United States Patent 7,365,185 (GENOMIC PLANT SEQUENCES AND USES THEREOF) - sequence listing, part 71

SEQ ID NO: 74372 - DNA, 28842 bp, Oryza sativa
ctagagtggccatttctcgatgtgttatgctactaaaccatgcatgataatctatcactcacaattgctcaagaacttcttgttgaggtggaggagtgagagagagtagagagaaaaagttgactcttttcttagcaacaggtgtgataccaagtgcaataatagattccggaaccattccttgatgggttttaagatcgcggtgggaggtgtagaggatggtagcgtggtataggcgacgatcgttggcttccttaaccattacgaacttgtgctatgcaccatctttctcttgtacttttgtcctaaaatataaacagttttggttagataaaactattcttcctcttcccatgtgttatctcgggaacatgcatggcatcgtcttccttgtatccatatttcaatttcaactcttacacacgcctcagcacagtaaaacacatagtagtatggatcatgatcgttgtcgtccaaacctagaatcatcaccaatcacatataagtcgatcgccgtttgtttaaaaatattgttttatatgcacgaatatacatggatcgccaattatatactactatctgaagaactatcaatcaagataaatagattaggggaatatgcgtgcatgcaaaaacttctccttcctttctttctttctgtcgatctgcatcggaattgaagacgagaaaggcgatggagagcgcacttcaccaaccaagcaagcacagcaatgcacgcgtgctactccaaaaggtgagagaagctagagctactgaagatgcgatgagatcgagcaccaaatctaaaagccgggcaagcagctgctacagctttgatcggccggcctgccggagtgcagtgatggacccaagatatatacagaaaaataatcccagacgaccgaaggatccaacgaagttgcataccaagtttctcgaccaattttttgtaccctgtacgtgtagctactgggcctatacgtatggccaacttttgccttgtagttgatatggagtagtagtatgtgttaagctcttttctccctgggtttgagcttttggttgaactaattggtgcatataatccaacactatctccattctcaaaagaacgttgtatgtacttaaatatcgattattaggctaagaaactttagattcgtcatgaagaacaatggttatgtttttaacaattttataagtttttttataagtatattcaattagaaaaaagtggtgatttacatgtacgtatgggagacttcgtcgatgtcagtaaaagaatcgttggtactagcatttgtttctcatgtcacacccacatatttaattcacacgcgatttcttaccacaaaagctaatggcagtcggctgagtttaatttagcaacttggctgagcaacttcaacatattttgtgagtacacgcttttcaaactactaaacactagaaatactttataataccatatagacgtttctttaaaagaatcaaatgtatctattttctaagtgtaaaattattaagaattaattaattatttattaatgatctatctcgttttatgtgcaaccaagttaattggccgagctaaatgggcagttcaaacgcacgatagagacagacaaaatgctggaaagtttacataagtccatgggaattgtaaaatgcgtacgcgaatgtttatatcgaaagcccactgctttgaaattttcgtaactcggcctccagggaaagcccagtgtgatggatgggccgagaaatttaagcctgtcaatgaggccttaaagtggggtggtacgcatctttggtgatatttggtccatattagctgcagtacaaacaaattaatctagtttgtatagattgatatcattttaaaccatattattttttggtaaaataatccatttagtttttattaaactttgataaatacataaaaaattatgctaaaaattgacaatattgctaaaatctttaaaatttgataaatgtttatttttgctacaatctaaacaacccctaagactcagcgaatttatactccagagcaagatagccaacaagaacattaacaagtgcaaccaccaacatgtccatttaatactgttttgaattggggagactgaaggagagggagatgattgtccttttacaaatgattacataaatccatgattttttatgagtaaaatagattgcttgcccttaattaaacttatcctaagatgtcatctagtttcataaacttagataacatacatcttagatacataatctttgtttaatataccacgtcaagtccaaagtgctgcttgcgggactagagtactgaccagggttccccttattctttttgcgcggttaccgcacccccacgataaggtgattactacggtaaccgcgcgattaccgagaaaccacgagacgtaccgtggtttaaaaactgaaaaagttaccgtgcatggtaaccgctataactgcatagtaaccgcatggttttgtaaactatgtactgacgtggccatctaccgtgggtgaagtttcttatgcagcccctttcgttacaataatatcaaaatcggctctcataattcagcatgccaccacttgaataggagagcaggcgaagaagtagctatatattagggcgacattgatcatccacaatcaaattaaaggtccccatagcgagatatatgacgcgatagggagacgttaagtttgtgcacatacgaatgacccggcctatactcttccttcccttttgagccgagcaattaatttagaggttactgtagtggaaattaaggggttaaatgaaaaggtcccatcattatggatggtcatgttagctctatggcccatctaattaaccgatctcacgtggtacattaagccaaaattataggctctaaatgagcattttgttaagttatgggtctagatgacattctatgataagtttaaggattggcattgtattttgcctttctttaattaatgtagtataaaagaaattttgcacaccaatattgatttgacatttttgctttatgatcgatcgatcgatctatctatctatctactagcatcattattattatcaattattattatagctacacataatatgggcatcccattcttttacacgacaagaaataacagtgaatccccagtatttaagtggtaagagcataaacaatagtgagctaatagcgagaaaacggacaatatgccactgtacaggttgggctgggataaaataccactcaatacaatgcaccggatacaatacattgtctataggatgaaatgctactttgaagatttttgtgcccaaaatatccttggagagagagaggagatcaggggagcgccgtggagggctgcccgggtggcgccagaggcctcgccgggcggaggcggctggcgaggatgacggggggaggaggatagggcagcgggccagcggaggaagaggcgacatcgcctggcgaggccttcggcgccgcccgggaggccttccctggcgctcccctctcctctctctctctctctcgggacattttggacataaaaatctccaaagtagcatttcattcagtaggcaatgtattgagtggcattttatccgatgcattgtattgagcggtattttatcccaacccaacctatagagtggcatatcgtccgttttctcgcaaatagcctgcttacttaggattttaacacatgtgatagataaaagaaatagtagagagaaaaatcgggtactaattagttagcggccaagtgttgcacgtctattttacaactgatagcttcgttatgagccctcttcatgccacaccaacgaataggatgacaacgtgtgatcacacggtgtacaattcgttggatcaagatataccagtactatttagaaacttataccttaaattggtgaaagcaagcaaatagcctattctaaacaacaaaagagaggaaaaaaaaagagttttagcaagttttagagcttgcagctagcccttttgaactggctcaaacaacaaaacaaaaagggacaagagaagagatggcccactaatcagtgaccatagagtccgtagtatagagccagtgagtgacaagtgtcgcacagcctcgaacgcgcaacccccccccccccccccgccaaaactgtccgtacgatggggtgcatgctcccctcgccgcagcgcgcgtgcccgggcgccccgccgccgtcgctgccgccggcggaggacctcctcttcgagatcctcctccgcctcccgcccgaccccgactgcctccaccgcgccgcgctcgtctgcaggcgctggggccgcctcatccacggcccggccttcctcccccgcttacgcgcattccaccgaacacctcccgtgctcggcttctaccacaactcccgctccctcggcccctccttcgtcgccctcgccgcgcccgcggggccctcgctcgtgttcggcgacggcgactggagcctcctgggatgccgccacggccgcgtgctcctccgcagcgggcccggctggctccagctcctcgtctgggaccccgtcactggccaccgcagctccgtccgcctcggccgcctcgcgggccacgtccgggcctgcaacgccgcggttcttggcgaccaggacacccgccgacacggctccttccgcgtcgccttcgtgttcaccggcgagggccgcgcgtccgcctgcctctattcgtcggagaccgccgcgtggggcaggctgatcaccgcggggacagcgcgctgcggcgacgtgggcaagaagcccagcgcgctcgccggggacgcgctctactgggcgctcgacgacggccgacggcgacatcctcgagctcgacatgggcaaggagaccctcgccgtggtcgagccgccgccgcccgacgctctggctctgtacgggaggagcagcatccagctgatggcctcgccggacggcgcactcggcctcgccgtgatggacgtgttcagcctgcagctgtgggcgcgggaggctggcggcgccgatggcgtcgcaagcaccagcagctgggtgcttctcaagagcattgacctcgacgtgttcgctccaatgccattgccatgcgcaggtgggcgggtgattctggtgccgcctgtccggctgctcggggttgacgaaggtggcatctctgcgttcatatggacaattgaggggatcttcatgctccatcttgaagatgagatgctgatgaagaaggtggctgcttccagagtggtggactttgtttatccctattcaagcgtctatgttgcaggtataacatgcaatgtttttttttatgtgtttacttgctctcattttgaatttgatttgcctctaaatgtgtaattttcgtagtatctgaagatgaattgcacaaatgacttcaaatccctgtctgttctggttgagtttagttgcagttatagattgcctttctagtttgtgctttgtggataggaatgcagacatgcacatatgaaatggatgttagcagtatcaagttgatagtttactttgttgaagtgacttatcatatttcttgcaattcatggattcaagaggatgtaaaatgggtagtacgcagaaattggcttatcagaggtgcacctcaactagcatattgttaaaatgttactgtgaatatccaattcccgtatggtttgagttagtaagaacatagggcttgcattggtatccattttctaccataattgaatatatgtgccttttatgggtaagaatatagcttctgatttctcttgaatatatcattgaaatctggtaatcagctatcaggggatgagctaaagattgtactggtggatgtgaatggtgatcacatatttttggagtcatccgtatgtaactacagtgttgcatattgtagaaggagctatgctttaccttccatttaaaaaggaaaattctggggtcaccctcacccatatagaactatagcatgtttactctataatactgatacaacaacatctactatataaagtttgaaagtttttaaagtataacaaatgattcgcttagctattttaagctccgaagttactcatttctgtaagaaagctgacgaatttatgacatcataaattggccaaactagttcatgctcttgtcttttcagaattaactagctttcttcacgtcgtacatgcctgcaaaaatagaggctgtgatgtgggggtagcattgtagcaaccatgcacgacaatctcatatttcttttatttttcctgtgactgttcttgtgcatctgcaattcacaccatgagctttgttggtaaagattacatgaataatactccctctgtttctttttatataatgttggttagttcaatcatatattttgggatggaggggggtattcatttggattatattgtatccagtaacctttcatgtgtagtcttttctgattgcttttatttgtgggttacgttaaaggatggacacgaatattcgtttcatcatgcactacactgaactaattacagagagctttaacatgcattcttgattctagtgaccttcagaaagatggattctagtgaaagaacctttctttcctttggggttacccacaagtagttgtcaaattgctagaatttcgaattgccatatatgtgttgtgcgttaatgttgttacatatcccagttttgctggtttctgtgatggactgatggtcttccataatttggcctaactctccagtaatggcaggtggaggtggtgaaggtgaagatgctggtgcagttcatggaagtggacggctgtaggatctttggtttgcagaggtgttcaaggatcagctatgcatctgcactgctttcaccaatgtctaacgtattaagcacatactaccatataagtattattagctattctaacttatgttagatcacgcatgtttcagtcgtaaaaggccaatgtgtcagttgctctatgtttgagattacagctaatactccattgagcatatatttgctttatgcgaagatattatcagattatctttatgctccgtagttcttctgtaaacagaagatgatcttattctgtttgttctgtgataatccagcagctgctctagcctgtaggctcttctcagaagtagcagttaatatcttaaatggaaaattgatgattttctccatagttgcatgtgcttctacattttgtccaaagatattttttcttgatcttctgtaaacagatttgggacaaaaaacatgaagtacagtctgtacagacaacttcgtggcatatttgtcgaagcgcgtgcaactgtagagcgaacaataaaatttcccatttagaagtattctttgttgaaaagaattttaaaatcgtgaacacacggaattttgaatttcaatatttgaagcaaaacgtcagactttggctgccaaaattggggattgttgcatcaaaacctgaagaatttgcactgtgtatttgttctctggaacagctttggtaatttaaaaccataagaacatacttccttcattattttaactttgagttgttaagctttgaaccgacaacattttttttttcaaataatttagttatttgacattaaattcataccaatagactactagtcgatagtactttactaggatttcacattttaattttttttgaccaactcgatctgacttagcataaatcttaattggtcaaaattcatgtgctctcagtcaaaaattcaaaatggatataggaagcattagtgatatagaggttgatttgtggatgcatgactccagccaccaagtaccaaattttaatacccacgaatattacacatgtgtagctttcaatatgattttagtaagaccagaatgtgtcgttggtttccgtctcttaaaaagtgtgttaggaggggcacatatgtagcgacccacgtatttcacttccgaggtagaatatcagtctacggctcattcctcagcaagaatcaacttaccgagaaataggcacactagagtagcatagcagaaacagttatagcgaaacccattaaataaaaaccgtaaaaaaataacttttgccaaaataagcactaatagtaccttgctactatagaccttcatcaccttcaactctcagttgatgtagagatatggaacgattatttgctttgatcttgatcaatcatgtagaatatttcttcacctaattgttagctcaacactataaggaataatatatatatatatatatatatatatgggatgagtatgaatggtactcaacaagtccaactatagcaacccaacaattatatgctcataatccacctgcataatacatatatgtccaaagtcccataatccaacaaggaaattcatacatgttcataaaaacagtgttgtaaaagctcatattaagtaattatgaaatctactgcatataaggcaccacaggtattagaacctccgataggttcctttcctgccacgttcatagtttctacctgaaacaggaagtgacatatcacaattcatacactctccagaggtgtgtcgctctgtacccacagacgccttaaacattttaatactcacgcccgttagcgcttgaagcatacttcatggtgtatgccagcaaggctaaggtcataagcttttcatcaatcccatctatcaattatctctacgggtgattccctcaacaacggcgatccacatcatctaatcggatcccgcaacaacggcaatcctcatcgctagcctacgctcacggggttcacggaagtccttaagcccgcaggataaagccattaagaaagatctactacgctagcctgtcccattccaggtcatgtggtctataatacaccgagtttcaaattagtatatttcagaaaatattagaacagatgcgcaaaagtgcaatttttaaattgttgttcgaatagacgaccaggaaccatggatgcgtagggcttgccgactaatgcaaaatagactataagttagtttatagtaatcggagtccaaacgaagtctcggggattgaatcgatttggaccgttgttctcctttctagactatatataaccaacagtaaaaaaaaagggggcaaagagagggatcgatcccagccctagccgtctttatctgttttgggcaccgccatcgccggacgtcgccgctgtcgccgatcgtcgccggtcgtcgccacagccgtcgtcctccacagccggtcgctggtgagctgctgctccttctgttaatttccctgctgctgccgatctgatctcttccttgctgctgatgcatggcttgttgttgctgccgatcctcgttgctgcttctgctgttgttgatgatctgcaacgaatgctgctgctcctgttgatggtctgcaacgaacagagaggaggagggttagaaggcagagaagaacatgaaggagggagagggggaaattagatagaagaaaggaaatttggggaatttggtggatatttcaaaattcattgttttttttacaaattagtactgctaggtaattcgttttagtctctatttgtttctaatttatacataagacgatctgtttccgatagctcaaatttattttattggctgctgggctgaaaacgtatttttaaatctggtattaaaccatcgggattcagattagttgttctaaataaagtttgtagtcatcgccgatatctttctaacggcgctggtttcactcgattctgataaacggtttgagacaaacatcagaaacaacagtgctgacctggtccggaaatcaagatagcaattcgttttgtttaatctgagaccaataaagacttaatctgattttgtgcccaacatgaaagatgtagacaattttatctagatgtccgaagtagtattatttgctagatttcgtaaacggtttgcgagttacgcataaaacagtaatgaagctgctatatgttgtttaatataaatcggttaaagtttatatgttctaggtttcgattttagtgtaactattattagttgaacatagtggtttattcgtagttttgctgcataggtgtggggagatctggtgtggagggtggttcgtcgggttaccgtcaaggttaaaggcaaatgcatgatgaactaattgtgtgattcttggatcgtttactctatctatttatttctgacatatttttatgtgataagtgactgtttatgttcagactgttgtttacgccatttagatttcaagtttatcttatgtctatgacgttattcttgtttcgatattccggattctggttctggttaaataattcaagttccatgcttgccatggatgtgcaatatggtttcaatttggttctttgtttctggtttcagttattcatgttccatgtgagtcatggatgtgctacttggttttctatttatattcctgtgggtaagtgctgatcacgcttactcagctttgccggcaaatgctaggatgtattcacaattgtccgggatggaaactactatttcaattcatatttgtctgggatgggactactattgtctttaacttggtgtttgaaatatgattcttttcaaagaaagaaagttttctgttcaggctttattgcgcatgatgtgtatacgtgttttctagttccatattatacttgctgagtatttctgtactactataaaaaaagtatttctgtactcactcttctgtttatttgattttagatacacattgagatcgacatgcatgggcgggaagtagcacccttggattacacatttatagcactaaaaaaatttggttttagattatgatcctgcttagcataagttttgcgtagaatttgtaaatgtcaattaaagttatggttcgtattcttatgtgggatttatggaactaggatggtttggattgtgcgaattatttcattattgatttatcttataactgcctgtcgtggatgttcgtatttataggggagactgtcgaaatttctaataattttgggagttagtggttttgagtgtttttggtgtggcactctaggtacgtggttacctgggctgttacatagtcgacacgatcgctacgacacttgcatgccatataccagttgtttttttaaccttatgatgataaatatatgcaactgagcccccaccacaatgacaagtttagaatacatccataatatgaccaactgctccaacaaccaatcgaatccttcaacatatttattttaattgcagaaaatataattaatgcaaggtgatacatatagattgcaaatacgaaaatataacaagagttggtcaaaggtgttggacttgcttgagatacccgaaatcgaagaatgaataaatcaataaagaattctagaaatccaagataaacacccaactaaaagaaacaataaaacacaactaaatatgataatgtttatatgaatgcaatgggatgttctactcgaactcacatactggatctatataggttatgggtttgcttttattaaacttattttaagaaagagtagttattttgtttagaagaaatttgattcactatagagattttattccataatctctagatatatttctttaattagaacatatattttggtttgcttgacaagataatttataaggtatattttgaaggaatacttttatttagattatagtatgaaagattaagttatatatatatttacttaaaaaacaatttaatttaatttagaaatatgctgaagggaattaaaataatacatcagcatttgcaagaattaactttgaatagtttaaaggatttaaatgtcatatactattttttctttattttttaactctacctctaaattctattagcccatctacgaaagcccacaacaacacgatctacctagcccaccttttttctctcctctctttttctcattctctttctttttctctcgctctcccttgcgccgccgcatcctcaggtctcaccgtcaacgccgccgttccaccccactccggccgctgctccctgctccggcagccgctgccagcctgaatatgttctgtggctcctcatgagtctgcccccaagctaaccctagccatcaacccctctccaatcgatgctgctgctggctactgctctcaacgactgagattggaatttcccagccccatcgcccctgattcaagcatggctcagaccagccgtgtctccccgagctcccctctgatcccttctttccctacttctgtggtgtgatctaattggtgttctcttgtgtggtaacctattgtgaatttcgatgcttgtgaacacgtcctaatgacgaacttgatggtgctatactaaggattatcctgctgtctgtagggatgaatgaatgaaggcaaaaaattgcttaagggcatccaaaaaagtgtaataaaaaaagtgtaattagttggtggacaccgaaataacgtgagtttgttgttgggcaccacgaaaaactggtaattagctgatggacacttgcaaccttattttatgattctgcccttgcgtggctccaacacaatattctctcaagtcctcatccctatttacccaagatatttttgatgttcttgttagcaatagctaatcgctttttgggaattgaatttaaatttttctggatcacaccgtcagtccaaaagctagggaaagcaaggaagcagcggactcaccaatgcacttgccggagctctccttgggaggcggccgttgcggttcatctcgtccaagaagcgatcgacatacttcgatccctccttcctgccggccggacgtcttgtcgaggaagtggaggtcgcggagccccacctgcgcgttggactgcatccacgtcatccttccccccggtcgcatgcccatcccggccaccctttccggcactagaacgacgacgtcgacagcaactgctccaccccattcgccaacgccatggacgacagcatcgacagcaactacggagctcgagttcggcgagctctaccacaacggccagatccagccgcgaaccttgtccccgcccccgaatctcgaccctgacagcgatgacgatgacgactgctgccctgtgccagtacgaggctgtgagccatcgtcgcggagcggatccgcgcaccacacgcacaaggtccatgtcgtcgctctggatcttggctgggctctcttgcactcggctgggtcggaggagctagccgcgaaggcgtcgcatgaggatccttgatgccgcccaggtccctcgagctccgccgccgccacccaactgctggtcgctgtcgtcctactgccagcctcgtcgaactagaggaagatccagcgaagaagacaagtcttacaggtaggccccacagaagaagtttgacaagggtaaatttgtctttaatgagtgtttctctctccaatttctccataaatagtaaaataatcttaggagtgttcatcagctaattatcagttttttgtgatgtccaacagcaaattcgtattgttacggtgtccaccagctaattacatattttttgaatgccctgtagcaaattttgccatgaatgaatacttacataatatatcctagagtaaatgcagtactgaaattaaaagcacactaacatgattttgtccttataaatatgcttgcatgtagaataaccgaatttctgaaattagtggcacattagcaggattaaatccctgaattaggtttattgagcaatttacatgttctacaatttgataattatggcaagatctgtactttatatagttgaattataacctatgaaatctgacattgaatataaagagatggtgactgatttctttcgatgatttactactactatctatatgtcctgacatcaatgtatgctttacagaacaaataacacaatttatgtcatacttgattagaatggttgacgaggccaataattgaactattgatcaactaattatatataagaaacttatccagatgctatgctctaaatctaaacagtttctatagactatctactataaacgtctatggttttctactcattaatcttatcaccccaatttaattctttttactggaacacactactcatcttctatacctgtatatgcacattaatctgaactactggtgccatctggacttttactaaattctggaggttaaatccagtaagttattactatctctaattaactatttataaaatcaagattcatcttacagggtcttttggtctttactgaaccttatcccacataactagttatatatctagtttttaagcccaacagcacaattaccatacttctaagcaatataaaatatttcttgctgctagctacatgatgatgcatataattttgaactataactaatctttctacttgtcagctaaatcaaaatatttataccctattggttacacatgttctacaactgaaattattatatgttccttttactgattcagagatgctcttgttcatattctttttttttaataatggaaatgggctacatctccggcctctgcccgtaggcacacagccaaaaaattcagacgtgaacagaaaagttaaaaaaaggcgagatgggacaaacccccaacttctgccgatgatatgatctactaaaataatattttttttcaaaatcacgtgaatactatcacgaaattctgtaggtactacgccatccaaactggaataaaagttccttggctactaattctaagcgtgtagcaccattgcgcatagtatcctgttgttcctgtgaaagcatcatacaccaagagtggagccaattggaacacatgaagataacctgcatgatgttagacatttttttatggttaaaaactatatcattacggcaacgccaaattgaccaacataaagctccaaacaaaatcattttttttgtgggtctaggtactccccttagccagtcaccaaaaatatcttttgcattgtggggagagggatgttgaaggcaaagaagacacatcaccaagcaaaacgtgcaatatgacagtcaaagaaaagatgttggatggtctcttgtgtattacaaaaacaacattgcttgtttccccttcaatttctctttatgagattatctttcgtcaagattacttttttttgtgaagaaaccacataaatactttgatttttagtggtacctttacctcccataagatcctcttgtggattcttacattggaattgatgatcgcattatacatggatttgaccgaaaaatggccatttttatgtagcgaccaaataaagcaatcattttcatttgacagggttatgttagctagtcgagagatcaaattattccactcaactaactttggtcctacaattgatcgtcggaatgaaacattcaacggtgttgtgctcataacctctgccaaagtagaatgtcttttttggaccacattgtacagagaaggatattgatatttgagaggttgcaagcccaaccatgtgtcttcccaaaatcttatttccatcccattaccaggtttaaaagatccatactgaaaaaattgatcttttactttcattaggcaagcccaaccatgtgtcttcccaaaatcttatttccatcctattaacaggtttaaaagatccatactgaaaaaattgatcttttactttcattaggccagcccaaaattgggatgttcctggtttgtgtgacatgtgggagaggggtttaccctttaagtacttgttgcgcaaaaggttttgccataggccatcaccattaagaagcttgaatagccatttgcttaacaaacatctattcatgatatcaagatttaggacacccagtccaccttgatcttttggccggcatatataatcctattttgttaaccgatatttctttttctagctatcactgctctagaaaaagctcgatcggtagtaatccaatctttgaagtacacctcgaggtatttcaaaaaaggataacatgaacatgggaagactcgaaagaaccgagttaagaagaaccaatctcccaccataggagctgtttttgcccttccatgtgctaagttttctttgaaacctatcctccacaaatttccaatcagaatttttgagttttcgatcgtatatggggattcctaagtatttgaatggaaaggaaccagaattacaaccaaacagttgtctatattggtcctccatttccttagctcccccaaagcagaaaatttcacttttatgaaagtttattttcagccccgagagatgttcaaacacacaaagaatggccttcatgttttttgcttgttcaaaatcatgttcaagaaatattattgtatcatcggcatatgggagaatggacaaaccatcatccactaagtgtggaattacccctctaatttggccatcggctttggctctttcaataagaatggctaacatgtcagccactatgttaaaaagaattgaggacattggatccccttgtcttaagcctttgcatgtccggaaattttttcctacattatcatcttgttcatattctaatggatgagaatgcaacacacaactcctacacagctctgattgtccatcctgtggagaatcatgccatcctcaatccgcaatccgcaatccacaatattcaaagcatacatactaatgtgaattgtctggatcttacaatctggatcggaggttctcacaatgcaaaagcatcagtggtccaggttccaactaaaggcattgcctcgttggtatgcatctcttgtttttaatctgtctgttgcaaggttattaaggcggtatggcgagctaaggcgctgcatacccgcctcaacgctattgcgatatggcggtaaggcgtggcgatgccctaagaaggtaccctgctagcgattagaggggaaataaggaataatttggtatggaaaaattaaaaaatgacaaaacagaacatcaaaccaaccctcccagtaacctattggtcaaacattctggcctaaaagcatcgcgcattagatgtccacagccgccgccacatgagaaaaccaagcgaagaagagaggaagaaaaccaagcgaagaaaagaggaaggaaacaggagcccagccgagtagaggagggaagcagtggatgtagcagcgaggatgccagcggggacgtgagggagacaatctaccgtagccagagctgatggtgatgggaatcgtggattctgagtcatcgccgccgctgctagggttccagatgagatggaatcctctctctctctatatctcgcggtgatgttttagggtcaccataatccgaaattgctaattagcgcccagttgcgctcccccctccccgcgcgcgactgggcacgtggcgcgatgggggagggggagggctgagcgacgcgatgggggaggggtcacgtggcgctggttggttttttttcggttttttccgtttggtttttttccggttttggttttttttcttttccttttttgcggttttcctttcaggttttttctttccgatttttttatatatacgtatataaactttttatatgtacatatacaaagtttgtatacatgtatacaaactttgtatatacacatacaaactttgtatatgcatgtatataaagtttatatacaaacttttgtatacgtacatatacaatgtttgtatatgtgatgtttttttttgttttttcaattttttaatacgtacatatacaaagtatacaaagtttgtacacatcgtatataaagtttgtacatgtatatatttcttttgatacattagaaatatatattttttatagtagtagtactaatagttatagtagtagtgtagtactagtagtgtactgtagtagtactagtactactagggggcaccgcacggcaggctgggcgtgcgtccagtcgcttgtggcatcatcaatgtttactacctactttatgaataagggtgggccctgcatcagtgggtattagttgttgttgtagccacaatggtgaaagaacaaaagtgggtagtaagctggaccccacaatcactagccatgagagaaagatgagagaaatcatttgtttattccttatgactaggtagtaagtatatgacctggtattagttacttactactcccacaatgtatacaacctggtagtagtagtattttattctttattatccactttagatgtacattgtagatgctctgagtggatgtaaaatccggctcctctaactgctagtaaagagtatacaaaacagagttaaactaggaccactaggagggatatttcttgcaattgtctgtagcaggttcagctcacgttggcgacaaaaaaactaaaaaagtcacaaaagaataaaagcaaaacaagtaattcctccgttttacgatgtaagtcattttaacattttccacatttatattgatgttaatgaatctagacatatatatctatatagatttattaacattaatatgaatgtgaaaaatggtagaacgatttatattgtgaaacggaggggtagatatttagatgtgaagcatttacacatcatccatattttgctcctcaattttgtactacttatcgtacttccttgtacgtgcgattccattcattacttcttgtttgggtaaagactatcttatcagcttaagtgattgcgatgtgttacccaaaccatttaactcgaatggataaaagtcatgtgacaccaacatcattaaatcttaactaattaaaagattcatatttttccgttcgtcacatgattttcgtccgtatgcacgatttttcacccgtccgtgcgatccgtccctcccagagtccgagtctgtattaaaaaaaaatccccgagctagatccccaaatcaatcaatcaaccagacaaccaaaaacaacacgaaaataccaaatttaaccttaacctcatgaatttgatcaccacaagaaacctaatacccatgtatttcctccctcccaatccgatccgatccggcaatacagaaagtcaaacaaaggcaatcatgtatgaatttgctggcaaacaagaggcagcaggaggcacgtcgggttgcaggcgacgtgcggcggcggaagtgtttggcgcggtcgttgggcttgttgtaggatcgagatgtcgactagaggggggtgaataggcgatttaaaattaaatgacacctaatcaaaactaacctaagttactaggctcggtgagggacaagactaactaagcaactaagttatgttttgcaatcctggggtgaaagtggctcaagtatatcactaggaaagtaaatcacacttcctaagtctagtttagcaatcctagggtgaaatgatctctagtatgtctctagaaatataaattgcacaaatgtaaatgcaacaagtaaatgagacaaggagacgagatttttgaccgaggttcggaaactcgccggtttcctactccccattgaggcgatctcaactccaccgctcaaccacgaagccaccgtacgcccccttcgtcaaggggtgggcaaggcgggagccggcccacggagaggactacccaagcctcgatcactagggtagttcttccttcactccgaaggtggtgaacttcaaaccactcacaaaccggcaccgggcctcctccacaattttctcggagaggtcaccgggaaactcctccacaagccgtctaggaggcggcaacctccaagagtaacaagcaatgacccggcgtggagataatcaatcaagtgccacactagctctacaatggaagcaaatgcacttgactcttggctagaacaacctcaaccactacaatggatgaacactaagctcaaaggtgtgtgagagaggtgcaaggggtgtatgcaattgaattgggtgccaagagaatccccttgttgctggagggggagtatttatactcccaccaaccaaaactagccgttgggggcgaaatcccccaactcagtgctctgccggtctgaccggaggtatgtggccggtcagaccatactactctacaacagctagttttctagccgttgcagggctgtcattgggccccactgcctaggccggtcagaccgacttggggtggccggccaaacgggcctcggctcggttagaccgccatcagctcggtctgaccgaatacggctccggcggctcgggatcgacacaccgagacggcaccatccgggccatatggccagccggtcagaccggcccgcacacaccagtcagaccggcgttgatacggcggtcagaccggccctgacatggcggtcagaccggcgacgccggccggtcagaccggcactcggccagcggtcagaccggccttggcaaggccacacaatgagcgcacaacttaaaatgtggggagagtctaaaagcgagcacaagtctaaatgcataatgacctaatgtggcaatttaaaatcatctctttgctaggtcattacccctcttaatagtacagcaaagctataaataaactagcacaattttgatcgcctaacgccatgatcaaattaaaatgaaaacactagtttaccgtcttctcttcctttagctttgtgccgtcaattttaattgcgcacacataatgtgaacctaacttaaagatatagctcaaaagaatggttagtccacaattagcgcttgtcattaattaccaaaattaacaccgggggcctagatgcttcacttgtggacaagctcgacgcgggccggcggcagggatagcatcaaggcgaccggcgcatttggtggcggcgtggctccgaagcccttcctcctgctagatctggcggagggagggcgcctctgggcggccgccgctcctcccgccgcacaccgctgccgtggaggggagggcgcgaccatcactaccgatgccgcctcccgccgctgggccgcaccgtctccacctgccgccgccacctgtcgtccgccgcctcccctcttgcgccgcggcctgccgcctcggctctgagagagaggagagcaaaacgagagagaagaccgacagagaggagaggaaaacgagagagccttatttcctcggtgggccccgccgaggggagggcgccgtcagccgggcggagggcgccgtgcgagggggacgggaagcggcgcactggtgaggggagaggggagggcgtcgctggctgcgacggcagtgggggagagaacaccaagaaagaggaaaaagaatggaggagagagggaggataagggaagtcgggggaaaacgagaagatgaggagacaggaaggatcgagaggcgccgctcgctccgcttgctctctcggtgataagtatcagatctgacgggcctttctttttaaaaaaaagagcactctgtattttaaaaaaacaacacaagtataccatataatcggcacatatagggatttataggggttggtttttaatttttttcggtttaaagtctaatgggtctttcttttacaacttttttatttctataaggaatatttttttaagggctcatatcataaaaactaaatcctaatcatctactatttttatatttgttataattttagtttacccgtagcaacgcacgggtatctatttattaaaattgtttaaataataaaaaaattcttggcctgtccgtctgctctctttttcctatgtccttgtccttttattttgtcccctcattgtctaatcttctttcattttttatgtcaacttattaatatttgacctcaaatacaatttgtaaataaaaaaacaatactcactctcacaaaattaataagatttatttttaagatttgttaaactccacacatttttattaggtaacaatacacaggtacattcgcacaaatgtaaagtgagtatagtttaacttgataggtttcttgtggtggaaccagtcaacctgcattcaaatatttgatttgacacgggtgctcgaggcgttcgtggtaacttcgtcaatctaaatactcgtgttgtgagtgcgtttgcactatgtgtttctaaaaatatatatattctcgcaattcaaagtacattgagtacaaaaattccactcgtgttctacataaaaaaaaatatttccgttcatgatacaaattttcatccgtcgccttttgggcaaagacagtcgcattattcgtccatccattttctctcatgctacaaatcatccaaactaaacatcatttctacaaatatagagcagattatttatctaaaagcaaacaatttttttagcagattagttgactaaaccaaacaacaccttttgtcactgtacacattccgtaatcacccggtgcaacgcacgggcacttttgctagttaaatggataaaatttagaaatttattcgtgtcgttttccgaacgcaaattgcagattgttgactccatctggtcttctcccccaatttcttgctcagttttttctacacccagttgtacgcaggttacttattggatcgatcatgcatatcaatgtgttgaccagttcttgatgcatatacaattgtgtgtcatctcctaccttacaataacaactaatctggcctgttgcattgcaatcagagcttccgaccttgcaaagaatgagctgctaaaagcatttcagtgacagctcgagagtgtgtccaaacatgggggtttctccatggattatcatcttcttgttgagtgttattgtgctggtttttgtcgcttcggccgacacgaacgcaagacagtaagtatagttcagttcctcttcagtatttgttgctgcagtgctaattttgatgttcttcttgtctatctctgcagctgctggcctcaatgggattgcaggtagctgggacacggacaccaaaccatcgaactgggggaatggcaacgatccatgtggagacaaatggatcgggataatttgcaccgggaaccgggtcacgtccatgttagtatatcagcatcagagatttgtatatgtccatggagtgatttttttttcttgcaattatgcagtaatatgagtaacaaagatcactcatgttgtcttcttgtttcatggtgtttttacagaagactgtcaagttttggattgtccgggacgctttccggggacattcagtccttatcagaattgcagtacctgtatgtattctcttctctctgtagtttgagcactttggattgcgaattaggcgtaaacatgtgcatagttggaaatttggaaatttatgcaaacttctgaaacgcttctgtttttgttgcagggacttatcctacaacaagaacttgcgtggaccccttccttcaaccattggaaccttgagcaagctccaaaacttgtgagtagtttaactttggagaagttcagttagtctgctaacttgagatttttcagtcagttcatggattcttgtttgacttgtcccctctcatttctctgcagaattcttgttggctgcagctttactggtgaaataccaaaagagataggccagctctcaaacctgatatttctgtagggaacttagacctgattcttgattatgtctaaaatcttaggcctgcggtcgcattccctgaacttctctagatcatatctaatctgaaaatagaatacatctaatagatttatagtctggttgaaaaatgttttaatataaactccatcatttgaaaaataaacaatttcgaactttattggttggacttttacctcagaatttaaagttcacctagtgatgtagattgacatgatggtaacattgtatattttaatcctaattttaaaatatggcaggtaagattatttcacttattagccaaccatgcttatacagagtatccattatctaaaaaaatgcttgtacagagtaaacagcaagtaaaaaaattaattaatttcctcctgtgagagtattacctccattgggataataggaataacaaccaaatggatggcctaaaaagcttaactacaaaaaaaatcctataagcttgtaacaagttaagaacttgatctggacatttagaaagataagtgtgatgcagttaaaccttttcccttttgggataatcaagtaccttaggtatggaggaggtggttatctggttttattagttggtaatattgaattctcaggcctggtgttcatctattatattattaaaacaacctttaaagaagtcaccatattcaccgtgaaagctagaaattctacattaatcgaagaaaatatgaattatttacaccgttagattgttatgtctatattttaacgtctgagaaaagccttaatgacattgccaccatatattttacttagcaacctaactagtagcaaacacgaagctttcttctatgttcctgtatcagcctttcacgcagtaatcgctcgtcgtaatattctgcacatatagtatcagtataatattgtacatttcctaaataaaaaagtattgttcattgtactctattcctacagatctttgaattccaacaagttcaatggtagcataccgccatcgctttgctgcctctcgaagctatactggttcgatctgtctgacaatcagctcactggaggacttcccatatccaactggacaagtcttgggttggacaatctaacaaacactaagcacttgtaagtaaattacaatattcttgatttcataagattttttttcattttctttgctgttgtctaatgaatatgtacacacgtttcgtcacagccatttcgggacgaatcagctctctggaaccatacctagccagattgtcaactcaaatatgaagctgatacatctgtatgactaaccaaattcttcatcctcctaaggaataagtccactttgactttcttaaaagtgacccaaatctaatccatgaccctgaaccacaaaaccagatatgttgacccctaaactgttaaaaccgatgcaatttgactccctcgacggtttcgctgatgtggcacgttacgtgacgatgttgacctagtcttcgtcctacatggtattgacgtggtgcttacgtgtcattagaattaaaaaaatatgtgcgcccacttgtcattcacaaaaaaaatttgtgtgacccactgacaggtggagcccatatgttagtctatcccttcctcatcctcccgatctccccttctctctcccttttttgttcatgagccccagttcgccatgccccatgccgccgtcatcgagcagccagctctccagcatcgagaacgccggcgcgggcttggcgccgccagtggccatcttgctgatctccgtcgagccctctggcgtctgggcagtcgccgccgccatagccaatccggcctccacctgctgcaaatgtcttaaggggaagatggcgacccccttctccgagcgacggtcggcgaccacagcggcaccacgccgcccctctcctccttcctgcctccgctcatgaatgtagccaatccccttggttgagctcggagaagatagaatcagcgccgccactctccctcccgttgccgccactccggacgccgcctgctgttgccggcccctgcttgccgaatggggagggagagagaaggggaggatgaagaatgtgggccccacctgccagtgggtcccacaatttttttaatgacaaatgggtccaacatattttttttaattctaatgacaagcaagcgccacgtcaatgccacgtaggacgaagactggtcaacatcgccacgtaacatgccacgtcagcgaaaccgctcaccaaaaccgtcgagggagtcaaattgcaccggttttaacagtttaggggtcaagatatctgattttgcggttcagggtcatggattaaatttgggtcagttttaagggagtcaaagtggacttattcctcatcataattgtgtttaattattgttgttaagctcagacctgagactgatttctaccatctgtatattatccaggcttcttgacaacaacaaattatccggaagcatcccttctactttaggccttcttaatacattggaagttctgtgagtacaagcgcatattatggatgagacaataaaattcatagattgacactgctgccttatgtcatgaagttcgatcgatgcaggcgtttcgataacaatgcgcaattgacaggaccagttcctaccaacctcaacaacttaaccaggcttacagaactgtgagtttactatgtgtgtctgctttattaattgtcaattattcaatattaatagcttacgcgctatgctttcatttgacactagccatcttgcaaactgcaatcttactggtccactgccagacctaactggaatgaacgaactcatgtatttgtaagtgatcagtcaacccttccaatgttaaaactaaaattgactttccatttatcatactatgcaactttctggatggtttcatcttactaacttgcaattcaatttgttacaggtacatgaacaacaatagcttcagttcatcattatttgaataatcactagccgacgcattataggctgaggcgctatcagattcataatttacatacctaaaataattatttgaataatcaccagccgacgcggtatatatatccattaaaaataggtctaacaacatatgtatgagaattaatggtacttgtaaaattattttgagaaacatatatatttgtaaattttacctcaggcttggtgtagtagggaaacggtgtagttctatggtatgctcgtccatatgtgcctttagcacagaagcttaactcctagtacgatggctgtgtacacttaacaaaaaatctaacaaattgatctgttagtgcaaatagaagcctttgttcacacgtagcaggatcgcagcactggcgtatgtcttggctccctgtacacacgacgaccacttaacccgagattgctacctggcgatggatcgccaggggcgatcaggattcggtcctcccttccttccacctgattttcttttttggcaccgtattactttcctaaatttatgcatctaaagtttgtacatttcaagttcaagtttagggacccaaaatttataaatcaagtttatatatccgattcaaatttaaatttgaattcaaatattttttatatatagtacatctaaagtttatacacctaaagtttataaacctaaagtttataagtcaaaatttacatacccgattcaattttgaatttgaattatatccgattcaaatttgaatttgaattcaaatattttttatatatagtatttctatgcatctaaagtttatacacctaaaatttatagacccaaaatttataagtcaaaagtttacatacccgattcaaatttgaatttgaattcaaatattagtttatagacataaagtttataagtcaaaagtttacatacctgtttcaattttgaatttgaattcaaactttttatatatagtatttctatacataaattttttcaactttgtgttttttttaaaaaaataatttatggtgtagtaggaagagaagaataagaggaggaaggaagagagtagtgtataggggggatggggttgggggggtgatctttatgctactatggttttgatgtcttcttgtgtcgctatctgaggtttgaaagtgagtaaagatctgaagctaaggtaaataataggttaaaacagaagaatgataagaataaagtacctctctgaatagctactttcttacttgactttctgatcaatagaaaaagacttgctgtcctcaagttcaaggccttagagtgagaagggaattacgtggtacctctctttttcaataagcattctaccactaactatgtgcctggctatggtttgtcaactcttaccttttggtatgagaacggatgctggaggtaaatggatacacagctactgcctgacttctcagatttcagtatggaacaaaaatccatcttggctagctattcgggaggacttctccatcggatcagaacatgaattgtagggcatacttagtagatgcagatataggtattcattattcttcctcagatggggaatgggccaagccgatccgttgttggcactgaaagtgcatttgctagtttgaaaggagctgaattcgggtgggattcaaaatgattcttatgtttcgtagcatgcagcgcagactcacttggtaaatagccttccataaaagaggcaaggtgctcacacatgaaattccctttcttcgtgcactcatttactagatagtcaggaaccttcttttgacttgaccagcttacttgtatagtatagtagtaggcatttgcttctgaacgaccttacgaatggatcaactagaaatgaatcggtgtcataaacgaatttagctaaccgttgtagtaaatagcatgacaccaagcaatcgatcaaagccaactcaaaagaaagcccatcccttcatccaacgtgaaaatattctcaagaagaagccaaaagaaagagaggtgaaacagagtagagagaatcaggtgcttccagtgattagttatcaaaaagcactgttttccagatcggattcgatcacagtcccgtaagcagtagggaccacgagtgagcatgagcctatttcgtgatcggctagttgctcaaaaaatcgtataaaaatcaagcaaga

SEQ ID NO: 74373 - DNA, 809 bp, Oryza sativa
tgccagtggaaggctttctgcgttcagtcaatctacgcagagtgaatcggtccctaaggaaaccccgaaagggctgccgtccgatgggtacactaaagtgacgaagttgctttgactactgaaccatgcctggatcgtcggagcgaattggatgatcgagccgagggctgccccctcttcccctcgctctcctttccttaatattcaccgtcaagtcatcaaagccgtcaactaattcagaggggctcagctggcccggtcgccctacgctactggcgcttcctaaggcgaagctctcgtctttggcaaccagcaaactcagggctaaaacctgtagttttgaagcaagggatgagtgcgaaagccattgcgcttccgtacacgtgcatacgttttcttgcttcgtcgcgcgttagtacaataacgcacagccgttttcttgctggggcggacacggatttctctctaaaggcgaagactcagaagtgggcgaacactcggcccagcgggcgaacatgccggctccggctccgcgcacctgttgacacctttcgaagcactttcacgtgtgaaccgaagtcgtcttgccgaactccttcctttcttatttcagtccttgcctttttcatcttccgtaggggcctttagtcttttgattagactagaggtcgcgagagagcagagcgtaccgcccttccatagtcacgaggatcttaatagtcggtcgcgactattgtcatagtcaacgacggttgaaacttcttggaaaaaacttcgaattgggagggcgatcctcccggtgagctgac

SEQ ID NO: 74374 - DNA, 25840 bp, Oryza sativa
cccaactatcccacctgaactaaccagttcattaagccaatttagggtgagaataatcacggtgaatctggtcgatcgcccataaccgcgagcaaggctattcgaatagttttactctggccagaggtgcacaactgtacccacaagacacaatccaccggcatgtcaccatgcctgcgtagacacgtgaccatgtcgagtgattgtgacaagacccttcgcataactctcctctaaccatccacaccacgctgaggtttcacccccacccctaccccgagagtgggcagtccccccatgcaccgcggtaaatccagcagctggacaaccggacactcggccgacccaactccatcatgcccaccctcgccactggtgcctaggaaagggtctgttgatgcgaaaaacacacactggcctaagagatttgctttactctagtgcaggtctaaagaattgctttcggtttctgatcgtgccagttggtttgatcttgcaaccaacaagaaataacagaaacacagttaagtcttcaaacgatagccgatcggttgtactgccgatgacgtatcgttcaatattaggccgatgtgatgtgaaccagatcggcaatgaagaatgaagcaggataaaattaaatctacccgatcggctgtagatatcaatgatatataatctatttctaaaaatatgtttaaaccaaagtgattgggatagatcgaacagtttgccaagacagtataaatcacttatgtttaaaagtacttcaagatagagattatatatattcatagcatagccgatgaagtaaatctaagatgtatcggctactccgatactactttatactaagatgttaatacagacaaaatatactaaacaacaagcttaatatgtttcaacgcagcaagatcttaatataaagggcagatttagcatatcgattaaatataaggaacaagacaactaaaccaggtaagatcggctgaaactccgatattatctctaccgataatcatagaacaagctaaattatggttctaaatattacttaatagatcgaacctaaccgatgcagcattaggcataaagagaaacataagatttgaacaagtcgatgaaaacctctttgagatggtagatatactatataacctagatcaacgttgatatctaaccctgtcggctgccctctgttggtagatgttagccgatttagggttagatagaaatattgatagagattatatagcatatatgacaactcgacgatttacataaataggattagagtatcatgaagatgtcagcactaatcacgagaacgcaagccgccataacaagttttacctcttgccggagatcgaacccgatgcagcccgacttgaaagcaagaattcgtcgaaacaaaaatagaaaaggtggcgatgcgccaaaagtgttattaaactgattgttcttcatttacaaggtcttgggtcatatttatacccaaaatacataatatgtccttgccggatacgactccaaatctgttacaactctaagatacgaacaagtcttttaggcaaacacttgccgacaaatatctctaaagaaactattcaaaatactctagttaatagatacaattgcccctttttcggatttatcccaatcgtggaaatacttgctcagcacatcaatcgatcccgaagatgattctagaaccaccttaccaagatcggctacatcggctgttctttgtccgatccaatgtcagccgatgcagacgttagccgacgtgcccccgtagccgacacgtactctgtttatgagaaacgatctcctatcaaatccgcttcgactttagctttgaatttgatgcatgatttaccaaatttggtcatcaacagggtcgagctatactacagatcaagcaattacccactcccgcttgtggtaagcgttgtatgtcttccagggtttcccgtgaactggtccttaattgctataggtgcgactagcaaaaccatgcacccacaacccaccattcagtcgcattttagttggataattacgaccaatgaaacattataacgccccaattttcggtcgggattaaaaatcaattaataatgcatttccagaaattatattaaaaattaaatcaatttaatcaagtgacatagtgagggaattaaaaatttcctttaaaaatcatggccgaaaatattttgtaatattctctgtgccctaatgtactctctggatttttccacgaattttcagagctcaagaaataattttaaagttacaaagttcatttaatcaattaaaataaaagcaaacaattttaaatctccatccttgtctttgggccgctatcggaccaatcctccatcccctccccgcggccttcctactcctctcccttatcaggctgtcggcccagcttggtccctccctcgcaagtccatgccgcctcccttctcctccctcctctccccgagttgcctacagatgggcccatattgccgggctctccttgaacctctagcctgggctggcagccgccacggccgcctgagccgcccacgtcgccgcctcctccagctccccctcgccctctcccgtgcgggcccgacgctgccccactccctccactctccttcccccactcccttcgcggaattcggcgccgtgccgccgcctctctctccccacgatgccgctccacgttgccgccacgcccggccacggttttccctccccgagcctataaaatccatccccgggatcccctcgtccgtttcctcctcctccccgagcttctcacgcccccttccgctctctccacgccgcctgccatttccgccgcactccggcgagcttcggccacgcgccaccgccgctcagccgtcctcgttccgtgccgcttgtaccaccagcatcgccactccttgccgcaccttggcctccgctccgcgccttcaatctgccgccgaagcaccacttccaccgccgacccgagctccaccaccgcccgccacacttcagccgcctattgccgccatccccgtctacctcaggttgtgccacctatttccctctctccaccgccgaatccccacctccattgcaaacccgaggctaccgccacattcgtcgcctccggtcaccgtttgccgccgctcccggccatcctgagccgcgccgtggccacctctggcgccgccgcatacatccgcaccttggccgtcgctcctcaccgctggaatcccccgctggcagccattcccctcaacgcactggtgagcacctccacaacctccgccttcggcccatgtccccactcatcgtggacctcatccctctccctaactcctcttaattgaatccccaggtcaccccggtcaccgtcagctgcctcgcgctcgcggtgcgccatcggactgtcgccgcctccctccgtcccgaggagagccgccgcccctcgtcgacgctgcttggtaagcccccatcctcctccgcttcatctccccggccgcctcgtgccgcgccgccgtcgccggtggccgtccggccaggccgccgccgccgctcccaccacacgccgctccagcgccatcgccggctatgctggtggccggctggccgcctccccttggtcccagccgcggccgatctaggccatcgaatcggcctcggcctccatccgggccgcccatgtgtctgcacacgtggctgccatatcggtgctccgtcggcgccacgtggtgcgctataggccaaagcccttgagtcaccgacgtgggggacccacttgtcggcaccaccccttccctcggtggctggcgtcataattcatttaaattgtgcaataatccggtaagaattataaaaaaccatttaaatggctcaaaacttctaaaattcataactaattcatacgaactccaaaatgagccattcaacttgcaaaattcatctaaaattgagctctacatgtttgtttactttttatgtactgtttacttcatgttcattagggtttttcctcgtttgtgtgccggcgagtagatttcgccgtttcggaagtccgcggtcgcgaggaaaagaatccctagttctacttggacaagggaacatctatgggtataaatacaagaccccctagaaggaaaggggcacgaaacagtcaaaatagacaccaatacccaccgccaaacatcgatatcagagataagcctaaacatacccaatttgtcgcctacggaggccaacaagagggatctagcgttatctctgatctcgccaagtccatattcgaggaggaagactaccccatcgtcgactacgcgttagtgttcatgccgccaagtcaatgacggctagatgggttatccaaatattgtacttgtgtgattcttttgaataagagcaacaccggcttcagccaataggagtagggctatttatctgattctgatgaataagaggcccgaacctgtacaaaaatatttgtctccgtctcttttatttcaatctcgcatataccggaggatcttgtaccaagatcccccgtaattttgctggtttctataatggtcacccataatttggcctaacttaggtggtgaaggtgaagatgatggtgcagttcatggaagtggacggctgtaggatctttggtttgcagaggtgttcaagggtcagctatgcatctgcactcctttcaccaatgtcttaactcctttcaccaatgtcttaacgtattaagcacatactaccatataagtattattagtgttgggatacgcgtaggctacgatagcataaatcaaaattttctatcgcgtaaactaggaaccatgcaagtattagatcatagatcgttaccactcgacgcgttgcgcagtggaataaggcgctaagaagtcgaaggaattctcgcgaagtatcgcgcgtcgatgtagaggaagtagtcaatcgcaccggctcgacgttctcctcctcatgcgttctcctcgccgtattcccacgctgttcagcaccgcaaaccagcggcgcctctaccgatatccacacgtacagggacggaacgccacgcgcagatgtgctagcacccgcgcgcggctagggttttgctcgggaggggagtgacggctagggtttctcacgtgatgcaatacctccaccggtcacacctctcacgaatatataggatccatcactcgggcctccaaggcccgtagaactcctattcagatccctatccgaattaagctcatattggatctccatccaatccccttattctggcccattaagtgtgcgaccctgtaggttcatgtacactcggctgtaacccgaaaactccttttcggtccacgcgtcaacagcggcccctagcagaacgtattgacccaccggtcatacataaagatcatatcggctaaacctctagtgtatactttatgaacccctttgcctcacgatatcgattaagctcaaggctagatatatgccatcctctaatagctcaatcattcacttgaacctgtgatagattatttaacttatgattgactcctcaatcacctttggcatggccatgcacttccataatctacaacatagagggcccagagatatctcttcataggaggggcaaatcccattttaattattcatatcccactacatgtttcacaacatacccgaaaactacttttataactacccaattacggagtagcgtttagcagtccctaagtaagctactacacatgttggaaaccataataatctcaggtctaaggattcaacaccaacactaaatgagattactgatgacacaacacatatggctcttgcagtgtctcatgttgggtctatccaacaacatgttccccaacatatgtccacattattaatttggtatctctataccatgatccatgagacatgataatcaattaatacatgtgctgatcatctaaacatatttgtttcacatatgatatttgatcagggatcctttagaaatagtaacaaataacataaagagtctcatgaaagaatcacatattcattaaccaataatgagttatttatttcaatgaacaaagtcggataaatatgtaaatatagtatgtgatataattatctctatgattgcctctagggcatgtcactaacaattagctattctaacttatgtttgatcacgcatgtttcagtcgtgaaaggcaaatgtgacagttgctctatgtttgagattacagctagtactccattgagcacgtatttgtttatgcgaagatattatcagattatctttatgctctgtagatcttctgtttaattctgtttgatctgtgatgatccagcagctgctctagcctgtaggctcttctcagaagtagcatttacgtggtgtttggatccatgtacttaactttagtctttgtatttagatatcaatttagagtattaaatatagactacttacaaaactaattaaataaatgaaagttaatttgcgagacaaattttttaagcctaattaatctataattagagaatgtttactgtagcattacgtagactaatcatggattaattaggctcaatagattcgtctcgcgaattagttcaagattatggatgggttttattaatagtctacgtttaatatttataattagtatccaatcatccgatgtgatagggacttaaaagttttagtcccatctgaacagcgtcttaatatcttaaatggaaaattgatgattttcttcatagttgcatgtgcttctacattttgtccaaagttattttctcttgatcttctgtaaacagatttgggacaaaaacatgaagagtctgtacaaataactttgtggcatatttgtcgaagcgcatgcaactatagaacgaaccatcaaatttcccatttagaagtgtttttttgttgaaaagaattttaaaatcgtgaacatacggaaaaacgtcagactttggctgccaaaatcggggattcttgcatcaaaacctgaagaatttgcactgtgtatttgttttctggaacagctttggtaatttaaaaccataaaaacatacttccttcattatttgaactttgagttgttaagctttgaaccaacaatatttttcaaaataatttagttatttaacattcaattcataccaatagacttctagtcgatagtactttactaggattttacattttaattttttttttaaccaactcgatctgacttagcttaaatcttaatcggtcaaaattcatgtactctcgatcaaaaattcgaaacacaacttacaaatattacgcatatatagtttttaatatgattttagtgagattaagatgtgtagttagtttttcatcttttagagagtgtgttagatggggcgcatatgcgggtatactatgacgttatagtgatgtgtatacgtgtacgtctatcatgtaatcgaaaaaaattcaaaatggaaaaaaaaaagtatattcaagagaaccagacgtgtcacgtgtccatccatcctctgttgagattttagaagtgaagtccgcggccatgagcgaggcgaccgccggccactcctccgcggcggcggcggagtctgcaccggacgacgtcatcgcggagatactcctccgcctcccgccccacccttccttcctctcccgcgcctccctcgtctgcaaccgctggcgccgcctggcccgcgacccgggcttcctccgccgcttgcgcgcattccatcgaacaccccccgtgctcggcttcttccacaactccccggacctcccccgcttcgtccccgccgagggcgtccccggccgcgtcgccgccgaggccgcctccctcaggagggacggggatgacggcatgtggtggtgcgtcgactgccgccacggccgcgccctcctccgcagccgcgactgggccgagttgctcgtctgggaccccatgaccggggagcgccgctgcatcaccgtctccagccagatccaggagggggccctcgacctcaacgccgccgtgttctgcgctgcctccggcggcggtgaccaagactgccactctagtcccttccatgtcgtcgtcgtgttcaccaccggccaatgccatggccgcgtgttcgcctgcgtgtactcttcggggatcgacgcgtggggggacccgatctcgacgccggtgacatcaccatgtgagctctatgaggagccccctgttcttgttggggaagctctgtattggcttcttgatgggagccgtatacttgagttcgaattcggcaaccaatgtttatgtttagctctgattgatcatcctgtggagaatcatgccatcctcaagcggaacatccgtcttgtgaggatggaagacgatgatgtgcttggccttgctttcgtcaaggatttcagcctgcacttgtgggcgcgggaggttgccgatgatggtgcgtcgcaatggattccgcgcagagccattgagctggacatgatcctgccgctggagggctatcggtgccgtgcgatgcctatttggatatgtggatttgctgaagatggagatgtggtgtttatacggactgttgctggagttttcctggtttggcttgatacattgaaattcaagaaggtgtctggctccttactcatgaagactgtttactcctatgctagcttttatgttccaaatggtatgaagaattatgcctctgtccctttgctgtgaagtatagttattacctaatgaaatgacttccaatgtttttccttttggtgctgaacccagtactgtgtatcttgttctggtttaggactgcaagctatataaaagtataaaacagaccaacactttgctaacttgctcttattatggttttctcattgctgagctgatgctcagtagtttaccactatggtagaaagtggattgatggaatacctagttgtgcaaatttcaatgatacctcatttattatttggaaaattttgcctacttaatgctacatgatctgtaaggaaaagtatgacaagtattgattcagcatatgtagtttgctttaaaaaaatatagtctttctctataatcaatggcccatgagatgcaagctaaaaacatttatattgggcggcaaattttaaatttacatcatttcgagctttagatgtaacagtctaatgtgtagtcctgatataaataatacagttgtgagtaatatctgattcttatgaagaaactggtgcccatcacatagtatacttttcctttcagggtgcattgaagcaatttttgtgacttataagtgaacaaagatgtaaataccacatgaatttttatgcacatcttgtgtaacacagcccttgttagcctgtcgacacttgacacatttgtgaaataggcgttgccaaaagtagctttacgaactatgagatctgcttaacttctcattctacatggtagagtaaaaactttcagaggaaagagccgacatgaaaatttaacttgttatttttggacatgagtgctttgtcgatgtccattcctgaatgggacatattattcttagtgttggttccttctggtatgatgtcaatgaaaatcccttgtaactaaatgagttgattaagctaacttatgatttgttgagtataaattgtgtatagcaccatagaatactatagcgagtatagttaagtgttttatgaattctatttgttgtctttattgtaaatcaagccaggccattgagattcagatagtaaatcatgtggacatttgttttttctacttgcgacatttcattgtattacactgatccaagactcattaagttcgactatgacttgagtaatttaagtctattactttacatgaaagttcggtaatttaaatgagctagtacgtaacattaaattgcaccagatatcattaaatgctattatgaaacatgaaaagtttggaagctaatgaaaatgctatctgaaaagtgttattcaaggcttcaagcactgctacttcgtaactacatttgaggctacacaggcagtcacttggaggcaaactaaccatacgtgtttctaggaaaaatatacataactcgatgggtcattttattgtttgctgaaaatggctgactgagtgactgtcatatttcaaattgctcaccaagtttacttcatatttaggaaatatcttttatgttctctggtcaccccgttcctcctggtgatttttgtcgtagttcctgtgtttttctgtgagtccacatgcacaattattgatgtctgctgtcttttcctttgatgttctgcatttgtacatcacatcacagtattttttttcctgaatatgcaagacatcccagtattgaactaggaacatttaatagcgaaattaggaaaacaatataggtaaattccacaaccaatccagtaatctatgagcatgcgagttcctaggagctgtttggatgaatgccaccaattgccacagatgtgttgctaagtgtcgcgtgcagcacttattgtggtgtacaaatctagcagagcaacatgtctatcaattaggcaacgctattctatattgacaatgtgccatatagaagactagtttaagagttctgaagtaacagagtatgactttggtacactattaacttacttttggtgttgtctgattgtggatgtgttaattcatcaaatctcatagcttattcatgctatatacatcttattgtttgctgttagctaatgtcacaggataatgacggaaatttccacagaagcccatgacatcccatgtgttgatagaagcaaggaactactgacattttcaagcaggtgaggcagcctggacatcagactttccaaaatattttgttcttttgtcttatgtgcagtttttttttaaaaaaatcgaaactgcagtggttcttttacattttagcttcactgcaattcacaagctagagcctagtaccagcaattggttcttatactaactcatattacatagatcaatatggcaattggtgagtaaattcatgctatatacatcttattgtttgctcttaagagcatctccaacagcctctccaagtgactgtccatgtcaaatttgagcaattctaccaaaaaatcgtgctccaattgatatagagattggtttaatttcacccctgtatttttgttgctcaatctgttctgttatatagcaggaaaatgtatttcagttgtaattgctattgcaagacttacacatgctgcagtagtacattggtctctctatatttttttgaaacaactaaataccaggagagttatgctgatggtagatgaaacaaaaatatgtctagatatttgtgtaatagacatttgacatttgagacatttgtgtaatagacatttgacatttgagacatttgtgtaatagacatttcacatttgagacatttgttatcactgaagtaaaaaagttgaggtcatttccacaagagttttcctataagaaaattcaataatttatgacattataattggcagaactatactctttcttttcagaaccaccaagctgttttcttataaacatgactgcataaacagatggtgtgatctagtgtagcaactttctatcttgacttgcctttatttttcctttcactgtttttgtgcacgtgcaatttgggctatgagttttgtcggtaaagggtactgcaataatcttcttttcgactatattgtagtattcaggaaccatttcgactatatagtattcaggaaccttttcatgtataattctctctcattcgttttctcgtctgagctattttaatagatggaaacaaagatctgttccttcctgcactacactgaactcatttcagttaggatgaaaatgcattctagagaccatcagaaagatgaattctttggggaggaccttaattctataattgggtaaggacctgaattatagaatcccactgaccacaagtagctgttaatttctttttgaagaataataagtagttattgctagagtttttaattgcgttatatgtgttgttagtgccatgttgcattcaacttgcgccatcaatcttcctaggattttgttgggtaggtgccaacttttctgtgttggtagcttgcttttgattgtactcctgttgttcatgattaaacggaagctcgtttactcacaatgagaaaagtggttacatcattacatgccattagtttgctcctttgtatgatgatctattgatgtcccctaattttttctaccgctcctgtgatggatacagatgatggtgcaaatcatggaatcggatggctttagaatctcttggctgcagtggtgttgaaggatcagttatgcatctgcgctgctttctcctgattgcagagggtgttgaaggatcactccatgtttcaatgaaaaggttaaagtggcattttgttgtcgttggagataacagctactaatactccaacgcatatcagattactccataattcaataaaaaggcgaaattgacattttctcgcctttggagattacagttaatacttcatgtggtacattttattttgtgcgtgcgatatgatattgttgtattcctatctctggttactctgtttgattgtctgtgatgacccaccagctgctctagttcttttttttttctctcataggcaattcatctttcaaatggaacattgatcatttgctccatagctgattgagcatatacattttgcccaaaagttgtgttcacttgatcttatgtaaaaaactttgggccaaaatcaagtgcaaacaactttggatcatattatagaagctcatgcaacaattgggtgaaccgtccaatttttccgttttgtgttcgcctgtgttgtgtggtgtgcatattgtgtcttccgtggaaaaaaaagagccattttttgtaaaaaagtgttcttggttgaaaagaatttttaaattgtgtagatacagaattttgtatttcaattatttgaagtaagccatcaaatgcttgcatgaaattctcattatttgcattatgcatttccaatggttaatctatggcttataatctgacaaagataaacgaagcaattcaaaatataaatttaggataagactttgggatacttttactctaggtgatccaataattaagcccaaagtatagaaaagcggcaaaagaacgtctagactaattgtagacggtaaattgtattcacggtgcatcaacttaacagttgggtggtgcaatttagataaaaacttaagaaatgagtgtcctagtgcaaaaggtgagtggctaaaaaatttataaataataagcttataattagaacaacttgtaaagttgtaaggtagctgcgattttgtggtacaataagttataagaagagatgcggtaactcaattattcaaagcactttttttttcattatacagatttaatttataagtgaaaaaaaactcggaatattttttttcggtgtgctaatggagcagtgaaaatttgaagttataaatcatgtttaaattttacgtgtttgtactgtgttttaaaaaagaaaaaaaaattgagcaggcttgagaaggggtgggcagaaaaagactgaaccgaaagaccgagaccgagaaattcagtcatcaattcagtcctaaacagtgaaagactgaatttggttcggtcaattcggttagtctcctcagttaaccgaatagaccgaaaagactgaattaacaaaaaaaaattgtctaaatgcaacctagaatccgctaagttcaataggattaaactctaattttcacatccctacttcttctagacatgcaattcatacatgcttgcgaattttttttttgtgatttttgtgttaaaaatttctatttcattgcatatatgaaaatgttattgaatttcggtcaggaccgagaccgagaccgaatttgttggtcctgactttattttcgttgtaatttggtgttcacttttcttttttcaaagaccgaaaaccgataccaaaattttgggtcagaccgaatgccaacccttggcttgagagacttgagaggcagcactcccctaccaatccacacgacatgagcgcggcggcggaggcggaggcggcggcggtggagtcgttaccggacgacgtggtcgccgagatcctcctctgcctcccgcctcacccttccttcgtctccggcgcctccctcgtctgcaagcgctggctccacctcatccgcagccccagcttcctccgccgcgtgtgcgcattccatcgaacaccccccgtgctcggcttcttccacaactaccgggacctccccagcttcgtccccgccgagggcgtccccggccgcaaccgcatggacggagtcgacgacggcggcgacgcgcggatgttcatcgactgccgccacggccgcgccctcctccgccgatacgactgggccgacctggtcgtgtgggaccccatgaccggggagcgccgccgcatcgccggccccaaccagaagatgcagggcggcggcgccggcacctcccgccgcagcgccgcgttgttctgcagctgcgatgtttccggaggcggcggcgaccaagactgccactctagccccttccatgtcgtcgtcgtgttcaccggtggctgccgcgcgttcgcctgcgtgtactcttcgctgaccgacgcgtggggcgacctgatctcaacgccggcgccattgccatgtgagctctgtgacacgccccctgccctggttggggaagcctcgtattggctttcttatgggggactcatacttgagttccaatttggcagccaaagtttaactctgatgaaacggccattggagatgcttgccgatgtacgtcttgtgaggttggaagaagatgggcttggtcttgccttcatcaaggattccaccttgcacttgtgggcgcgggaggttgccgatgatggtgcgccgaaatggaaatggataccgcgcagggccattgagcttgacaagttcctgccgatgccaagggtgctcaccggaaaatggtgtggtgaaatgtttgtttcgattagtgggttctctgaggatggaaatgtggtgtttatacggacccttgccggcgttttccttgtttggcttgaagcattgaagttcaagaagatgtctgaccccttatacatgatgactgttcacccatattcaagcttttatgtcccaaatggtatgggaagttctctctctttctttatcctctgctgtttagtattgtttttagctaatgaaaagatttccagtgtctttcttttggtgctgaacccagtattatgtgtctcattgtggtttaggagtgaaagcaaatagagtatacaatagaccaaacttttccaagtcactttcattttatggcttgttgagctgatgttcaatagtcagcattaccactatggttggaagtggattgattctacttgcgccaatttcaataatatatcatttatgatttggaaaatcttttctataatgccacatttctgtaagaaaaaaatatgacaagtattgattcagcatctgttctatttacagtagtaatgatctagtagtttgattaaaataaatatgcagatgaccttttctttataatcaatgcctgtgagttggaagcgaaaacattgatattgcgcggcaagtgttaattttacatcatttagagccttagagatgaagtgctaatgtgtagtggtaacagataaagcatcatttctgatgcttatgaacaaaacataagtccagttcttatcatgtagacatagtatacttttccttcaagggtgcattgaaatgtatgttggcacaatctctgtgacttataagtgaacgaagatgcgaaaactccatgagctttcatgcacatcttctgtaatacaaaccttattagcttgttgacactttgagacatttgtgcaaaaggtactgccaaagttgctttataataccagattgatatctcattctgcatatattgtagagtaaaaactttcagatgaaaagaacagtaacagaaagataacttgtgatgtttggacatgagtactttttcaatgaccattcaggaatatgttattctctgtattggttccatgggaatgatttcaattaaattctcttacactataatgtgttgattacttgattatgctaatatatgattcttttagtataggttgcatatagtataacactattaaattctcatgtactataatgcgtgattacttgattacgctaatttatgatttctttattggttggacttattgtaagtcaagccaggccattgagctgcgaatcaacaaatcatgtaggtgtttgttttttctacttgctgattttcattgtattgttgtggttattgacttattaagttcgagtattggactgattgtatcttaattttagtactttacattaaaatcggtaatcttaatgagctagtgtttcaaaattaaactgcaccagatatcataaaatgccattctaaaacatgaaatatttggaagctaataaaaatgctatctgaaaagtgttgttcaaggcacagtcactttctagttaaaaggcagctagaactgaagctgactatcccaattcaggaagacagaaattgctggttgggttagtccaaccaatatttgggattctttgggctttgctagggctgacttcagtatgacaatcttaaaggtctataattgcacacttgagtgatctgtctacagccaattaaccagagcatctatagcagcttcaccgctttctttttagtattaaactgccttttcaatgtgaaaaaaaggcctaggcctagtactcagtcactcagagccaaaaaaaaaaaaacatgcttccaggaaaaatatacataacccaatggaccattttattgtttgctgaacatggctgactgagtgactattatacttcaaattcttcatgaagttttacatcatttctggaaaatatcttatgctgtctggtcattctaccttcctcaaactggtgatttccgttgtagtacatgtgttttacttgagtccataagggaagtgcaattatattgatgtctgctgtctttttttttgtcctgcatttgtacatcaaaatcccattattcaattaggaacatttaatggcgaaactaggaaaaagataataggtaaacaccacattcgatccagaattttatgggcatgttggttcctatgagctattttgagctgtttggatgaatgccaccaattgcgaaacatttcttgttgccacactttattgtggtgcccaatttagcagaacagtgtgtgtgtgtgtgtgtgtgtgtgacaagcagggattgaaatttcggttcgaaatttccgaaatttcggaacccaccggcatgtcaatattttggccgaaattttcggtttttctcaattttttgtgaatttagtcaaaatcagttaaattgcgtcaaaatttcagaaaatttcggtccaaaaattaccgaaccgaaatggccgaaattttagccaaaatcgaaattgaaaaccctagtgacaagtaggccatgatgttgaagaactgtaggtctgtggcatggacctgcttaactcaagtgtggcaaaatgtggcatggtagccatctggtggcaatactagatcagcaatagcccataagatgacttctaattaagatattctatacatggccaatgtgccatactaaagactagtcttaagattgctgaaatagcaaagtacaagtattggtacaccattaacttactcttggtattgtctgactttgattgtgttaattcatcaaagctcatagcttatatatcttattgtttggtgttagctaatgtcacagaataatgactggaagttccattgaagcccatgagatccaatgtgttgacagaggcaaggaaatactgacgttttcaagcaggtgaggcagcctggacatcagccttcggaaagtttttttgctcgtcttgcgtttagtggttcttttttttattgattgaaactgcagtggttattttccattcttgagctttatcataattcacaagctagagcatagcaccagcaattatacatttttggctcttatactaagtcatgttttttaagtagatcgatgtggtgattggtgagtaaataatctatatgcagattaactcatgttaattaaactagtcaaatgaaaagactttcctagacctttggtaatcatttaaaactatggatagattttagtaatttgtacctgattgcagcactttgccactggcttacaggagctcttttgtgtacagatgtttcaagaaggtagttttcactcgaattctaaaggctggatttacttgaattcttgtgtattttcctctgcaggatacgccacgggtatctgacatcaggtctgtgatctcatgatgtgcatgagttgcagttgcacgtagctcaaatcgtttgctcgactggccccgaaaccccagctgatattttgtaaagaattggtttaaatccacccctgtgtcagtcttcaatccctcctgttagctaccaggaaaaatgtattacatctgtaataggcatgctgcggtagtagattagatatattggtctctgcattttatttgtcttagctaggaagattggatgttttcttcgaaataataatacaaagtaggagagttatgctgatggtagatgaaaaacaaaattgaatgctcaggatgaatattggatatatttatgtccctatttcaatactatttctatgtgaagttcaaaaatattgctaatattgatatcccttgttattaagggtgtgttggaacatgtgggttcagaacccttcccttcctcccgcctcccgacacataaaatggtaaaatggaacggcggatgagtgaatgaataattaagtaatccctccgtttcacaatgtaagtcattctagcatttcccacattcatattgctgtaaatatgaatctagacatatatatctatctagattcattaacatcaatatgaatgtgaaaaatgctagaatgacttacattatgaaacggagaaagtattaactaacaaacttaaaaaatatattaatatgattttgtaaagcaacattcttatagaaaattatagaacacaccctaatgtggatctataagctgtgtgatacgaccatactctttatccttaacaaaaggatcacactacttctgcaaacttttttctctcctttctccactcttaggtttaagatcatacataagtatgaaccagcacacttataagttttaacacattgccattaggtagttaaccatatggctaatagtaagtattgcactaaagactactagtttctaatgttctagttatggacacattttagcatcgtaataaattacacatatacattccatcgtaaataactttgatgatacatgagtattgttttctagatcttgaaatcactggtgatagtgaaattattgtagaaaatagttagctaaccgtaacaagagcctaaggtatgaaacagtagcaataatcttataatctttctcagtaatatataacattataactactcgtttcgtttcaaagatatcgctagtcgaacggtcgaagaatagtttatgaaaactttaagatccactttgttgtgaacttgattattttaaagagttgtacattaagataatatcttcttttattatcggaggttaaggttgaatatttcactttgtcacgctaaatgttagttatgttatagtttccataattaaatgtttagtcattatcataattgtaccacaccactttgtatcccatgtccaacctttatttgtgaaacttgtggataggaaattgttagtcacactttaacaacatgtatacattattcaacacattaatatgggtgttgtatatcagtatatatctttacaattatctgctaagggtattaaagttaattcgcatactgatatatgttaatgataataaattaaggatagtcaattcgcatactttagtatatctcaatatattccctttagaaaaagaattaataattacttaaatttttttaataggacgaacagtcaagtttaaaaaaatcaacgcatcaaatattccctttaaatttaagggcaattactataatatctcatatgttgcccctaagagtgccacattcgattgagtgatgatgtggaagagagaagtgaggagagagatgatgagccacctctaaatcaagaggcaaccttcacaaaatttaagaaggatgtgagagtattagagcaggtacaatagcaggttataagccagctgtaaacatattttaagaagataaataaggagagagaagagcagcgagctacagatttgtagccagctgtagcacggactccaagatgcagtgtgtatatgataggtgggaccagctattaatagtgtaatatgtaactattgtatgaatgagctattagattggctatatatgaattgaagctagtagttggctatattgctcttagagcaaagataatagtaacgcccacagttggctgcaattttcaccatatcatcaaaagttggtttaggtcccattcgtttatccaacaatatttgaatgaagatgaagattttcgtggcacgcttttcaaactgctaaacagtgcgtttcgtgcgaaaacttgctatatgaatgttgtactaaaatatcatattaatccattttttaagtttataataattaaaactcaattaatcacacgttattaccaccccattttgtgtgaaacacttaatttttatcttcatcttcatcttcaagagattcaaacaccaccttagtagcttaccggcacaataagcatgctctaacccgtctgtccatcctttcatgacaatagtattttattcttcattcatcttattctctctctggagattatttcaccgctgatgatctatggcatcgacggggcccacttttctcgaaaaacgcatgcagccaggcgacaatttagtcgccgactcgccctctctcctgtcttttttctgccaaatcatcactccggtctacgtggccagcatatcgccggcataccagctgctattgtacctgctcttaatgatatggtatttgtattggtatttgtgtactagaggtgatgcattgtataggttgactcttagagcaagtttaatagtatagcccactgctagctacaattcatgtatagccaatctaatagccaattcatacaataattgcttactatactattagtatatggtcccacctgtcatacacacattgcgtattggagtccatgctgtagctggctacagatctatagcccgctgctattctctctcatcttttatcctattaaaatatgtttgtagcttgctaatagtctactattgtacctgctcttagttcatgagtgaataaaatagataaatttagaggtgatagtcacatgtaccatagcatttgcccttcagtgcacaaaattcaatcccccgtttctctcatccccagatctgacgatggccgatgtcaccggcggccactcctcccctccggcggcggcggcggagaccttgcccgacgacgtcctcgccgagatcctcctccgcctcccgccccacccttccttcctctcctcggcgtccctcgtctccaagcgctggctccgccacacccgcaaccctagcttcctccgccgcttccgcgagttccaccgcaccgcccccgtgctcggcttcttcctcaactcctcgcatggcgccctcttcttccccaccgacgcgcccctctgccgcatcgccgaccaggtcgcctccctccgcaggaacacgggcgatggcttgtggtggctcgtcggctgccgccacggccgcgtcctcctccgcagctgcgactgggccaacctgctcgtctgggaccccatgaccgaggggttcgtctgcttccccgcccccatccagatggtccaagccgacgccgaccgcgacgccgccgtgttctgcgctgcctccgccggcgacgaggaccgccgctccggcgccttcaacgtcgccgtcgtgttcgtcagcggcgaccacgtgttcggctgcatgttctcctcggcgatcggcgcctggggcgacgtgatctcgacgccggtgactttacctctgctgatgatctacgacgagcccgctgcccttgctggggaagccctgtactggattgttaatggcagcagcttgctcgagttcaattgcggcagccaaagtctagctctgatctcgcggccatcggatatgcccgcaacccacaggtggaacatccgtcctgtgagtttggaggacgatttgcttggcctcgcctttttcaacgatttctgcctgcatctgtgggtgcgggaggttgccgatgatggcgcgacgaactgggttccacgcaagtccgttgagatggacaagctcctttcgctgccagtggcgacggaggacagtcggcgccgtatcgtgcctgcttggatatgtgggttctctggggatggaaatgtggtgtttattgggacccctgctggcattttcttggttgagcttgacacgttgaagttcaagaaggtgactgatggttccctactcatcaagactgttcatccctatgagagcttttattatgttccaaatggtatgagcaactatccctttgtccttttctgtcaagtagtctttaaataatgaaaagtcttacaatgtttactctgttggtgctgaacccaatactacgtagtacatatcctgttccagttcaggagcactagcaattaatatcaaatagagcaacacatgccaagtcacttttattttatgttttattgatctgatgttcagtagtcatcgttaacactaaggttgaaagtgggttaatggggatatctccttgcgcgattttaataatacctcatgtatcgtttgtggataccttttccacttaatgccacattatgtttaagcaaaagtatgacaagtattgatttgtgtctcttccacttctatttatactagtttttaaaatgccttttccacttaatgccacatttatgtgtaagcaaaagtatgacaaatattgattggtatctgttctacttatatttatagtagtaatgaacttgtttgattgaaaaaaaaaatacagttgtaccttttctttacggtgagctcattctataaagatcccactgaaaattaaaatttaacttttgttgtagttgttaataaaaaatacggttctgacaatttgattaatacggctggaaaaaagggagatagcaaacgccttttctgccagggttttgaaaagatgaacacttattcattaagtgccccttagcttactttgtttggaatgttgttagttgtacttttggtgttggtccagttcttagtgtttatcatctttttggaccctggctaaacaagtttaagaagaaactttagtcactcattttgattggaattgcttttgtatgctggtatttattgaaagctagaaattcagcctgtttcaaagctaaattatctaaagatcctacagatataatatattttgtttgcttatggatgttatcttgggctctaatgcagaaaaaggaggaaaacaggagagtgctatagtggggaaccaggtttctgaggcaggtggcaagtgagatcttccgcgccaagttcagatggagactgtgctcaggacagttggaaggatgaacacaaaggaggatgtcactatatgttgggagaattcaccaggtcttttctagttttaagttctgtttagctgatcatcactttctggatgctatttctcggtacatgttggttgtagtcttgtgctttgaaactcaacttttgttgtaaaccagcggttggtatacatggtaggatggcaccatgtgaacaacctggctgatgcttgacctgtttgctgctgaaaggtggtgtgggcgttatgaaccttgtagtctgtttgactgtttccttcagtggtcggtttgaagacaaataaaaaacaggttttcataaaacaagttttaatttgatttatcataataaacacttataggttgttagtttgttatggatcatttatttaacatcatgtttgggtggaaaatactaaatatgtgttttgcgatagatgtgtgtttggcactttggctggctgctgcgagggagaaaaaaggggcacggtcaatatgtttcgtgctgtgttgattgagaacaacactacttttcgtaaaattgttgtgtagtttttgattaaacatgatttcccggttttattgaaacccagtttttcttaccgcttacttgcacaaattttttttaaaaaatgtgattaaggtaaagcggttttaatagaatatgagatacaaacaacccgtcttgatatatcaagggcctatgagttgcaagcaaaatcattggtattgggtgcccagtgttaattccacatcagttgtctgcttactctgttagaaccaaggtttgaaatttcgccccccatcggcatgctcaaatttcgtccgaaattttcggttttttgtaattttttgtgaatttggtcaaattttattcaaattcattcaaattcagtcaaattttcaaataattttggctcgaaatttccgaaattttggtaacccctggcataaaatccaatttcgaaatttcaaaccctggttagaaccttagggttaaagggctattttgtagtggttatagaaacaatagaatgatagatgataatgcatggtgcttatatgaacacaaaacaattttggtgcttattgcactgtattcttttcctttaagggtgcaatgaaacattaaatagcttaccacatgtgcatatagttggtgcttggtttcataagtgttaagagatgagaaaaatggttgtagtgggtgttgctgctgttatctgagctgtctggaaaaccaggaatgcatatgtgatatgttttataaatgtacttaaaacacattctgttgagctgatccattatgtttgcttttggattaaacctggcttattttgcagaaatcaagtagcaagtgagatgtatggcgcaaaacctggctggaggttcggaactggaatgctggactgaattttggcaatcctggtggtttgaccaacaaaatgagggggagatgaagtcctgtgatgctttagtaccatcagaagttttagttgtcttattacagatgttctcgttagctgtactgaaaacttgtataggttatcctagtagcatcacactgatgggatggcatctaattaagaaggggtggcatatgctacactttttcgtgatgcccaattttggcagagcaaaagtgtctatgacacactgtaattgtatagcaaagagtgtttatgagaggattctggggtgttggatgtaaaattctcactgaagaacagttacagacaagcgaccgaagaacgtgtgatgtcaccgaagcgtcgctcgccacttgtgcctgcattttccgcttcagcgagcagcctttagtcaatccccattcctcaccccaaaccttaattccccatttttgaggttgcggctgccattgggaagcaagagcgttcagcttacctctaggatgaaatttaatttgtgagtgcaatttata

SEQ ID NO: 74375 - DNA, 11329 bp, Oryza sativa
tcgttgttacttgcattgcctatagctctgatgatcactggttcccgctgttgccgatggtgaagatcattggcgttgcggaggagggcgacgtggtgtttctatggacattgtcggggatcttcaagttctgttctggatccatggagcttaataagaaggtttgtgaagcaactaaagatatggagattgtgcatccgatccgtatgtgaccttttctatgtctcaactcgcaactcccacaggtatatatatgttcgcaaaccatcctagcttccgataggcaattcaattcaaatcggtttcatggattcgttatttcaattttctagtgtcatttctgaaatgcacagctgttaagaatttttactatttgtctacatccaactgaaccatgtaatcacatatcattacttatgtttgaatcctgaaatgtttgtttccattctgccttcattttgcttagacaattaattcagattattgtcctagttaagtttatggaaatgtagagaccaggttttagtccattttctataataagtttagtggaaatacttaaattaactggtaatatatatgttataggttgtcaaattaacatataaaaatgtacaggatttatcagaaatcaattaggaacataaataaatagtgataatataaaagacaatatttttgtatgaatcagtagcacatgtgaaatcttgctttgttgttgaaccttttagttaattttatgcgcttgtgcttcaatcatcttctagacttccactgagcctttttacttcgatttggagataatgcaatatgaggatttcttaacaaatatcaaatacatgtggccactatttatttaagaaataattattttgccttttgtaataaaaccatatacaatgaaaaagttgcagttagaacgaactaaaattgcacattgcatagtattgcaaacctaggtttagccatacgtgatttaggtgactgaagatttataaaatttgcacataaaatctagaaaatcccttttgtaaaaaaaatttgcatagaagactttgaaaactaataccttggaacaatatatagcaacagttttttgatttccttgcggtttctttttattttctctgccttgaggaggacacggcagatacaaaaatgacccaacctatgctgtgctggatgcaaaattatcactgaagaacagttacaaacaagccaacgaagaacataggatgtcaccggagcgttgctcgatcgtttcttgttcccgcattttccgcttcaacagcctttaatcaatccgcattcctgaccctgaaccctaatccctatttcagaccttgtgggcgctattaagatgtgagagggagagcttagctcgattcacgctgctctttgccgtcactatgttcattggatttgaccgggaaggtctacgtacggttgtacaaaatcaagtaggatcgaggatcgatggtggagaataaacgcttgtaaaagaggatgaaatttaactagtgtcacgccccgaactagccccgaacgggactagcccgtgacgttccaaattaacctgttaatcgataccagtcccaggaaacagtgctggtatcacaggaagacagaatatcacaaccacaggggtctctttattacagagtaggagtacagtcatgttgggctgcggacagatcccgagctcacaactgcattacaaaagggaaagcggaagccaagacttgaatcaaacatcacaggcgcgacttgggaactaggccaaaaccctaaaactcatcgtagccgacttgctcctggaagaactcctcgtcagcgggggccacatcatcttcttcggcaactggggggattatttatatagagcaagggtgagtacaggagtactcagcaagccatgggaattaagtgtttaatgcaggcttcaaaggaaaggctgttgtttttgcaattgattttatttaaactcctttttgaaacaactaagtgagtgcttctcaaacgacacggatgggacagtgcgtcttgtccggtcggagtatgtgcaatgtatcagtctttgaattgatcagggttggcacccggccaacagctttcaaacggtcacccgggcctggttgatcccatcaaccgcagatttttcaaacatcgaacccattccacaacagcaatttcacaaagcagtagtcaaacaaaactacgctaggaatcacctcacatccgcccatgaccgtgggcacggctgttcgaacagtttgttaacctctgcagagggggtgcactttacccacacgacattactaacccggatcacccagcccgtgcagaatggccacgtctggagaccttgacgctttcatgacaaggcatttcgaaagccgacacaggtttaccatatgccaacgagaggggttccagaccaacaccaggttaggtcccagaccatactgtgccaggaagcccgggagttctccccgacaccaccccgttgaatccacatgtctcttggcatcaaggctcccccgattagcaatttactcagccaggggtgtcccatttcacccatgtggccgcacttgtcttatgtttggatgaaattccaaggaaacggtccttaagtgcaagagcgggaaaccgtactcccggtacgtcccccggcctgcgattttggaaattcatttagttcgcaagcaccgacccaggtgtcgggttttccaagtcttttgtaaaacccaagttttaaccatcgttggatgttttatatttgaggggaggtgtcccgatgcgcgtgcccgaaggcccgtacatcgaagcacaacagtcgacaagggagggttaagtgttcaataattcaaggagggtaattgcagtaattaggattgggggccgacgggctatctcgcaagccgcggccgaattacttgtgttaatcctattcatgcaatatttgcggaaaagaaatacttagatttaaattataggtgcaagatggtcaaaggtaacttgccttgctcaagatcttgagcttgatcctcgtaatcctcgcactgtgggtcttcgggctctgaaactacacgcgaaacgggacaactcaacaaacggcaaaaataaagccctattattgacctctaagcgtgccattagatagatctcaagatttgaggaattttggaagttgaacggagtcgaacggatgtacggttgataagatatggaatttctaagattattggatttttgatctaaaggaaaaggatttatttaaatcctttttgagaaaagaaaagaaaagaaaagaaagagggaggggaattagacttccctcgggcggctagggcgtggcccgagagaaaggggcggctcggccgaacttaacgggctggccggcccgagaaggcggcccaaggcgcgcgcgcgggcggggaggagagagagggagccggtgggccgggtccatcccgcgtagtcccgagtgggacccgcttgtcggcggctcggctcgccgtgagcaaggtgcacgcggggcgtgctagggtttgggaaggggaggcgcggcgcacgcgcggttcgcggaggacgcggtgcgcggcgggcccacgcgcagcctcacggctcaccgtggaccatgcgcatggggagggtggaacggagggagtggctgactgggtcagccgatccggtcgtgccgaggtggcaccgacgtggcgcctacgtggctgccacgcgggccggctggaggaagacgaaggcgccggccgcgaatggacggcgggcgacggcggtttctccgggacgccgtgcgacgacgaggggcgacggggtgtacaccggaatgacgagggagaatgagagggagcgagccaacggctcggattcgccggagggagttcgacggcggcggattgcggtggcggcaaccggcggcgagaaaagggggaaacggcgacgaggtcatgaggggctgattcccggcggtgagagcatctacgcagctaaggtaaagcattcctagcaccggattaggaggaaacacgccgtgggaggtcggcgacgagaggttgctaccggactcgggcggcgacgccggcgagtccactgcgagcgacgacagcagtcggggcggcgccagtttgctacggggaggctacacatgctactaaccgagtctaaggggaggaggtgggacgaggagggagaacggggaggatgcactaccgctgcagaggagggcgctgtgacgagaggccgacggcacgggagtgatctctccggcctcgggccggggaagaggaagaagacgagcgcccggagtccccttccgcgtcctagcgcgcaccggctcctctggcacacgcgacgacggcggtcggtgatagagagacagaggggacggcaatggcgcggtggagcgagggagaatgggggagggaaaggaagggagggcgccttggtttaataggagggcaatgtcggtttgggaaccgacctagggcggtcaaggagcgagttggagctcagcggtcgcggccaaaacggcgacagagggcatgacaccggcagaagaagagaaaagggaaaaaggaaggaagaaagggggcttgccccttgtcgctttgggaaaaggaggagggagagggggggtgacgcggcagagggaggaggagctctgcctccgtcccttggaagctagcgcgcggtggtggcggggccgggtcgatgacgacggcgatgacggcggaccggtttggagcggagcggcgacacgggcggcagacacggggcaggcgcggcaggtgctgacggcggtggcgactggccggtcggccaccacggcgcgcgcgcgcgggaggcaacggggcgacatgacgatttggacggcgttggcgggaagcggcagcgagggcggagggcgctcggctcggcgccggctcgcgcgcacgcgcgcgcacgcggcgtacgagcagagcgagggaggggagagccgagggagaggcgctcggcgcggcgtggctcacgcgcacgcgcgcgcggcgcacgggcagagcgagggagagagggagagggagagagagggagagagagagggagggagagagagatgggccgagaggaaatcggcccaccgaacctgagggaggcaaaatggacttttgcggaggaattgaattgggaaggaaaattgagattagggtttggatttagcgatggatcggggattcgagatccggaatggcacggagactaactgcaagcgaagaaataattttcgcaattagggtttttagaatttaaattttcccgctaggcgccacgacggaacgggcgctacaactagtgagtgcaattaattgtcaaacttatgtaatatacatttttgcaaagcaacatctgagctagacatttattgagtgagatccttatatgtagacatttaatttggtgaatttcatccaaatatatattagtgaaaaatatttttgtttctatttatcaaaaaattgtgatattaaattcttaattacctactcttcttttgctcaaacgggcataatgtatgtcgagtgtctagatttcaggtgactgaaatttcagtcacttttatcatcctttaaatatatagcatgccaagagttgtcacttccactattactcatgcaaacaaagtcgtttctttcctgttgaacggtaaattttataagtagatacgaaataaatttacaataaaaaaacaaaattacatgtaaaattattcaaacatagataaatttgtcccgactttttagggtttgcaattttattgctgttttttcttaaatgaagcaaagttttgccattggtttggcctgctgttttgatggtgttaattcaatggcgaaaaggcatatatatccttggttgttgtttgccactactttttttcatctctagtgatttcgtccctattctgttttgaatgatatgaagtaagattgtgttaaataattcaaatatgagcatttttttacttttgccaaaaaaaatgacaaatactaccacaagtaaaattttgatggtacttgaattgaattttgttaaaattttgatagaatgtgctcaatttataggatttcctacatcgaaccctccccgtcatctcatccgcccctccgccacttcttcccccgctcaccgttgctattgctgtgaccgtcgtggaggaggccttcaaggcgctgaagaggaccaaggacctcctcgcaaccttctcccaccttgaggccatcctgccaccgttcaacaagtgcctcacatgcctcaagctgccccgacccatcccacgtccttgccatcgccctccactccctcaagacaacccccaactccatcgctgtctcgctcgccatggccctccacctcgtcgggtcttcctccttcaacctcccgttttcacattggcctcttcttcttttcacgctccctccgctgtctcgctcgccatggccctccatctcgtcgggtcttcctcctacctcccatttttacattagcctattcttcttttcacgctccctccacctcctgtccctgctccttccctccaaagatgttgtcgcctttgaggaagaaggcgatcattatgctaaagtgctgcggggaggcggcaggaagaggagagtgctagggggagggattgaggatgagctgaggccggtggccgtgaggtggtacggtgctggcatgaacatggtcttgccttatgctaccgagccacctgccttctttcacacatccagcaacgtcggtacattgaaaccaccctctccgctgcattgcatgattctcgcgtgctgaggtgctaaaaacactgtggccgccagcctcacatagttgcatcgatgcaccggaatgacgaatccacccccgccacaacggcatgcctcaacgcactggaatgccgccgccgtgcccgccgcgtggtcttgccggattagccgttgcctgcctaggggttttatggtgaaagctgtggcagggaacacaacgggatggttggggtaaccttttcttttactacaagggtagaagagtaaacctatatttcataaatcatttttctattttcgttcctatttatttaactcaatttcgtgggacatacctaacaactgtctaaagtgttggcaaatgtcttcttcgttttcagaaaacggtgtaaattacaaaccttaaaaagtgagggcaaagcaacaatggaggttcaaagcagaggcatggacacaattgtcccttgattaaaaaaaatgtaaaaccatatacataatgataactttgtagttaaaatagaccaaaattgtacattgcatagttttgcaaacatagtttagcttagccatatgaaactttaggtgacggaaaatttataaaatttcagacgcctaaaatgtaacaaatcccttttagggaaaacaatattgcaaattaagaactctttaaaaactaatagcatggatcaatatatagccgaaatgttttctaatttacctgaagaaaattcggttactttctttttctctctgccttgccgaggtaactgcaaatacacacgagacaaatggtgcgagaaaatgagtaaaaaaaaaaaaagaaaaaaccggggtgttttgcgtaaaagtctcactgaagaacagttactgacaagctgacgaagaacgcgtcaggtcactggagagcatcgctacctcgccgcttgtccgcattttccgccttcagcgagcagccgccttcaatccaatccccaaaccctaattccccatttccgatctcgcagccgcgcgccgccgggagatctcagctctgatccattccatccacgccgccgtcgcgcgcgcgcgccagccgccatgtcgctgagccgaccgctcgccgccgccgccgccgccaccgtgcccgacgagctccatctggagatcatggtgcgcctccctgcgcttccccaggcgctcgcccgcgcctccgccgtgtgcccggagtggcgccgcgtcgtgcgcgacgcggccttcctccgccgccaccgcgagctccacggcggggtgcccgccacggcggggttcttccacaacaccgtcgtcttcggcggcgcgcccggcggcgcccgcttcgtctgcgccggcgccggccccctcgccctgtccgttccgccgtcggtaagccgccagggtgtcccctgctgccacacccacgtaaaccccggcgacgcatggacggtgctcgactgccgcggcggccgcgtcctgctcggctgctgcagattctcctgctacttcctcgtctacaaccccatcaccggcaagcgctgcctcgtcaaggcggcatcccataaacgactccatctccatcactccatccgatgcaacgccacgctgatctgcgacgacgacgacgccgacgccgacgggccgttccgcgtggccgccgtgtacaccaccgtcaccgacggcggccgcctgttcggcgcggcgttcttgtcgcgcaccggcaggtggaccacggcgccgcaggtgttcgtcgacctgccgcggggcatcgacctccgcggcgagccgtccgccgtggtggggagcacggcgtacctctcggcgtacagctacctcgtcctcgcgttcgacgtcgagcactggacgatggccacgttccagcggccgccgcgctgcggcaacgcccggctgatgaagacgcgcggcgacggcgtgctcggcctcgtcggggcgctggagctcaccgtccggctgtgggcgcgggaggccggaggctgggtgctgcgtagcaccgttgagctctccgacatggggcttcttcgtgatctcccatcggcaccgttgcccaggtctgaaaaaaaccaatgggttctttgatattttgttggaaatttcgtgaaattggcaaacttttagttgttttgttaccttgataaagaaatctcttttgctaaaaatttgggaacttttgaatatgtgctatgttataaacttattataactgtgaatctgaaattaagaaccactgtactgtatgtttttgtccattggcagacacaggaaatataccgtccattgtgtttagtgggatagagttaagggacttgaggtagttagctattggattagaattgggtgagccagcaataaaaaaataaatttgttgacaaaagaattagaatgaagtattagatcgaacgaaatatatacatgtgtgatatacctatatatattaattttatttcacaaatttttgggtattcttcctagaaatacccgggaacccctgtgtctgccactgtttttctctttgtttgtgtatatatgtatagctagtatagccccaaatcgagccaaagaaaaaaaaaagtatagtaaccccagattggttgagtttaacttcaatcatgtgatccgggtatctgacaatggcattgttgttgattgcctagctctgatgctcggttcccgctgttgccaccggtgaagatcatcggcgtcgctgaggagggcgacgcagtgttcctttggacgatgctcgggatctttatgttctgtccaggatccatggagcttaagaaggtctgtgaagaaactcgagatattgagatggtgcacccatacgcatccttctatgtcccaactcgcaactcccgcaggtatatatgtttatatattatccttgctttctaccattcaaacataatgttttatggattatttatacaaaattctccatttcatttctgaagcgcgcacaaagcagttaagaatttgtatttgtttgcattcaactgaacccatataatcatatcattactaatgctataatcttgaaatccattttaccttcagtatgttcacacaatttggattattgcagttaacttattggaaatgcctaaagtaactgttaaatatatatgttctgggatgtcaaaggaacatatagaaatgtacaggatttatcagaaatcaattaggaacataatatatagtgataatactagctttttgtatgaatcagtagcacatgtgaattattgttatttagctgaaccttttagctttctgtgcggttatgcttcaatcattgtccgttgagccatttttacattaatttagagattactataagatacatgtggccattctgtttcagaaatagttattttatttgctgtaaatatgtaacaaaacttagctcaatggtacttttgggactcagttaatctgatctaggaatatgaatgtacataaaactcccttgcaaataagaaaacatataaaaccgtatttgttaaagcatattgcgactgcaatatatatgaatattccattatttactgtttgtgggagttttaccctactgaaaaagtttgctgtagctcgagtaacatgtgtcgtctgatagaacatccttgacaaagtttctgcagaattaaatataactgtatagttttaattaaattgcttgttgagtgcaacatatatactgatcacactatttctcatcacttcttttcagaaggcagtgaagaaacagcaaaacagggttgacatgctacaacaaatgtcgctgaagattaatgatgaaggtgcaatggagtttttagggattggatgccttgtgattttttgcttcgttaaatttgaacctgtttgatacaaataatacatgtaatatgtttgttgcaatgactttgtactcgttgtactctcttagatgatttttgttgttcaatgactgcatgcgtaacttctgttgtgagactcatgtatgaaatcaaggtggatttttggacgcatgaaaatctggttattgcatctcatctagcttatttttcctattgatttccaattcagcctctatgatctatgttggttaaagtatatcaaagttatcttcatgatattttttttccactaccattcattacttcacttttttttttcactgcagactccttttttaaaaaaatcttgtggattatattgtttttaatggatggaggcaaaagattttggttcatctgtgaatatatagatactgaaccaacattgaacttcctacatgcatatggcttgatatatagagtgaacacgtatagtaattaattaccttcaaaaatatgcacagaaaagataactagcactggtggagaaaccatctttggtcggtcggccaaaatacacaatagtcccggttgcaataaaaaccgggactaaagatatctttagtcccggttcaaaaggatagagtttttttttatctttagtcccggttggtaacacca

SEQ ID NO: 74376 - DNA, 14913 bp, Oryza sativa
cctgcagcccttctatctcctccctggccttatctcttcctccatatctcttcctcttcttcctcctctccttttgggttctctcctccttttcctctttctcctctaccagcgccggcgggcggagggcctggcggccggcggcgcggaggcccgggcggcctcgtgggcagcgcggtggccgggcggcgcagcggcccaggcggcctcgcgggcagcgcggtggccgagcggtgctgcggcccgggtggcgcggtggttgggggcggcgcggcgttgggcggtgcggtggcgggcggtgcggcgaagggccaggcggcctcgcggcgggcggcgctccggcggccggcggctggcggccggcgcggcagtggcaacgggctttttttttcttcttctttttagaatttgtgattcagatctgtgtatttgatttgtgtgtgatgtgaatgtgatgtatctatgatgaattttgtaaaatttgtgatgtatctgtgatgtatcgatttggggagttgaggatttggggataatttatttgggattttgggaaggggatggggtgaaatcaatataatgaagaaaagaaaataataatggagcaaccggatctagctagtctagctctaccaaccgggactaaaaaggctctatctttagtcccggttggtaacaccaaccgggactaaaaatggatttttactcccggttttttcacccgggactaaagatagtgatctttagtcccggattggtagtcccgatttgaaaaccgggactataggggggttacgaaccaggagtaaagcccctttctccaccagtgtagatttctcccatcagtacgtgaagttgtcaattgttcaaatttcgtacaacatagtacgtatatgtatcatgtttaattgttatttacgttttgtatattcattgcactgctcctttgtttgatgtggtgccaccctactgtttccctactatatcttgtgaaatatgatggctgatggcagcaacaagatgatgatggtgtaaacatggcgctgcaaaacagtagcatttatctgccacagctgtgttatcttggatagaaaagttgcagaggtttcgaaggatgccttccatccataactatatatatatgataaaccatgaaggtatgtttcaaaggcatggaacccatgcgcatgacaacgcttcctatttgatgttgtggtgtatagtgtgttccatatctccctttaatcaatttcacatatatacaacatgtctgtacattttatcaattataggttcccttgaattgtggaaagcaaggaagattgtgctagggcgagctgactgctcagacaagtcacaagtaagatcttcaagtccaagtttagctagagagatcccaaaaacgtttttttaatacgcaggagagctacttatcattatattaaggagaagaaagaagaggataagaacccttacaacacacacaatagaccttacacgagaccaaaagacaacttcaacctattacaagcaaacactatttactgttcggcatgaggacaagaatgcccttaggcccggccaaaccctattcatacaactcttctcttgcaaacagcaagtcttcagctatgttaggagaagtaccatcgaagacacaaccgtgttggcatgagggctaccaacaatcgactctaagtgtcgagaagatggaatgaaagctggttttatgttgttttgagagtgccccttgagttttttaggttcaaggtgcctagaaaaaaaagctgacaatttagataaactttgtgttgggaaaagttgttttattctacgttgtcttgccagaacatgaatagtggagcagagaatgagatgtcattctcatctcgagaaatagtccccttcagaggaatatatgtatatatacacacacatacatacatacatgtatggggtgctttcttttgtttgtgctttcttttgtttttccattctgtttctcatcgaatcatttctattaatgaaaatgaagctgtgccctttgctaaaaaaaagtttcccaacattcataaatctccaagcaattaaacggataatttttttaaggcataggcagcttccaaaacttcttgcaaattaaagtggtaagcaaccatatgcagaagaaccagtactatctggagcaaagtcctagagctaaataatgagaaccatccattattcacatttctcgtaataccaagtaatagtatgtcacattaattcttctgtttagcacaaattgtacaaaattaactaaacgatgaacagtcctagctaacaggtaatcacgtgcattatcagttcatcacagaaaccgagaggccaagacggtctgttactcatggacgtagatggaattgaaccaaactctggtgtacatgagaaagtttctcttttttaatatatcgttcctcttcgtctgttccaaatgaactctatagattcttctgttatttgtttgtccttctatctccaaatctaatttgaaattgctacatcaaccaactgtggcgttgtcttggtttaagaagtgtaactcatggcttctgcatatagctagaaatgaacacaaacattatacaaaatcggcagaggaaaagaaggtatgtgaaaaagaaaaagactgcctactctacatttgatagaaaattccctctaaaattttaggaatattgagccattaattggattgttttgattcgttggagaagttaggaataattcccctgtgccctcttcttcttccctacgccgttgccgccgccggagatcaacgagatcatcggagcgggaggtaaggtaaaggtgttgactattgaagggtccaaaatctgcaagacactgagggggcaaggagggatttttttgttgaatgaaggttattactccctccgtattttaatatatgacgccgttaacttttcgaacaacatttgactattcatcttattcaaaatttttatgtaaatataaaaatatttatgtcatgcttaaaaaatatttgataataacataaagtcacgataaaataaatgataattacataaattttttgaataagacgaatggtcaaacgttaataaaaagtcaatggcgtcatacattaaaatacgaatggagtatcaactagcaggaaaagaaacccatgtattaccatgcaaggacataatggaaagcaacggatgaaccaaagctaaagaattcttgaatggctgctagcttctccatcaaaagaggccaacagatgaaagcctagtacacgactcaagcgaaaatgttcagttaaattattgtcctcttaatttctgtcacggtgtcacttcacatcaaatcataaaacgcatactcttcaacgggtaatgcttttatatttccatatggatcgagatcgatcggcagtacaggttcattcattctccaaagtccagcgttcatcaatggccatcttcatcggatgcatctgttcacttgcactcttgctgctctgctcccatgtcttccagcttctctcagacgctcgccgccgtcttccaccgggcccgaggccgcttccggtcatcggcaacctcctcgacgtcgccggtgagctcccgcaccgctcgttggcgtgcgtcgccgagcggtacggcccgctggtgacgctccgcctgggcacgatgctcgccgtcgtggcctcctcgccggccacggcgcgcgacgtcctgcacaggcacggcgccagcatcaccgaccggggcacgccggacgcgtggagcaccgacgggcacgacggcaactccatcttcgcgttcccgacgcgccaccaccggtggcgcgcgctgcgccggctcggcgccgagcagctgttctcgccacggcgggtcgaggagcagcgcccgctgcgccgagacgccgtgcgcggcctcctccgccacgtggcggagctggctgcggcgtccggcggaggcggcgcggcggtggtcgacgtcgggagggcggcgttcgcggccatggcgagcctactgttcggggcgctgttctcggcgggcatcgacgccgcgacgtcgtgccggttccgcgacgcggcgcgggagttcgcgctgctgacgatgacgcccaacgtgtcggagttcttcccggtggtggccatggccgatctgcagggcctgcggcgaaggacggcgaggcacatcacgtggatgtaccaactgatcgacggccatgtcgaacggcggatgcgtggccgggaaacggccggtggctgcggcgccgcgcacggggagaaggagaaggacctgcttgatgtgatgctggacatgtcggagaaagaggagcagaatgacgacagcagcctcaccatgaaccggggtgtgataagagcatttatggccgtaagtatatgtatcctatatatctcagttttttaccagattatacagtttacttttaattatattttgactgtatgccatattttgaaattttagtataaatattctaaaatataaatcatatctaaaatttctttaatacataattaacatgtcataataaaataatatttatttatttttaataaaacgaatggttaaatatcatataaaaaggtagccacatcatctattttaaaaaaggagtataggtttgttaaggatgtttttccaattactttacaactttataatagttaatctgttcgattattgtatcttaacatattataaaaagttggataattcatcaccctttcagaacagaaaaaccacgcccaaaagtaacttttctcaccgcatgcacatatgttttacaaagaggcaaaaaaatgctactgagcaataaacaacgtgattgttatagaagatagtaataatcatggcatgacagtttgtggctacttttcattaattagacttcgtagtcactaaaacataatgggtggacggaagcccagtgaccacggctagagttatctctaacaaagttattttccaaaattttttacaactatttaggtacatgaaaaataaagattgaaggagcgaaaacactttagaacaaactatattttatgcataaggtgatttctataatcatctgcctaggtttttgttaggctttaaatattttctctgggttggtctgtttgcacgtgggtgtgttttcaatataagtttggtggtatttacacatttatttaaaggcaaattttacgggaggacatcacgtacggctcctaagtggttttagcttttggacactaaaagttgatctttgggaaagatactttcaaagtatggttatttactactagggacatcatgttggttaaaatattcatttttattaaataaaagagagataaatagtatgaaaggacaaatgtactagctagcgaaatgaccaaggccggtggcatatttgtcctttcgcactatttttgctctcctattcaatcgaaaatgaatattttgattaatgtacgtggtgttcagtagcaaataaccatatattttaagattgaattctgtaaagattgactttttggttaagatattcgatttatctaaattacttacattgcttaaccaatttcaggatttactaatggcgggcagtgaaacaagctcagctgtaatagagtgggcaatggccgagctactgcagaatcctcaaactatgacaaaattacaagaagagctcaaaaaggtcattggctcaaaaacttgcatagatgaagaagacatcgaccaacttccctatcttcaagcagtcatcaaggaaacacacaggctacatccagccataccactgctaatgtacaaagcagccgtcccagttgaaatacaagggtataaaatccccaaagaaaccactgtgatagtaaatacatgggcaattcatcagaattcagaggtttggattgaaccagacaagtttataccagagagattcctacaaaaggagatcagtttgtcatcaggtagtaccaacatggaacttattccattcagtgccggacgacgtttctgcctcggatatccggtagcaaatagaatgctgcatgttatgcttgcctcgctagttcatcagtttcagtggacactgcctgaagtagtgaagaagaacggtggcgtagacatggcagaaaagtttggaataacactgtctatggcgacccccctacatgctatagcaaagaatattgtgtaatgtgtaatttgtgtaatgtattcccgaataaaatgtgtcatttatcctaaaatataagacggatttataaaaagtatctgaaattaaatagggaatgattgtgattggtttaagacactactacaggattgattttcctggacgcccccccttttgtttacatgcggtccgtaagtggaactacacgaaaaaatagggggaccagcgctgggctgtcgcccgcacgggaaaatcgattttcccgtgtggacgtcctaatccaaccgcacgggataatcctccgtcctttccctctcacccacttcaaaattttcccatctctctcttcctttttcccttttattctccctcaaccactcccctctctctctctctaccttatctcttccttttactcctctcccagccacacacccggccggcttcccacctcctcccccacaccttcctggccggcttcccctcctcctccccctcccctcctcccattcccctctgttgggccggcgatggcggcggcctgggcgacggcggtggccgggcgcggcggcgagtagcgaggcggcagtagcggcggcggccaggcttcccctcctcttggtcgtcgtcctcgttgtgcgctcggctacgtcaaggcaaggcaaggcaacagacgtcgtgcgctccggcaaggcaaggcaaggttccgtcgtgcgctcgtcgtcctcctcctagtcatcacgtgcatcgtcaaggcagcggatctggcggcggtggcggccggcacaactatggcggcggcgggcgggctcaacagcgacgacgatggcgggctcggcggcggccgggtgggtgcggtccggcggccggcggcgattttcttgtttttttttatttttggttttttttccgtacgggtggtataacacgaccgcacgggataatcgattatcctgtgcggtcggcccacccgcacgtgaaaataatgattttcacagacacctgggtgcaaataggccggaccaccgcacgaaaaaatcttgtctgtagtagtgagatgaaaaaaagtaagttgagaaattaaatagtatataattgggattagttaagatgagaaaataggtggagaagtaattatatttttaaactaatagataatattattacttttatggctaccgctactgctatactactatgacgacaaacgaatactaccaatgccgccattgctgcaataacctaccattacctaccaccaccaccatcacaccactactaggacccatgatcaacctagtacaacaacaacaatttccactattatttgtgtagatattatagtaacacactgataaccttgaacttaaagtccatccaaataatgcaagtttaatttgcaatctcattccattaggcaacaagacaatattagtgtagttctttcgaagctagcatacggacagaagagagagcaccagccacagatggattgattgggctttagatgggctaatgacagtgaactactgtagacgaggccaatagcatggagtgagaactatagtactacatatagttaaggaacaaacagataacatcaggagcttttgtaaggttcatgtgtatcctaggtatatatatgtttgatttcaacataaagtgggaaatgatgagatgttattgtcttgtatttggttggaaggtcgttgggataggccttatttgattggagagaaaaggatggatgggatgattgaagggatttttctttgatgagccttgggtggacgcgcggatgggatgagtcatactcatatgtcctgcatttcatcatcacatgacaaacacccatccatcaccaatgggctcaggagcttaccccaattttttttcaaacaaatgtgatttaatatgtttggtatatgtgtacccagccggttagttatcaaaacaatcatttgtaagtacaaaattatctttttcaagattattatcattctttttcccttagatgttttataatttttctataataatgatttttgtttgagctaataacacatactagcacttcaatatttttgtcattggataattcttgcttcagtaactctgcatctctcgctgaaatcctgcgtccgctactgaatcggagccaagcctgtgcggcccagctcgtcacaacgcttgaagatgatgaacctcgtgacgcgaaactcgtacgtcacgaggagaaggctgctggaggcgtaggttgaggcgtcaaggtcggaggcagcagcgatcgacatgtcatggtccagtaaacataaattgatggatggatgtgaggtatcgtactatcctacaaaaccaaaataacagaaacgatactgatcttatcctactatagaaagggtttttgcgtgtggaccgaaaagcatcttcctgtgcggaaggccggcacgcccgcccgagaaggtctgcgataatcaaattttcgcatgcgattgacccaaccgcacgggaagatgtattatcccgtgcggcactatatacaataacctaggcgtttgggagtatctcgtcctatctcaaccggtagcaataccggattatcaaatggtacgcgttctacatatcagggttgtcattagtcgcacgaattaagaaatcacattatgatataaataagaaagtagaatgcacacattcacataaaatatgtaatagacatatacacatacacacatatatatataattattgtcttggaatttacaataattcaaaaccaaatacaatttatgtctctaaattgttttttcacgtaaattctttctcccactctcttaggcgtttgaaagcgtcattctttgcaaggtcgctctccggatcgtagaattcgcccaaatggttacaaacatcgtggcggatgtaacgacaaatatctgcacacaagttgagaatggttttttttgtcgaacaggtttgctacccatggaattgacatgatctgtttaagaaaaatacatattgaaagttagggaaattaaattattgaatatgttaatgtgtacacgatattttctagactcatatctgcaaactctattgtgtacctcccattaatttgaagcatctcgcacatgtagtatccacataagttagtgcctggtggttgcttgcaacactgtgttgaaaattctgtatacgtcaatatttcaatctaacaagtataaaaaatgttactatagcggacataccattcattaccggccatcgtgtcttcacgagaagcttactcttactggcatcctttactcgtccgctttggtctttgtaatacttgtgtgctctatgtagccaaaaattttgtttgagtcaattgtgagtacaagagccaatagttattgcgtagtgtataacaatacttacaagttcaacaacacaaggaattccgtgaatgtcttctcggcataatgtgccggatcaagcacgacgaccaagtggtcccacggatatactagaaatagtatgtagtggtcgctgcagagaattacaggtgatgttgtattatggaaacagtagtatggaagtaacacttacggcaaagtggaagggaccattagggcatttttgtcttggtgcgtgagcatcgctttccccaagtacattgctacctagaccctctttttcttgtgcaattgattgatgaacgcttttttctcctccgctgttctcacctagtattctaattttcgtaatattcgattaattattatactattcatttttacacaatcctacgaaatcttagatagtatcctgatactacgatcccaccaaatattatttaaaataaggtggattgaaaataatgtgaacaaatatgcttaagtttacataaagaccaattatatttatcaaaattaatattatatgctttgatttatacaatataaatatgtactttcgataatctgatagtatcttgatcgtatggtactattccgatactatgatactacaaatcggaaaacaatcatacctagtatctcgatactgattagcttgctctgtaggcataatagggcagtttgcaacaaagccaacaagggatcaattgtggctcgcgcttgggctggctggccgtatcacgcgtgagcaagaggaaggtaacaacctcaaagttgtgaatttaaagttggaaaattaaaaattttaaatattttttttatctttggatgatttttcttgtttctttaaatattatagttgccagtgccaaaccaaatgaatgcaattaagatttagaaattaaaatttataaagtgaaatcctcttaagaaaatccttttacagttaccgctaccaccactactacgacaacaaacgaatactaccaatgccaccattactaacagagcctaccattactttcgacggggatacccatgaaccgttttctgagagtattggggtacattgatacgaggatctacatgatacgacatcaagcacacaaaaaagcaaggattataccggttcagacatctcgtaaggtaatagctctaatccagtttatatgggattatagagaaaactacagagtataaaagagaacaactgaatttcgagattactgacgagatccttgttaagaagtactcgtgacgagatctatcacgagcaggcttcaagttcttcagattgcttgtggtggcgagtgtcttatactaagattagatgccctgtacctcccgggggggtattgtcgacgtttgatgtcgcgattccggtatttgcatagtatatggatcgttggtactagggtatatgcgagactgaggtaaaagagacggagacgaggatttttatataggttcgggcccctgaattgtcagttaataaccttacatcctgttagccaaagacggtcgttgctcttattcatcataatcacaccagtacaatatttggggtagcctatctaattgttgtcgacatggtggtctgaaggtctgacttgtagtcgataacagggtagtcttccttctcgagttcgtgcccggcgagatcaaagacagcgctagatccctatagccggcctctgtaggtaccggatagggtcgatccaggcatatctctgatgtcgatatccggcggcttgtcttggcgtatgtaagcttgtatgttgatcttctgtcttgatctatgttccgtgtcgtctatggtgggtatgtcccctctcctcatagggggtcttgtatttatacccataggtgtccctttgttcaagtagaactagggaaaccaatatggatacaatccgagtagtccttgtcgtttccatgtagaactctggttgtctttccttatccggaactcctcctatatctgcaggttgtctccgtatagaacatggtatgtggtgggtcctgccgagatttagtcaactactattaggtatgtggtatccataaccctgacagtagcccccgactttaatgcaaatgagcgagttcatattctcaactgcagaccttggagtaactgttatcgagctcacgtgaccgttctcggtgagttcagagataatgttagacttcctttattagcctcgtacgggcacctaaagggtttgtctgagtcaatctccgacgtcaaccaagaaagtacagagcatacaattaagtctcccgtcttgctgtaatcgagaatttggattgaagtcaagaaattttatctcggcgggtacaccatcttttcattccgtattccttgccgagatccaccaacctttctcgaatgatcgagaaggcgtaaaatctgcaacgaagtcttgtcaacatttgtcgtactcgccttagtcgattttggtgtagaacaatagatacatgaagtcttcgataatgtcaaatagaattttcctgaaatcaatactcagataagaatattagatagaaatagccccccgagcgaacgctcaaagggtgacatgttataatatgtatggaaaactgaaaatgaattaaacttacagaccaatgttttgtatatgagcgtctactcttttatcgacttcgatcagtcagtttgttcagttatacacttctccctagcccgcagccttgtcgtcggagaatcgttcttggaggataaggctcttggacctttgacctgcctcgtttgaacaagcactgatcctagcccccagccgtgaagttggaaaacccaatttccgattacacggcttggttaatacgcacgacgagaactcttacacgaccagatcttacatggtctttcgtctctaaaggatccgacaaggccttatccactctgggcgtccccagccgaagttcccttaggttcctcagaggccttgtcaagacggcgtaaagggacattaggataggtttcaatgctaggtgtctttgtggtaagggatctctaggtaaaacacttggcgatattgtgtacttgatatcaactttgttgaagtagaggtaatgggagaatcgctacacctctggtcaagaaccaggtagtagtcgtaactcaaccactagaagtaaatgtacgagagatcgctacgattgactggttgagaaccagtgagtaggtgtctctcgatcatttgaagtcgtggtaagaggaccgctgcattattgctgtagtcgtatctcgaccatctgaggttgcggtgtgagagattgctacgtactggttcgaggaccagcgaacgtgtagaatcatatctcaaacaccaatggagattgcggtgcgagagattgctacgtactggttcgaggaccagcgaacgtgtagaatcatatctcgaacaccaatggagattgcggtgcgagagattgctacgtactggttcgaggaccagcgagcgagtacaatcatctctcgaacaccaatggagcttgcggtgcgggagattcctacgtactggttcaagaaccagcgagcgagtagaatcatctctcgaacaccaatggaagttgcggtgcgagagattgccacgtactggttcgagaaccagcgagcgagtagaatcatctcccgaacaccaatggaggtttgcggtgcgggagattgctacgtactggttcgaggaccagcgagcgagtagaatcatctcccgaacaccattggaggtttgcggtgcgggagattgctacgtactggttcgaggaccagcgaacgtgtagaatcatctctcgaacacgaaccagcgagcgagtagaatcatctctcgaacaccaatggaggctgcggtgcgggagattgctacgtactggttccagaaccagcgagcgagtagaatcatctcctgaacaccaatagaagtttgcggtgcgagagattgctacgtactggttcgagaaccagcgagcgagtagaatcatctcccgaacaccaatggaagtttgtggtgcaggagattgctacgtactggttcgagaaccagctagcgagtagaatcatctcccgaacaccaatggaagtttgctacgtactggttcgagaaccagcgagtgagtagaatcatctctcgaacatcaatggaagcgctatagttggtttattacatgtgcatctcatgtggccaacatgacttacacacccaacttgtagcatatccggatgtccgttcgcaatcatgtcgggtgatcaagccgacagcgttcgcgaggaattatccgttaacaaccttttctcgagtagtccagccatggccggtgctgtgagataggttgtcggtcttcgttggcaggttgggcgcgacgactctgcattcgtcgagatcgttctcgataatgcggtgtacttgaccacaacctactcgagtgctcaattgttcctgaaaaatattttctagaaggcaagacatatagcagataatatcgagtatgtattcgaaaaactgcatggatcttctagtattatcaggatataacgagcagatgtaaatatcaggtattatgtaaaccgtaaacaaacatgattcatacagaagagaatagagcaagcccccagcgttagaccgtagtcgatttaacatcggggacactcacgcaatagatattatataaaaacatgctctaggtaaacataataaattataaatctgacaatgctgtataagtctaaaaaaataggtacgataaatttatataaaatattgcgtacctgtgtagatatatgccggatatatatatgaaattagtagattaattagattaatctaatctactaattaccttgttagtggtctactacacactgcagaagacacatgtatgcagtaaacttagacttgattgtttgttggtcttgtggagcatgatgacccgtcatatgctcgcacgcgtgtgcatatgcacgtgacgtgattagggaaataccctctgttgatcatctccgattagaacacagtaatacaaaggcataggtactcgaacgagtccccgtgcagtatgtagcattgcactgtgctcggctcggacacggcgtcgtgttcggcctgggctgctgatgcttttgcaccagccataccagccgatgtcgtgggcggagaacttgatcagcaactctgcacgaaggaagatggagcactgattgatcccgatccagaacaggctcatatcaaatcgattccgtatgcagcgaatattgttgattctctgcggcgacgatttcctg

SEQ ID NO: 74377 - DNA, 26253 bp, Oryza sativa
cagatttggcaggaaaacggtcagacaataacaagttcagtagtaaagttatttaggaagatgtcaaagcatgtcaagtgtgataagttggttcttttgagaaacgtaattcaaaggcaaaagttatcgacccttgcatcgaatagcagtagtatctagcacccggaggctaggaaagctaatatgatgcagttagtgacaagttgtcaaacatggtatgctggataagcgtgacatcatactccaaagcattcagtggcaagttagaagtaaatgataagcatgacattcttatgatgacaaacatggtatcctagtaatgacaagctagtgttgacgcatgacatgaagtggtaacttgtatgaggttgactccaaagatacgagttataagaagttatggaactgaagccccatcttccaatgccgcatcccagtcgaagtcagctagaggtacaaccagggaaaagtcaggtgaagagaagattccatctgcaacaggagatcgagccaagcagtccagagtggagaagttttgttaggcaagtttgttatagaagacggagcggaagaagtcagacaagaagaaaagaccgcccaacctatcttcttgctagcctcctcgaatctcggggacgagattcttgtaaggggggtggatttgtcacgtcctgataaattcatcccgaaattaaaaatcattcgctaaaaggaataatagaattaattaaaattcgaaaagaaattggcaaaccctaaaatacgtacaagaaaaattcaaatgtggcccggagaatttttgttaaattctccttggtctaaaaggagccctcaaattttacttgaattttcagagcaccggaaataattattaagcaacaaaaacaattatcaaagtttaataaaaagaaaaacctaaaaataattctcctcttcctcctttgggccaagcccagcccgaagtctctctctcctccctctctttctctccctctccttctctccctcctcttgggcccccttcccctcggcccagttccctcctccctctctctcccgggctgcctttcccccccctctcccctcccggcctgcccggcccaggccgtctccccctcctctcctcctgggccgcctctcggcccaagctgagccgccccccctcccgcgcacgtgcgctgaccgcgcgccgcgcgcgctgacgccgcccgaccgcgtggggcccacgcgtcaggccgccgtcgccttcttcctccagccgcccggccgtcctctttccctctcccgtgaaccctagcacccttcctccctcaaatccgcgcgaatcaagcatgggattcccaaattgattgaggggaattaatcccctttccctcctctctctttcccccttaatttccccttgaatggtgccttcaatccccgggaatggacgcgccaagtccggccaccaaccattgccgccggccgtggttcccgccgccgttcccgctcctcccgtggccggctccctcccccatcctataaaatgggatcctcatcccccgttctctcgttttagccccatcccgagcctccccgtggtccctagctccctccctaccgtcgccctctctctcccacgccgccggccgcctccagccgccggtgccgcctcgaccgtgcgccggccggccgcgccgtcgcctcctccagcgtcgccgccacctcctccaccccggcttgccctccgtttcgcgaggtgacccccggagctgccttcccgccgtcgccctcctcttttctccgcgccggccgcctccagccgcctctcccgcctcgcccgtgcgccgtccggccgcgccgtcttctccctcggcctcgcagccaccccctctccctcggtcagccctccgtttcgcggggaaaacaccggagacgcgttctcgccggcaaaacagtggcgttgccgccactgttccacctccggccgcctctgccgcgtccccggtgcgccggccgacgtcgccaccacctcccccggcaccggagtgccgtcctctctcccggccaggccacggcgtcgcccgaatttcgccggaacgccatcgtctccgcgccggcctctccttcctcctcgtcggctcgtcgccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcatcgtcatcgcagcggcgtgttccacgtcgtcctcgtccccgtgcagccgctgccggctgtcctcgtcgcctcctcgccggccccggtcatcgtcgtcgtcgtcctctcgtcgttcccggtcgtcgtggcgtttgtccctccgtcgagccgttctcgttcgtcctcgcttcgtcaaggtcgctgcagcccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccctgtcctcgtcctttcggtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttacacctgttttataattgcaaagcttaattataataatccgcaaatctccatataacagcattaaacttcggatgatcatatcctggtcatacgagctccgaatcgacccgttcaagtctcctaatgtttgttacaacctaaagaactgtgtgctttctttttatgtgttgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaacaaaaccccatctagtggacactctatttatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccgtaggcaggattgggtcggtactcttgtctatggctaggatgggttgggaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttctaattcttaaaatttgctcaacaactaaaatgtgcaatggttggcctgggttggcttgggacgagctgggacccagggtcgggttgccagttcggtctgaatcatcgtaggccttgggttagggcaggttcgtgagggttcacggccttgtttaataatactgtgtagctctaggatcgtctttataaatggctttgggcaactaagtgacttttaaatgccgtttattgcaaaacttaacccctaaattattatctccttgtacccccccttgcattaattatgcatctccggtgtggcttgctgagtactgtggttgcactcattcttgctcaatctttcccctcttcagtaagagaagctttggagaatatgtcttaggtggagtcctggcttataccccagttgagcgcctgtgaagattgagccgtaggcccgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacagttggtatggttgatggctccgattgctttgatgtttgaccaaatctcttcctacgagatgatcttggtcttttcgaatcactagtttggttatcaaatcgttgaccggctaatcctctcttgtatttagccataagcatctcaaaagtgagcttcggctttttggtcttttggaaactagatgactcatcatttgcaactttatgatctttggccttcgcattattgattctagtcttgggccgaggatccccaataataacatttttccttttctttttgttaacatcaataggactaatagggagaggattactatcaattccggtcttaggcatagatgtaactgaaatcgtttcacaagtgaccgatgaagtatcaatcggtctttgctccatcaagcttgcatctttgaaataatcttgaaacttatgctccatttgtgaccatgtagaaattgaattaggagcaagcaaactataccatgtagatgcaaagtttgacaaagaaaggggaaacaactttaacttaagcaaatcatcgctactggccttaccacattgatcaataaatcggccgatatgctccattgttgttctagcatcctcatctgtgaatttcgtgaagttgggcacctcaaatccttgcgggtatgggaccgaatctatgtgttcaggatacggcctttgatatgtatgcataactattttagattctatctcattactatcccgcaagacattatcatcatcttttccaacatccacatgaccgatttgtgaattggtcttaggtgacaatgctatttcactttcgcttgtaatacaatccaaactgtcatttagttcggctatatcttcgatgatgctattgtctaagctagcaacacaatccgaatcatcacttgaattggctattccatcattgtctaaactagtaacacaatccgaaccaacacttggttcggctataatggttgttgcattattatccaagctagcaagacaatctgaaccaacatttggttcggctataattgctatggcatcattgcataaatcattaacacaatccgaaccatcgcttggttcggctatacatgatattgcatttttatctaaactagcttgtaagctattgttatccactcggctttcctgagccagagcttcatgcaacacatgatcaacatcaagaaatatctggccattcaatttctctttaatagaatcaagcaatccatcatatgcaatgtcggccaaatctttgtcagttattttcaaattgaaatatcggtttttaacatctctaaacctttcaatataatcaacaacagattcattgtatttgtgcctaaccgatgttaaatcagacaacctaagctcagttttagcagtgcaaaaatgatcatgaaatttttgttctaattgagcccaagtataaatagaatttgccggtaaagaagtaaaccatgtaaaagcagtaccggacaaagataaagaaaacaagcgcaatttaaaagtatcactattagcctcaccacattgcgctaaaaattgacctacatgctcccatgtggtcctactatcctcaacactaaatttggtaaattcgggaactctataattacgaggatatggtacattatcataataatcaggatacggctttttgtaagatctagcacgattcctaatttcaatcccgaatctatccctaataatatcactaattatatcctccatattatcagacctatgttgatttggtggtggatttagtgtcctaataggttgtgtttgcggcgcaatatggttatattggccttgtctagtatcgggaggataccccctagcaacatcattataagcattaggaacatgtgggggaacttggggactatttgcagcagtagatacaggaggatcaaatgttttaaaatgatataaataactagcattagtcattggatctatagcctgtattgggacaattgcgccggtctgaccggcccagggcccggtctgaccggcgtcatgatgtgcagtcggaccggcctgagagccggtctgaccgccggggtaatacccggtcggaccggccgtctggctggtcggaccgacggctgtgtagcggtctgaccggccgtcaggcccggtcggacaggccgtgaacgccgttccgtcggttttactacccgtttgatctataggaggttgattagcagtggtataggctttatcctttaatgtgtaatcattcataagagggccgaatttaatccttaaaaacccatcaaatttatccttaaacattacatctaacttatttttaaaagcaatcgtagatgaatctattgtagatgctacttgttgttggatagattgtattacctcgtcattgcttaccaaatcgggagcgagcttaggaaggcccgggcttgatgatcacgccttgacgagtcctagtgcacgccctcatcaacgcctcctgtgtgatctccttgatgtactcctccatggacttgcggtcttctccttcgaaatcatccaatgtgaccgacatgatctcgttcccgctcatcatggttgatgaagaaattccttgattaaatccggccatatagctcatagccgaaatatttgaccgaatagattaatatatggtcttgatatgttactgtgtttagccaattttattaaaactagcctttgttgatttttctggacgtaacagtaacttcggtactgtaccaaaatataccaaagatcaaccgatcttagattagatcggctgctatgttttttttttttgggtacgtgagcagtaatagatcggctgtgatagcctgatccttttttttcttctcttcttttacacagcaaaccgaatagatttgatactcaaaatttctggccgtgcacagcaaaactctgccggccctgctactgcttctcctcggtcagggtacacgcgcatgcacctgtatacgacgttgctacgacttgatgaccctaagcactaagcggcagatgagacacgtcgatgcagatcgcagctgtagccgacaagcagatggcgtcgatggcggcgggctgctgcagatcagtactattgcaatcaatttcggccacacggccgaaagttgcctcaactcgatgaaacgatgacagtgtagattgatttcggctgtttagccgaaattcttaattttgacgaaacagttattactagattaaacaaaattcggccgtgatatggccgattagatcgttccccagcggagtcgccaaaaatcgtgttggcaactttttgtgacaagtcgacaagcacgatcgcagcacctaaaccccttgcggtgatcctagagtcgccaaccacctcgatctagctaaagggccaaatcaagatgggttttgttgaaaaacagctaaaccagctagcggagccgatttagagatcaaaatcagcctctaggccgatttagatcaatatgaggataactacccgtctcgtgggcaaaacggaaggttttcaggacaaacctacaaagaggtgttgcactctcgcagcggcggcggacggtttacggcgcaaaccgacaaagatggactaaactagggtaaaatagaaaacatagtaaaagaacgattcaagtagattgtattcgggggttttacaatgaaccggccttgtcccttatataggggttggtcttgccctctacaggcccttctccacgtccaactcgggatagaaactaaaggaaacacgaaacatgccttcccgagcaaggaaacccgagacccgacgaaaatagagtcggactcggaccctgacagtctgaccgcccacatacctgtggtcagaccggccctactagccgatcagaccgcccacatacctgtggtctgaccggccctagtgaaggaaacccggcactttccaaactttggcaatttttccctatttcgttcataggtgccaaatttggatgtaaacagcgcagtcgaaatctagtcgggccatgtctggagggacctctagcgcgtcccctgtgacggcatctaccgacatcattcccgcgatcgggagtcgggaggcgacgcccagcggccctgccagcgatcccgctggaggccgtggtctgccagaggctatcctcacctgggaggagctccaagctgagatggggcgtcttctcgaggccggtgctcgcggcattggccgcgaggtctcgtaagctagggcggagacggcggcggccaacgcgcgcgctgagcgcttggtgcgggaactggccgaagcccgtgaggacttcacgaagatgagggagctggtggccggcaacgagcgctagcgcaaagggctcgaggaccgcatgtcggaactcggggataacctctccgagatccgaggttcgttgcgggtcacctacaccggtctccaccaacttgccgaggagtgtggcatcaagtccacgattccggcgaaccccgacgagttttcgttgacctcttctcttgcggagctagcgacggcgatggggaaaattccctccaagcacgcggccaggatcgcggaggagtcgtctaacggtatctataccggggcgtgtcacatcctcgcttgcatgaagttgtcgcgtcctgagctcaacctgcgtgaggtcttggatcagggagcggcaagcgacgcgcggaaggaggtgatggaggaagtcagtgatctgggggaatctgtcctcccccactttgaagagtaggacctcttgtatttttctgactcgtaaattttaaactctggttacccttatgcgcatgattgccatctttgttcaccgttgatctcggaagtctatcttgtcgattgtagagatgccgatgatgaggatgtccagcagcgcgggcagcctgagtcgctggcaataattccggtactcgagtttgaaccgcacgcatcgcataacgtcgaggaccaaactcttgacgcggaggtcgaagtgacagcaactggcccgagtgagtgatcctgtcaaccttgatgctgttttgggggtttccgagttatcttagtagtcgttatgtttagcagatctcgaggattcccttgcgacccaagatcgtcgtatccaatattggaagacaaaatttgaagtggtggaactcgagagggcaatgctggccgtgaagaaagatcaagctgtggaaacgctccgaggccgcgaggtgtggttctcatcttacttgaagagttgttgcacctcgatggagagggtgtgtcgggatcttcgggtagcccgcggtgatcctgaaaaatcggcggccgggtacatctcgtggctcaacgaggcctgcgcccaactcgatggcattggtaagcgtatcgacgaggccttgaagcaagagtgttgtcgagcgagccgatatgccggaggacatgtgctggcttgcatacgagatcactgcccacgcatggatcttgaatttctccgcgaaggttttggtcgttctcggagggatccggcggagatagaccatctcgcgagatcgatgtcgccgttggccgagaagattttccaatcaatggactggcgttggccttcttggtaggattcgtaccctgcaacaagatatcttgggaaaagatgtaatgtgacaaaatatttatgtacaaattgtaaggaatattttgtgaataaagaaatctatctttaacaaatgtttcttactcagggtgtcgtgtgtaaggccgtgttctcagttaacgaccttagttagccgtttgagttgtacactctccctagcccccagccttgtcgtcggagggatgtcctcgggtggcaaggctcttggacccctggcctgtcttggttgaataagctctgatcctagcccccagccgtgaagttggaaagattggtttccgattacacggtttggttaatacgcacggcgagaactcttacacgaccagatcttacatggtctttcgtctctgaaggatctgacaaggccttatcggctctgggcatctccagccgaagatcccttgggttcctcggaggccttgtcgagacggtgtaaacggacataaggacaggtttcaacgctaggcgtcgtcagagtgaggagttgttgggtgaaaacactttggtcattatatgagaccaagaagtagtctttattgatactgtaagggtgcttacaggtacaatggtattgactcatacatagaatttacgtagttggtcaatgttccatgaatttgctaattcgcgaccgtcgccgtctgcgattttgtatgcgcctggccgcaaggcttgtgtgatcatgtagggtccttcccattttggtgagagtttgtttcgccctgcttaggtttgaactcgtcggaggacgtagtcaccgatcgaaagtatgcgtgctcggatgcgcttctcgtgataacggcggagggcctgttggtagcttgctgctcgcacggcaactcgctcacgatgctcctcgagaaggtttacatagatgtctcgctgttcatcctgcttcttgtcggaatgcttctgtactcgtgtactttgatgtcgtagctcaccggggagcatggcttcagagccgtacacgaggaagaagagtgtttccttattggacgttgtcggtgtagtgcgcacggcccatagtactgatgggagttcttcaacccattttttgtcatgtgacatgagtctgtcgtagacgcgggtttttatcccttctagtactatgtcgtttgccctttcgacttgtccattgctttgagggtgagagaccgaggcgaagcatattttgactcctaagccgatgcagtaatcttggaaatcggcgctgatgaattgggagccgttgtcggttatgatgcggtgcggtagtccgtatctgcaaaatatccctctgatgaacttgatggcgttgtcggccatgatttctccagtgggtgctgcttcgatccatttggtgaatttgtcgatcgctacaaataggaatttgtagccgccttgtcctcgtgggaatgggccaagtttttctagcccccagcacgagaacggccaaatcagagggattgtttgaagcgcttgtgcaggtagctttgtgtgtttgctgtggaattgacaggcttcacatcgctggaccatgtcgcatgcatctttgagggctgttggctagaaaaacccttgtcgaaaggctttcccgaccaatgtccgaccggcggcgtgggacccacatatgccttcgtgtatgtcgaggaggagttgtctgccgtcgtcggtagagacgcatttgagaagtatcctgtttggcgcttttttgtataagtcgttgccgatcatacagtagatttttgctttacgggttattttctcggcctctgtgtcgtcttcgggtaactcctcgctgctgatgaatttgattaatggggtgcgccagtcatccgttgtttcaatgtcagccacggcgcgttctgccgcgatgacctccgagctgatgtcgagggtgcttgggccaacttcgccgcttacttcttttaccgaaggttttgtcaggatgtcgagaaaggtgctgggctcgagcggttctcgtctggatgcgcgtcgggctaggtcgtctggctcgacgttgtccttgcgatagacgtgtcggacctcgatcccgtcgaacctcttctcgagcttcctgacttctgcaaggtacttggataactcggggttagagcatttatagtctttgtgcacctggtttgcgactagctcagagtcccctttgacgattagtcgcttggcgccaagtgcggctgcatctcgtatcccggcaagtagtccttcgtattctgcagtgttattcgttgctctgaagttaaggtggattgcgtgtttgaattgatctccggatggagatgttaagataaatccagcgcctgctccttggctattgagtgcaccatcgaacgccattgtccatgtctcattgtcgccttggttatctgacttgttatctggcatggtccaatcggccacgaaatcggcgagtacctgagatttaatggctgttcgcggcacgaagtggacatcaaattggcttagctcgactacccatttcgcgatgcggccgacaacgtctttgtttctgacaacttcgccaagagggaaggaggaaacaattgtgaccctgtgggcttggaagtagtggcgtagcttccttgatgtcataatgactatgtagagcagtttttgaatctgtgggtatcttgtctttgcgtcatggagagcttcgctgacgtaatagactggtcgctgtactttctctcgctcgacgacaatgacagtgctaacggagtgtggcgtagcggcaatataaaggaataattcttcattaggttggggagcaacgagtacaggggggtttgataggtagcgcttgagtgcaataaatgcctcttcggcttcctgtgtccatacaaatttgtcttgtttcttcaataaggcgaaaaaaggttgtcctcgttctaccatcctagcgacgaatctgcttaatgctgccatgcatccggttagcttctgtacctccttgagtcttgtgggcgacttcatgttctcgattgctttgatcttctcgggatttgcctctattcctctgccagaaacaaggaatccgagtagcttgcccgacggtactccgaacatgcacttctctggattgagcatgaggcgatatcgtcggaggttgtcgaacgtttcccggaggtcatcaatcaatgagtcgcttgtcttggttttgacaacgatgtcgtcgacgtacgcttcgacattgttgccaagctgattgctaagtgcgccctggaccgtgcgttggaaagtattcccaactgttatcaatccgaagggcatcttgacgtagcaaaataccccgaacagtgtgatgaacgttgttttttcctcgtcctccttcgccatgctaatttggtcgtagccagagtaagcgtcgaggaagcttaatagttcgcatccgggtgtcgaatccaccagttggtctattcgagggagaggaaagtgatccttggggcacgccttgttgaggtctgtgaagtcgacgcacattctccattttccattggctttccgcaccataactgggttgacgagccactctggatggaggacttctctgatgaagccagctttgagaagtttgtcgagctcttctcgtatggcttgttttcgatctggtgcaaatctccgcagtctttgttttactggcttggtatcgggtcgcaccattagtttgtgctcaatcacctccctggggacccccggcatgtcggacggttgccaagcgaacacgtcggcattgtcgcggaggaaggcgatgagcgcgagttcctatttctcgtctagtgtagccccgattttgacagtcttgtcggggttagcactagagagcggaacgatcttgatggcgccgtccggcttcggcgtcttgtttggcttgctcactttcttgggtggctcaaacatggcgggtggagtgggcgtttgctcgaccatgtcgaggcttcgcttgttgcactgcaccgccagctttgcgttcccttgaatagtgattgttcccttcggtcccggcatcttgagcacttgatatgcgtagtgggatgcggccatgaacttcgcaagtgcagttctcccgatgatggcgttgtaagctgtatcgaattcagcgacatcgaaggtgatctgctctgttcggaagttgttggcttggccaaaggtcacaggcagcgtaatcttgcccaaaggtctggatgatgattggggagtaattccatggaagggttgatcagttggtgtcagctcactttgtggaattcccattgcatccaaagtggtggcaaaaagaaggttgatcgagctgcccccgtcgatgagaactcgtgctaccttgatgttccgaatagtgggttcgaccacgatcggataccgtcccgggataaccgaggttttgggatggtctgcttccgagaactccatcttctgctcagaccacttcatcctgggtgcagccccctgccatgtcgaacaaacttcgcgttccactttcttgtattctcgcttggaggagtacgtcatggagccgccgaagatgtgtgaaacatggaggtcggagtctgggtacgcgaagtccgattcgtgaggaggtgactcctcgtttttctcgacaacgcgtactcgcttgcctttttcaaacgccatgtgcttctcgggcgactttttgaaaacaaggcaatcctccagagaatgtctatctgttttgtgtatggggcaccaagatttctttgtttcgcttccttgtgggtccgggtgcttgggagggttcgcgtattctgctgcgaggacttccgcttgagctttccttttcccgtttttgcgatttttcttcttgtttgactcagatgtgtctgcagctgatttcttctctcccccagtcttcggcttgtcgttcttgcgccttagtgcatcatccacgtgggcacacctttccacgatctcgaatagtcttcgagtagttgtgatgcgtcttgttgccaactcctgggtagtgtagcgatctctgacaccaaacttaaaggcgcgaattacataagcgtcggtgatctcggggatggtgttcctgcactcgttaaagcgccgaacgtattccctcaaagattcccctgagttatgtgttaacgcgtgaagatcgtcttcgatcgcatgacgcttgtatgttccttggaaattggcgacgaactgctgccacaggtctgaccacgaagaaattgagtaggggggagatacatcagccacgaacgtgcagaacccttcaacgcggttggtaaatagtttgccaacgcattgtcatctgctccagcggcataaatgtaacatcctgaaaatgtgtcattttctaatcctgcatcatgccgattcttatgtttttaataacctcctaaacttaggacagtataattagagggacctcctaaaactaactcgcacaaaacctctatagtatttaatctcttttgtgtttttcattttaaaatatatatttggttaaattgaggtatttcttgatttggtttaaaaccttcttttgacaaaaattcttttattcaaatttagtttgaaaacccctttctattttttatgaattatggtccaataaattctccactattatcctataacttaaaccaaatgattccaattggattcaattgtcgacccgtcctttgatcttaaacctatcctttgattccaaaccggcctattcttatttatcgccaaatatctaaattcttcattttgatctagccgctaatttaattcctgtggcttgatttctttctcggcacaagaatattattattacaaatattgtgaataattgctctcgtgctaagaaaataaattatatccttgtcacctaaatttccttttagcctcaaacaattccttgaaacctatgccatatatattagggttcaaatcctatccttttgcctccacctattttcctaccatattcccaaaaatattttgaggaatactattaatttccttttctatttgagtgcttccaaataaattccctcaaactccacctctaaatattgcactcaaataaattagaaaatctcttttgtgaattctctccgaattcaaattcttcgcaaaacctagttatccaaatcaaatatataaattagacttctttctttttgtcatcgggccgaaactccgttctttcttccttttggcccaatcctttttctttctattttcctccttcctcttgggcttccggcccagctaagccgagccggcccaagtcagcccacaacccagccgcctccctcctcctcccagtgcgcgtgttccacacgcgcacgccgccgcaaatgccgccgcaaacgtcgccgctaaggaatcaagccggcgccgtcttttcttccttcacgctagcatcaccgtgaccgagttgacgaccgcctccacaaccgcctttcatcgcctatataagaggaggaaccccctctgtttatccccgacatccgagcttgaagctctcctcttttctctctctagccatggccggccgtccaccgatctcccttaccggagcgttgtcggccaaatcctcgcgccactaaatccgccccgtcgaggtgattccattttgcccctttcccccttcccttttcttttgaatcaaaccaccaccgctactctatttactgccgcggccgagcttttgtcgccgccgttccagccactcacctcttcccctcttccttccacatacctccccgagttctcaatgttcgggaacacactttaccaccgccgtcgaggccgttccatcatcagtgcatcggcgccctattctctctctcccctctgttaccgggctggaaggaggagaagaaagaaagtgacgggaggaagaagaggaggagagagaaagaaaagaaaaagaatagaaaggctgacaggtgggccccatgaatagtaacctttcatattttctagatttaattcaaatcctattctttaaaagcccatatctcctaaaccgtagatccgattccagtgaaacttggacctaaattcatataaattcaaatgcttcattttgatgcctaattgctattttataattttatttgaatttattcaaatatcatttgaatttatatttgccttttgcaaatattttcttttaccccaaaatacccattagccactgaaaagctgccggttggaactttacgccttccacggggacgttcgtgtggtttactatcctcgacgttggactattggttgtaaagcccggcaaaaccaaacctaaggtcgaagtgctgctcctggcaccccacgcctcgatgcgtacagcggtcggagcttcactattccctcgacctccacagtacgtcgcgcagttagatctcgagctctgtgtaatcctagccgctccgccgccatccacggttgtcggagtaacacttccgcctcgctaaacttgcacaaacctcccatccctctagccgttatattgtctatcgacaccagctagagaagataccaaacctagtcgtcatgctttagcgacgactagagaacactcaaactctagccgatatttatcttacctcaatatcggcttaaacaattgaaaccatagttagcttattaaccagactccccgccagctataatctcaaccatttaccctccaactacctagaacatatacataaaatatagagcctggccgatatattgtcccactccacaatcggcttaaatatgactaaaccctaagtataatgctacccaaacctactatcagccaataccagtcacatatctgctcaacctgttcaattatccactatactccctatccaccaaccaatcagagcctgcacataaaatataggtgaccgtagccacttaattccctctccaccccaaccaccaactctttagaacccgcgtataaaatattagcctaataatccttataccctataaaggagataggttataccctaaaccctagccctctgtactgcttatctctttcttgctattttatggcttttattgaatttggttcttccttttctttagtagagtctgttatattttagatggcaacctgtggtatttcaaagatcggataatcaggttgcccatctcggatttatttgcgttggagcaaggcaagttattattcctctcctttgagcataactaccctatattctatatctctgttctatgcattagtcatacatgatttcaaatgcataacctgaacatagcaaaccagatatgctagattttgcttagccatgcctagttagattgcataaaatataataaacttagattgggacagtacggtagaaatggttgatttccgggtggctagtactgttccaaccgacataaaactgccaagtacatgtgaagaacatacgagtacgaccacaattctcgtatgggcatagacctagctgattaagttatctagcaaaggtggtacctctgtatagtggttcttcttaagtcctcgcgcaggaggcaaacttacgccgagcagggcgattatgatatttaccgaggcgcaggtaaatatcttgattatctcgcgagctgtgtgtgaattatgaaaacctgattgagatgacgggggtctctcaaccagttctctctgaaaaccccgggaacgccagaactcctcttgctgctgataacgttacgttcagagcgcatggggactagagttcatggaacaggtaccactgatgttagtaaccgaaaagctttgccatgacaaggctaatgtgtttggcacgtcatggattgcgggtaaagcgtacatctactgcagtatgaatattattaaaactattcaaatagccgtgctcgcggttatcgagcattgggactcacaatggcatcttggttagaaacataatttcaaactctattaaatactgttgcatatcaaacatttcaggatttctacttctttattctcagctttctgcaattaaacctagctctactcaaatattaccatttcatacatttattattgaatataatagcttgctgagtacgttgtactcacccttgcttcaacccccttttccagagtcattttggagttcttgccgaagccgggagttcaatcataagttagtctcattctaacttaattctcaaatatagattagatagatagtttaagtctatagcaaaacactagagttgagtcatcgtatagcttctactgtaatagttagccacaagtttgtaaataccctatcattttatgtaaaggaatctcctttaaaaccttgatcaaatgtatgcaatgaagatccagatcgttgaacctgtatcaatctactgatccaggtcttgatacagtctaaacatgtcggttttcgaatcattagttttgggacccgacaataaagcactgtcaagtagacttggaggaattcttctgggtcggtgctcccatcatacttttcaatagctccgggtcggaatctctcaggccatcggacatcacgtagggaacgaccgaaagccctgcacccagcgcttggagcggcgggttgtcggcggtcgcgtgaccttcgtggatcttggtctgacgatgaagaggactcggatgatgatgatgatgacgatgggtcgcttggttccggcgtacgattacgagggtgacgacctggatctcgggaatcttgtcttcgtctctcgctgttgtctcgacgccgatcttcttcatcttcgtcattacggcgacggccatgaccaatgctgtccggcccccgccggtcgcgatcgtcgtagtctcggtcctcgtttggacgacttcttcgatcatggtgtcgtgaggagacatgacgccgggagtggttcacgtcatcccgtgctcgccgtgcttctcgacgaccattgatttgatctcgaagatcgccagtaccacgaggtggaggggtagcttgtcgaggtgattctctccgttctagaatttcaccgttagcatcgccgacgggagatcggttttgttgggctgcggtggcggcttcttcgaacgcgttgctgaggttagtcaccgatgcccgtagttgttccgtccaacgctcgaggtcgtcgtttagaacaggatcgtaaggtgtttccctcagtatggcctaaacagccctgatgtgttgggctggggtagtcgattgattcgccgtctccgcgttggcttgtgctgacgtgccaacgccatcgatagccaacacctcccgcgccgcgtctgatatcgatgaccccaacgaatcgatctggggccggagtcgctccttgttccttgccgttatccctgacggggacgtatgacttaggagacggagttttcatagcgccgagtagaactttgcaactcgagaggtcgtgattctttgtcttatgaataggacaatagacgtcccgagttggagaagtacgttgaattccacgttctttgcaggcgcggatttcagcatggacgttgatgaatacccagcaatcttgaagagtatgtttcttggttttatggataggacaccaagacctggtagtttcggaagtcatctttgttggcccgtgattttcgtcggggggacaaggcttggccgcatcagaatccttcacgagtttgggtgtagtcggtaatccgttctctgtttcaacgggtggatttttcgacatgtaggcgtctcggttcgtagccactgcgttctcgttgccagttattgggggaccggttgagatcggcatagtggtgtaaaccgggtagacgatttcgccgacttgagtccataccagcattgttgaagtaggaagaacttcaccgaagctggtgttggcattgttgtcgacgaagcttgatggcatagtagtagaaccttgaataccaggcccccctacctggcgcgccactgtcgacgggggatacccgtagaccggatatagagggtattggggtacgctggtataaggatctacgtagtatgacatcgagcaattaaaagacaagaattatactggttcaggccccttgataggtaatagccctaatccagttgatatgggattatatggtggaaaacacagattacaaaggaaaagacggaactcaggggatttggcgagattgtagtcgagatgattcgactagctctcgtcgacttggctccttgcaggctccgacttcgtaggctgtgtgggttgtgttggctctgagattcgatgatctatgccctccccggggggtcccttttataccgtaggttgggtgctctccgagtaggactcgaacataccagacctggcacgatacgtaggtaacccaattcttgtccgaggaggtctctcttcgtccattgactttacgaagagtttccttagacgccaaaggatttatccgtgcacatgtgaataggccttgtcaatacgtgacgtatgtcgaggggtagagggtatgcctgacccgtaaccctgacaaaatcgaagttcgaacggataagttaagacctcgagaagttcaaattcagagaaaatctaatgacagaaagaaaaggaatattccaggaatatcctatggatattaattctttaaattgaattatttttaataagaaaattatagtggggcccactgattagtggctcaggttttggtggactcggtgtatgatgggtcggctggcgtggatgcctcgtggtgacacgtgtatagagatagatgacatggcaatgacgtgggtggatctagggctgatgtgccgagggaaggagttatggtaatctgactctaaagatttaagcaaggagatcaaatggctgtatgttcctcatgtttgatacccttggaatactctaagggaaagtgctaccgcggtattctgtgcgcctcagatttatctgtgatcgtatcacataccaataattgcattatagcggaattatagctagatattactgttatattcatataaatttagcctaaattaattcactttcactaaattatggatagttaaaaagagataatgaatatagatttcgacttgtcacgatgtgttaaaacatattagaaattcaatataataatactttaagagatattgtggccgggagatttgctaagaagcaaacggagactggagaccatactgaaggacgcacatttcgttgaggtgattttctcatggaactgaacccccatatacctgaaatgctatattctattttgggtttttttttccttatatataccatttacccaaaatacaatattctattttggggttttttccttactagcaatagtgtctgtgcgttgcaacgggaaaaacaccgtttgatagtgtgacaccttgaaaacctcgaatctgtaaaaatcttgatatattaatcaattcgacggcccgcaagctgagcagttgagcgcggcccacatatgcggggacggtccgatgcacttccgcagcccattgggcgcagcgtaatcaacggcggcgacagcccgacgctaggcgaatctgagccgtccgatctaatggacggctccaatcgtacccgcgctggatgaagcgccgatcggggagaggggcaaaaccctggctcccaaatccctctctcctgataccatttatctccggagacgagcgagcaaaacgatggcggtccggcaagctggtgcgcgcgtgcagcgacgaccgccgagcggctcctgcttcgccggctgggggccgcacccgagggcagcgcaaagccatgccacgacgtcggcggtccggttaggtggtcgtgcaaacggcgacgagcgctgagcggcttggacctcgtcggtggtaggggcgacaccaagccgacacttcccgtcttcggcaaaggacggtggaggggtgctccaggacagcgtgcgcaggaaacccgacacgactgcgaggaggtgaaggtgcggtggtgccgcttcccagaaagctccagtgagctcaggggcttcaagtctggtaagtaacccgaacccttagcttaattgatttggatttgactcttatggttcttacccgaaattagggttgttcgaatttagagaattttgtcgggaaatttcaatctattttattccctcttttcgagttaggggtgtttcaatatcgtttattctcttttaatttcgggaacttcaatctagtttatccctttgctcaattttgtttttttagcttgcgtttcatcgcgcaagcggggatggagggcgccgctcgtccccacggaaagattgaatcggactttcttttatttgttttaatgtttttttggtcctttttttcgttattacggacaacagaaacatttttaattttttaagcagtagagatagagaagatagagatatatagtaccgtgtcaaatataataggattcgatttttttaccgcgtcacgtataattcttttttttttggaatcggacatatttgttttttttattttttttttctcctttctttttacagcgtccacacggattcttttttttttggccggtcttttttttcacctgttttttttttcgcctgtttttttagaatcggacagattcctttttttttctttttgccctttttttttactgcggaatcggattcagttttcttttccctttttccgcccgtttttttattcttttttcgtccggttttttttgcccgttttgttttggatataggattgcatcggttatagtcggtttcgatggtagggattaatgtagggacaaacctacttttaaagcagattgcttttctcatattcaaccttttccacatgtggtaggtgttgtgtaattgtcttgagagatggacccctaattggttgctgcaattattgtctgtgcatgtactatttatcatatttatacaaaagatattgtacggcttgattcatactgctttcgtttttttaatagatgacgccgttgatttttttctcacatgtttgaccattcgtcttattaaaaaaaattatgcaaatatataagatataaatcacacttaaagtactataagtgataaaacaactcataacaaaataaattataattacgtaaattttttgaataagacgaatggtcaaacatgtgagaaaaaattaacggcgtcatctattaaaaaacggaggtagtatgattcaattttaacttatcgcacatcaatcttattactgtaattttacattatcatactcacgtattttcctcatcgtctcatatttataatgcagcccctcgcaacgaagtagacggtgttaataagcagtagcagcccaaggatgatatatgtaagattcttgtcttgtgttgtcacctcaataacctgaaacattgtaagggctcggtttgggaaaactggtagaaatgacgcttgacgggttgaggtagccttaggccccgtttagaccctcgggactaaacagttttaagtccgtgtcacatcggatgtttgaaaattaattataaatattaaacgtagactattaataaaacccatccataatcttggactaattcgcgagacgaatctattgagcctaattaatccataattagcctatgtgatgctatagtaaacattctctaattatagattaattaggcttaaaaaatttgtcacgcgaattagctttcatttatgtaattagttttgtaagtactctatatttaatactctaaattagtgtctaaatagagggactaaagttaagtccatggatccaaacaccaccttagttcccaattttttttccaaaaaacatcacatcaaatctttagacacatgcatggaacattaaatatagataaaataaaaaactaattgcacagttgggaggaaatcgcgaggcaaatcttttgagcctaattagtctatgattagccataagtgctacagtaacccacatgtgctaatgacggattaattaggctcaaaagattcgtctcgcgatttccaggcgagttatgaaattaattttttcattcgtgttcgaaaaccccttccgacatttggtcaaacgtccgatgtgacatccaaaaattttcatttcacaaactaaacatgcccttagctgatcacctgctggcttatggaccaaactgacccgaacacattttttaataaaatcataatttaattgtgtaggatagggaatctataagatatactcgatcagtctgaagtccctcactttaattactactccgtattttccttagcaagcataccattaattcaatataagatctatctttcttagagttatgcctatgtataaagagggaagctatatagcgcacgcgcgccaggaaaataagttgtgcacaggccttatccactaccaaccgattcccccctccctgcattcgcatggatgagacgtctagcgctgccgctattcctcctcttcgtcgtgagcgtgcacctccatctccaacctctccatcgagacatcatcaagcccagaatcggttcctctttctttcacactggtggagacaccatctttgatcggtcgcccaaaatccacaatagtcccggttcgaataaaaaccaggactaaagatgatttttagtcccggttaaaaactttttgacctaccaaccgggactaaagatcatttttagtcccggtttaaaaagttgtcgggtcgagttaggccccaactcatttttagtcccggttgggggctgcaggaa

SEQ ID NO: 74378 - DNA, 6203 bp, Oryza sativa
aacaaccgggactaaaaatggatctttagtcccggttgtttataccaaccgggatcaaaaatcaaccgaaccgtgcgccagtccaccgtcctctcctctctcattaattatcccttatcccttcgatcccaccgtcctctccatcccttcgctattagccctatccctctcagccttcctcctcctccatccattctcctctccccttcctcccccttctcctctcttcctcctcctcctccttccacgtgaggccgggctgcggcgatagggaggcgggcgcccgagcaggcggcgggcggccgggcaggcggcgggcaaggccggcgaggcccgcgaggcggcgggtggccaggcgggcgaggcccgcgcggcggcgagcagccgggcaggcgggcggcgaggcggcgctccccgggcgggcggcagagcccgaggtggcgggcagcggtgttcccagggcagcggcgctccccaggcggcgggtggcggtgctcccggggcggcggcgctccccaggcggcggcggagcccgaggcggccgggcgggaggccggtgaggcggcggacggccggcgcccgatctctgtgatgtagtttttttccctgatccgtgtgatatgtgcggtcgatctgtgcgatgtcgattttttttcgatctgtgtgatgtgtgatgtgtgaatgaatttgtggagatgttttttgaatgatttgcgatgtatttggagataaaaatgcagcttgatgtatttggggattttgtgaatgatctgtgatgtatttgggtttaaaaatgtagcttgatgtatttggggattttgggaaggatatgtggtgttaaaatgatttgtgaataatatgaatggtggtgctcgaaatcatgaaagcatgaaaaaaaaaagaaagaacattagtcccggttgttaactctaaccgggactaaatctttagtcccggtttttaacactaaccgggacaaaagatggatcttttgtcccggttatttcaaccgggactaaaaataggcatctttagtcccggattcgtagtcccgtttgtataaccgggactatagggggttgcgaaccggtattaaaaagggtttgtccaccagtgtcatctccctgccagctgcttcccctacctctcttcccccaccccttctcccgcccctccccctcctgatgggttcccctttatctctccttcagcatttgttcccctaccatttgttcccctaccccgattcctcatgttgttgagacatcagcgacttccaccacttctctatagatttatccaggttttgcgttgaattttttttggaatttgaagaaggttgattgaaagtttaggctttcactgcttcgatgaaagttctatgatttttgagatgaaagttttgtgattttgagatgaaagttcaagttttcaatcaaaaatattttcagatgaaagtttcagatttttaattaaaagttttgtgattttgggataaaagtttcaattaaaagtttcttttttgagatgaaagttttgggtttctaatttaaatttttataattttcagacaaaagtttcatttgagtcgtttttttcaattttgatatggaagttttagattttgagttaaaagctttttaaatttgtgataaaagttttagcattcttgtggtcaggtggcatcaaggaagaagaacaagctctcgcctctgaatcaatggggagtggggctgaaacatgcgcacgacagcgggcctcatgggcatgcttgtgcacctgcagcggagctgcgccaaagcgctaagcgctagcggtgtcttgacatatactctgtatgttgtcatcatccaaacacccccggtggtacttggatcatggactaaactgtccctgtcctatcggatgtttgaaaattaatttagagtaataaacatagactacatacaaaactaattacataaatgagagctaattcgcgagacaatttttttaagcctaattaatttataattagagaatgtttactgtagcatcacgcgggctaatcatggattaattatgctcaatagattcatcttgcgaattagtccagagttatgaaataggttttgtcagtagactatatttaatacttctaattagtatcaaacatccgatatgacgtgtactgaaaaatttttagccccatccaaacacccccgatatgcgtcactgtattgtgccagatagatgaatatatctgtttaaaaatttcagtcccttaacaactgacaaaaggacatttcaattaattatacaaaaggacatttcaactgttaagtgtgcatggatatgcgaagggacgaacagtagctagtactacactagagattttttttttaagtacagtaaaggtctagatctttgaaagacatacaccacaccataaatagagcacggtaccaagctaatgagtactgagcagtcgagctagtgcccagccttgcgttgaacatcacattacgtacgtttcagcaagcaggtgctcgatcgatcggccatggcaccgcccacggtgctcaactccggcgagcccgacgcccgacgccgcgagcggccgcacgtcgtcttcatcccgagcgccggcatgggccacctcctcccgttcttccgcttcatcggcgcgctgtcctcccacgacgtcgacatctccgtcgtcaccgtcctccccaccgtgtcggccgccgaggccgaccacttcgcccgcctcttccacgacttccccagcatccgccgcgtcgacttcaacctgctgccgctcgacgcctccgagttccccggcgccgacccgttcctgctccggtgggaggccctgcgccgctccatgcacctcctcgccccggccatcgccggcgtcgccccgcgcgccacggccgtcgtcaccgacgtcacgctggtgtcccacgtgaaccccatcgccaaggaccttcgcctccagtgccacgtgctgttcatctcatccgtgaccatgcactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccacccgggactaaagatgatctttagttcccggttcaaatgctgtcagggtctgtcaggccctcccggtatctttagtcccggttgataacaccaacggggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgatagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaagggccctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacacatctgctttgtcaccttgtgaaagagatccgtattctcgggcctatgtacctacacaacatgtttcctttcgagaggta

SEQ ID NO: 74379 - DNA, 15187 bp, Oryza sativa
gacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcactgactcctcctcgtgctcctacacctactcccccgcaagctcctcttccggcaccttcaaagtcaagggcccccccagctgcaccgcctgcccacacaagggcaacgaagaaggcgaaagttgacgccgacaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgccaaggaggccatcaagctatcgaactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaaattccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtaaaatggagattcaaagggcccgacggcggagggttttcgatactggattcatcgaccctcggagagtaaacgtcgcattgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatatctatatacatatgcattaatttgcataacatatatatgtgtataaatacatatatattatgcatgtatatacatataatataatataatatatatatatatacatatatatatatgtatgcatatatatgtattgaaacatatatatgcatggtttatatatatatatatatatatatatatatatataaactatatatatatataaaccatgcagcaacagggccatgcaaaaaaaaatggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgatgatgtccctctgctcctacttccccatctacctcgacaacaaggatgcccaggccgacgtcggcgacgtcgacgtccccggtgttcgtcacctgcagaggtcctggctgccgcagccgctgctcgacctggacatgctcttcacgaagcagttcatcgagaacggccgcgaggtggtcaagaccgacggcgttctgatcaacacgttcgacgcgctggagccggtggcgctcgccgccctgcgggacggcaccgtcgtccgcgggttcccgccggtgttcgccgtcggcccgtacagctcgctcgcgagcgagaagaaggccgccgacgcagatcagagctcggcgctcgcctggctcgaccagcagccggcgcggtcagtggtgtacgtcgccttcggcaaccgttgcaccgtgagcaacgaccagctccgagagatcgcggcggggctggaggcgagcggctgccgattcctgtggatcctcaagaccacggtggtggaccgcgacgaggccgccgcgggcggcgtccgcgacgtgctcggcgacgggttcatggagcgcgtgaaggggcgcggcatggtgaccaaggaatgggtggaccaggaggcggtgctcgggcacccggcggtgggcctgttcctgagccacagcgggtggaactcggtgaccgaggcggcggcggccggcgtgccgctgctggcgtggccgcggggcggcgaccaccgcgtggcggcgacggtggtggcgagcagcggcgtcggggtgtggatggagcagtggagctgggacggggaggagtggttggtgagcggggaggagataggggggaaggtgaaggagatgatggccgacgacgccgtgcgggagagggcggccaaggtcggcgaggaggcggccaaggccgtcgcggagggcggcacgagccacacgagcatgctggagtttgttgcaaagctcaaggctgcttaattaattacaatgcatctaaagatagtacaagtactatagtactacaagctcgtagtacaaaataaaagcgtgcatgcatgcaggctgagtcgttgggtcttgatgagtgggtgcacgttcgtgtgtcgtgtctgtatactccgtgtcacgtgaagttggttgattctcactccctttgttcgaaaacaaatcaatctactacgacatataataaaccaacattggctgccatggatatatggatgaagttagagcttattatacctccgtcacagaatatatagacttttatttttacataatacaattattatattaagacagtagataaaatgaaataagaaaaaggttgtgattgaatgaaaagtgaagataggtaaaagaatttactaatggagggttgtgattagttgggaagagaatattggtagagaagttgtattttaggattgagagaatagattttgtgtcatgtgtactttttttttaagtttttctatatattttcaacaatttgttttctaaaaatttaacagatgtaacatgatgtaactacattgtaacttgcatataactataatttaacttccgcgtagttttgaaccgttagattttgttgcacaatgtgagaggatggaaaaaatcacagcgcacacatgtgaacacatgtgagaggatttactctcactttcatggaaatagcatgcaacaaagggactttttttttaaattgtgtaaaagtcacgtttgtaaatacatcatgattgtactacaatcacaaatgtataggcggtctcaattttttgggaaaaaacgaaccatttagcagtttagaaaatgtactaacagaaaacaagaaagttgtactccctccatccacaaaagttacacctattacttttgtcaccaagactaatgtcacgcccggaatttctatccaaaattccaaacgcttaaatgtgtgtgaaccctcgtccaggaatcagccgaggcacacaataacaaattgataatagagtacaattattactctaattaataagcgaataaaatgtcattacagaggtagatagttcctctcaatcaataaggatctaagcagcggaaaataaataaacggcgcagacggctctactccacaggcagcttgaccaaagctacacctattcctccactccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccacaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaactaatcacgatcgaccatcgtgaactatcattaagccatcatgaaataatagtgaatcattagttatcccataaatgtgctaatgtttctaagcagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagagggtttattgcgtcagcgggctagggtttggtggaccgggcgcacgggcggcggttcacacgaacggacggccgagatcgaaccaatccaaaatggacggccgagatcgatcgggtccacggcggctcacggcggacgaccccgatgacgtcagcggtgacatcaccgacagcggcggcggctcggtggaggagacggctcgaacggcgcacgctcgccggcgaacggcggcgcgaggacgcaaacggagggcaccaagatgaagcgggcggcacggcgaactcaccggcgaccaaaacgacggcggaaggtcaacggacggcgacggcgacgaggaggaagcggcgaagctcttcggcttgacgacggcgacgaagctccgacgatctctggcgacggcgaaggggcggacgaggacggcgacgacttggcgagcacgacggtggtcttcccgagcgacggcgacggctgaaacgacggcggcgcacggctggagcgacggcggcgacggcaaagctagggcacacggcgctagggcttttccgacgacgagaggcgaaggcgaaggtggcgacgggtagaggagacaccgggggtccttttaaaggggctcagaggcggcggcgaaggcccatggcggcggcaacggcgaaggaaagctcggcttggagagagggaaaccgatccgaaacgaactcgattccacgaacttccaaaacgatttagccaaagattccaaaggagaaaaggtagaggagatcccggagattgtttcgcctcaaacaattcggccggagaaggaaaggaacggccggatttggaaaggaacggcggcggcggcgcgctagggtttcgggcggcggcggccgaaggtagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaattccatttattaaaaatacttccttagctcaaataaatcccagaaaaatctaggaattatagaattaagccaagtatttaatgaaattttatctggccccattttatattggaatttattaattaaaattagattttcttttcaagacttttaaaattatttctaaaaattccaattaaacaacaatttatatattttgaattttcagggtgtgacaaacctaccccccttaaacagaatctcgtcctcgagattcggaagaactggcaaataggtgcggatgagctgacttcaattcatcttctcgttcccaagttgattcttcttccgagtgattactccattggagtttgcaaaaacggataactcgattcctggttcttctctcatttgtttccaagatacggattggtttctcaacataagtcaaatcctcttggacttctatctgttcaagattagcttcttcggtaggtactcttaaacacttcttcaattgcgacacatggaacacattatggactcctgccaaagattgaggtaattctaactgataagcaacctctcctcttctactgacaatcttataaggtcccacataacgcggtgccaattttcctttggtgtgaaaacgatgaactcctcgaagaggcgtgacacgaagatacacataatctccttcttcaaaactcaaatctctacggcgattgtcggcataactcttatgtcgagactgagccactcgcaatctttcttgaatgacctttaccttttcttctgcttcccttaggatatccgtcccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatgtacaattccgccaagcgacttccggaataggttgtctttaccggaataaaatgagccactttggtaagtctgtcgactatcacccaaatagagtcatggcctgatgacgttctgggtaaaccagtaataaaatccatacctatttcttcccatttccattcaggaatcttcaatggctgcaacaaaccggcgggtttctgatgttctgccttgactcgctgacaaacatcacatactgctacatattccgcgatttcacgcttcatacttgcccaccaaaatctttccttgagatcctggtacatcttagtactaccagggtgaatggagtataaagtatcatgagcttctttcagaactgcatcttttagatctttgttgtcggggacacaaattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcgcaatacacttgaaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttagaaaaattctctataaacctccgataatatcctgcgaggcctaggaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctccaatgcaaggcgaagatgttcctcatgctcttctttggtccgagagtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcatggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattgtgaactctatatcccttttaggcggcataccaggtaaatcatctgggaacacatcgggatactcccggactataggaatctcttccaaagttatttggttcagtcttgaccttaaagactcagatgacaatgcatgaacagttacaactcgaccatcatagctggtgagagttacttttttgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggcagggacaaccttcacgcgtcggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaaatgacgctgcggacgaacaacagacgaagaacctccctgtggcatgggctggggtcctaaagtaagacgcggcttctgattattcccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactactcctgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatgggcagggcacaagaagagaaaccggggaaactacttaggacagagaattactttaacttttattgatcttaactgagtttcattattacaaactaaagactcacacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcctgagttgctacccactcaatcttggaattgttgcgcttggattcttcttcttcatcactacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagcggctaacacagtctccgcacgactttcatccatagcccacaacatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggaggtagttaagacctttatccaattaatagcacaagtttttggattaatttgaataaagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaatcaacatgctaaatttattttattgcagcaagattaaataaaacagtattgtaaaacttttgctggtaaatgagccattagtacagtaatagatgtacagtactaataacactggaataaatttttaatgagaaccattaaaagagattatgaagtgcatgtgccattagtttggtttaattaaaagagaaagggaggagaccagttctacttttccaatatttttagagggcttctatggataaccatttggcataacctagggtcaacctggctctgataccaacttgtcacgcccggaatttctatccaaaattccaaacgcttaaatgtgtgtgaaccctcgtccaggaatcagccgaggcacacaataacaaattgataatagagtacaattattactctaattaataagcgaataaaatgtcattacagaggtagatagttcctctcaatcaataaggatctaagcagcggaaaataaataaacggcgcagacggctccactccacaggcagcttgaccaaagctacacctattcctccactccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaatgatgagaggtgtgagactaatcacgaaagacattgttagacccgcccataaccgcgggcacggctattcgaa

SEQ ID NO: 74380 - DNA, 1569 bp, Oryza sativa
atgatgacgcccatggttgtgttgtatatatacagattttagtatacaaatatgtatgtgttggcaaacattaatgttctacatattgcatatatgtgtcctggttttgcaagaatatttttcatgccaattaatctctggccgatctctaattgatacaaatacagccttcactaacataacatgttggttgatttcagtaaaaccatatggaacagaactacagttacagaaacagaaaccagagactatcttagttgtaccagagtcacaaatgattctatgaggacttcatagaggtagagtgtgcgtgtgtattcataggaatgagtgtgagcgcattgtgagcgcctgtgtttgtattttacttataaaaaaaattgctccaaaatgcatatacattttatgttaatatacttggtgagctttgccacaagagcacttaagcatcactttttttcctgggttccttggtgaatttcagacctagttaaaaaaaaatctctctctctgatcccacataaaaacatgtgttaagattcgacctatatagggtgagtcctcgtgttggaagcaagggcctcaaagtaacggttaagaattgatccataggtggtgagtccgggtgttgaggcttattcttaatgaaaaaccatggggacgtccattctcgcgtcggtcaagtgtttttttttaatcacagtagttatagtcgtctgaaaggaaagagttaaaatatacttcctccgtctcaaaataagtgcaacttggtaccgtgcatgtttaacgtttgactgttcgtcttatttgaaatttttttatgattagtatttttattgttattaaatgataaaacatgaatagtactttatgtgtgattaattctttttaattttttcataaaattttaaataaaacggatagtcaaacatcggacatgggtacccatggctacacttattttgggacagaggtagtagaatatttagtgggccaacattgggctgttaatttcttcatggagagagtgcgcacaatatcttcccatgggctgccttacatatgtactgagccataggggcctctggccctctggttcccgataatttcatgtaattccaagttttggtcaatacagtgtttgcttttcaatcttcttagcgcatgttttttttaaagaaactcttagcccatgctggtctgggccttttgtgtgagcttattataagatagaaggcccaagcccaacagttatgcgtgccaaaatgcaagtccgtgacatgcaaatgtcagatgctgtcgactacctctacaaatgtatgtcattttagagttatgtacatgaataaagtggttaaaatgatatgtaggtattgcatattggaaataatacatatcatttatacatgaggtgacgagggtggtaacaccatctagtccactgatgctcattcccccatgagaaactgataagctgtgatggcataagtgtttatgttgtaatgcattgtctatctattttgtgcacaaattttgacagtttgaccctttgcaaaaactatttttaca

SEQ ID NO: 74381 - DNA, 1725 bp, Oryza sativa
cagccagtgcattaattatgctaccgctttaacacaaacctttattatcattacatatatacaactgcaaacttgtgcttttctgtttattatcatctgatatgtttgagtggttctatgctcgcagtctccaactagaattgtatgcatcttaaagcacctgaaggggtaagtaatacccatccacccttgaatcatgccttagatttggcaaatttgttccagccactagtcttctctataggacaatgctattttgtgactatttgctgcaagacaaatttcagtattccctctgttctgtaatgtaagatattttggttttgtcctgagttaaacttattcaagtttgaccaaatttatagaaaaatgtagctacatctacaacaccaaattcaaatttgaccataactaaatatatttttataatatatttgtttggtgttggaaatattgctatgtttctttataaactttggtcaagcttaaataaatttgacttcggacaaaaccaaaacatcttacaatatgaaatggagggtgtacatatgatatatcatttgttgtcactagaggagagttaattagggtggagtgaccagtgtgccctttggtgcatttcaaaaatattgctggacatgaatttgaaatatcaatcttaattcacaatcatgctaaatggtgcgcagagtagcaagcatccgagtgcctccttccctctgtttcctcgtttttcctttcttcccgtcctttactcattacatccgcttttctagttttttctgttcctcacctcctccccacatttcacattacactccagagtaaaggatttactcatccactcatctcctgtcctttcaaccatccactcatctcctgtcctttcatctttgtcctaagtaaaggatttactcattgactatctactaatctcattgtccagcttcataactaattaatcctgtgtaaagaatttacttatcgatcatctggttcataagtaattcatctttgctaaagatttacttttatttactcattgaccaataatacagctaggttcatctcccattcatcttagagttctttgctcatggactgctttccggttctcttcatagagtaaaaatattactaccgctcatattagtctcttccataatgtttaacagtcaatctactcccacatatttgttttttcccgttttgccctacttttggttttgtcctgcttttgtgagtggaaatgatatcagtagaaaacttataaaattgtatgaacataaaacaattacacaactcacacacaaagaattacacattagtcttgaacaacgaaaaaaaagaaaaaaattcagttgatgactgacgatgagacgagagcaccacggcggatggaagggctccctagagctgatgcagatgatgcatgatggaggggctgaagaggatgggcatctccttcaatgtcggtgtgggcgcccctcccagcaaagaagcactaaggcggatccacatccgccatgaccgtgagaggtaggaatgacaacaaccgagattcggtcgcaacaccagtagacagatggcgccaaatctagccgcttccatccttgaggccaccggatttgatcagctgcttcctagttcccattgtccaccgtgagtggcaggcatggagcatgctttgagctaacacctcactttgttgcttgtccgccgcct

SEQ ID NO: 74382 - DNA, 4194 bp, Oryza sativa
  unsure (1)..(4194): unsure at all n locations
ttcataatcctgataaattcattttagagagaacagcaaattggtcctgtgagtttcccccctgggggtcactttgttttttagcattcaaattggcataaagcgccaaatgggcaaagccaacgaagaaaatggctactattggtgaaaaaatacaacacaatgaaagaaaaagggaagagaattgattggatcatcccattatgcccttgtatctttgtgggccattgcagtgggcgcccgatatgatattatattagtgtcataaggtttgccatctgttgagttggttttacacgcatggtgttttacctctcaaggatcattttgaactaatggacaaatgggcaaactttgagggctctgatgaaatcaattatcaaaggctagttattctggagtcatacttgagggaccaaattggatattatgtttcctttanggagaaagaagttagattggcaaaatgatcatttctgttctttcaaacacaaaaaaagaaaagatattcatgaacacttcaatcttcctctcagtaggaactgattttttattttcttaaggtcacatggcaaatggttacagaatggcaaccttctatgccaaaagttggcattggtagtgtgaaagaggatgaaatttttgccttttaaattattgcaaatcattgagggtggaacactgaggcagcctcttattaagtatttgagctaactcattctgtggatatggcttttattagtttatataaaacttacagtaagacatgtactagtagagaatcagtatgacgcatatctgttgttccttttttctttagatagtccttcactttcagttattgagaaaagcaaagctagttctgttatgatttgacagtttgtgctggcaaaattaataagtggccctgatgttagttagtagtattgaagctttcatttgttttgctattatgttagcagatattaataccggcaaggtgcaactgtaaagttatcatacaatggaaatatatttttgtccttccattgctgcagctatcatttctttaggattaaatttcagaaaactgcaattatttggtcgagactatcactttgctacaactttaaccggctattttataaattgcaactttagcagtggattttatcaaataactgcaattttcccatatgtgtatgacatgtgggcccaacttattactacatgaatatttcatttgtgtatggaagacatataaagttgtagctttctgataaaattatacactattgttgcaattctctgaaatgcgcagttaaagttgtagcaaatgatatgtgctttgctgtaatttactttcttttaggaagttttgtttttgcatttacatgaatatgtttcttgcctttttattgcaggagttgattgagaaacttagcaagggtgagctaccaaaagatgagtatcactatttgaatgaccctagtcctagtttccggggaattccaagtgcatctacccaaacaagcccagctcaccagccagctcaatccatgagatctaaaggacaggtggcacatgggccaggcctcgagactctgatgatgggtattcaaggtttgtgacctcatacccccatttctactattataaaaattgaagatgtttttgtcggtattttggtacgtcatccgtgtatgagtctgtttttaaattcgtttgcttttggaaatacatatccgtatttgagtcggtttttaagatcgttcacttttgctaatacagaaggaatcatataagaaatctgtttaaaaaaactcacatgctaacttgagacgatcggactcctaactgccgctcataattttctaaaaaaatatatatccaagcgaactcccacagtaaatttcatcttaaccatataacagtaataagattaaaatagatttcacccgttgcaacgcacggacatttttctagtctatttaaaaatttgagttcataaaatattgcccaagctgccgcacaattaccactggtcactatcaatttcggatttagttttatatgtcaaatatcaatgcaattaatgcaattactgcttagttgtcttattgagtagttctttacctttaagaaagctgtattttggccatgaaactgtcacatttgctgcaaattcctttcgcttttgtatgaactttttatgaaccttttgtgtggatcgtgaaagctcctccatttagaccacgtgcattttacaataagctatcgcatattatagtcatggaagtgcatttgcaataatgggttatgataataatgataataccacttttctcatgactaataagccttttgcagtgactcggtactgaagcacacatcaagtaatagcagaaagttgggtcagcgattatttgtttttgttattggtggtgctactcgatctgaggtatcttctcaagcatctgaatttcctttcttctttcacctgtaatgctttctgattcgaatatggtgtaaaactaagaaaggatctaattctcacattctcaatctgtaccattatatgccaatggctattacagttatgtgctgctcacaagctatcatcaaaactgaagagagaaattatccttggctcctctagtcttgatgatccaccccagttcatcactgtaagtttcttgttcatgtctcctctccaatatgcttgttgtaccaagaacttgttaacatgttattatttgcagaaattaaaaatgttatcaaccgatgatttgacacttgacgatctacagatataacaatatacaaaggcctctttcttgactttctcttttataatcatttgctgatcttttttctattatagaactctatgagtgcgcatataacgttgtgtcgaaaagtttacacaggttcccattaaactacaggcttacagcctagtgtgcctataatatagcagtgtgccagaaactgtattatgagattggtggacaatatgttcgttatcgtgtacttcactaatttctttcttcttttggacgcgaataattattctgaattggttttactagtaaaagttgtgatgaagtggtgagcaaaggttgctacttcctttgtttcacatggatctatgtatttgttccatacatatgtccaaatttatattgatgttagtgaatctggatgagtaatgaaggggctaggagtctatggaaaagacgagcgaggaagagctcgtagtccccgactccatggacgcggccggtgaggaagtgctcgtggtcaccaactccatggatgatgaggtccgcgaggaggtgcacgtgaccgttgactatatagacgatgaggccagcgaggaagggcatgtggttgtcgtggccggcgaggtggccggcgaggaagtgcacgtggttgccgactctatggacgtcgcggccggcaaggaagtgcacggagttgctgaccccatggacgacgaggccggagaggaagtgctcgtggtcgccggctccatggacgaaaatgaggagtgtcctggcaccggcgacaccaacattgaggtggttgaagttgaacaaaaaaagttgcattctgatcactaattgatgagattaaaacagaagagattctaccttttttattttgcaaaagaggagtgtgtcgccgctggtgctggtgacaacaacgatgaggagattgaagaacaggacttgcataagcaaaaggtgcattgttgaagcttcttctacctacttattttccaaaagaaaagaaatgaatcgacttacatattcatgcatgtcatagattctaattgctctattgttctgaatttttgaaaaactaattttacaaatagatccctagaaaaacttatcctagaaatagtcctttttggggcgtcagagtctctggcgccgtcccctgcatcatagagtatattgcatcttgagccaccttttcttaccaatgttgcaacttagacagggtaaattaatcttttcactttgggccgggtatatttacaaaatgtttcaatttgagctctcttcttcctccagctccatttctcccatctctgctgcgtacggctcaaaatctcttctcaatcaggagcagcgcacgcagaagattagtgcaagccatcccagcgcagccgcccatcaaagctgagctcaagctcaagtgtag

SEQ ID NO: 74383 - DNA, 2402 bp, Oryza sativa
ttgtgtgccaaaactcttaggcatatattagttgttgctttggcagactctaagccaactgctctaagatatgctatgatctaaatcagatcatcttgaaacatgtggtgtctgtgtgtgtattttgtgtgtcaaaactatgtggagtgttatcatttgaactgagtgacatttgataatttgatttgagctatgtttcaatttgctgaaattatgtggcttgtactgatctgatctgagatggcatgtaaaaatgttgaagttatgtgcattgtgatgatctgagctgatattatgtttgtgaatttgtatgatctgatatgttgacctgatctaagctgaaatttcaaaatgttctatttggtatcttatgtttgtgagctatatcatgtttgtaatatgaaaatattgtgcaatgtgcaatgtgagctatcttcatcgaaattcactggaattactgaaatttcagacagccatagctgcattcactcaaattccagacaaccatattgcatcttagatgtattcattgataattcagaatattacagctcagttgttgtacacatcaagttattaactaacacctaacacaaatggcagcaataggactagaacaaccaccattgtgacctaattggtgctaacatagtgcacctcatgcgaaagggactatagcctagtggttacaagagcctcaatagcaccttaggtcctgggttcgattccccatgagagcgaatgttctaggatttaacggcattgtgcttcagtggtgggcgatgtactgtcgacagtgaggcgcttgtagtgatttcgtcaatctcaaggatttgccggcccagtctttgaagatgctcataggggtagggtttgcgtgcatgcgttcacaggggtgagtgtctgcgttgtactatgtaattaaaaaaaacatattgcacctcacgtctgaactagtaacacaaccaacatcacaaacacacatgccagcaataacattacaagcacaaatctctgtttctctatcctactgttaattgccctcatagcagccatttttgcatcattctccgatgccacaagcctcaaatttgccacttgatttattgctgcactcagctctgtgcactgctcttcttcctttggcctcagttcttcaacagcacgctctaactcagccttctcccttcttagcgacaacacggcttcaggaagatcattcaacaactccctcaaaaagctgcttgttgggggtcataccacccaaaaagattgcaaccggcgccctgaaaacttgacatacaaaatcacccaaccaatgtgctaggtccaacaaaaaaaaaacaatcaaaacaaatcgcaaacactcaactgattgttgcatctgtagtaccaccggcctgggttgtccatgctccaggagatccactgcgccgcttttgcaccacaccggcacatcaccgctggctgataatcgaattgcccaactcacagcggattgggagcacgattggtgggatgtgacgaacccgacgatcgtttactacaagacctcgccatcgcctagctataactccaattctcgccgccgccactgccctaagctagggtttgagctgagagggagaaggggaaaatgtcgtgccaagataaccccgtctattaacgcctcaacggcgccctgacatgtagggcccacagtgcaccacgtcagcaaaatcgggcaaaaaatgagtcgatattgccatgggacctcctttgaacggtttgtgcgagtttaggggtacacatatctgattttgtggttaagggacctaaaaatattcgacgttaagttgagggacctccggtgaacttgttagcttttcaatcttctgagcccatgttttttttaagaaattcttaacccatgttggtctgggccttttgtgtgagcttattataagatagaaagcccaagcccaacagttatgcgtgccaaaatgcaagtccgggacatatgcaaatgtcagatgctgtcgactacctctccaaatgaatgtcattttagagttatgtacatgaataaagtggttaaaatgatatgtaggtattgcatattggaaataatacatatcatttatacatgaggtgatgagggtggtaacatttataattaataagggcaaattaagaaaaggtgggagacaaatgctttgaagttccataacaacctatatttagagaagaggaaaaaaaacataaaaaaacctacatttgaaaaggggtagacaggaggccctaccaatctccttgttatttcaactttttcttcagattatttgctccatgctttaaaaaaaatgctttctcaaaaaattttattctactgtatacttaaaatatttaatttatccttacaa

SEQ ID NO: 74384 - DNA, 1992 bp, Oryza sativa
agaaacaagacccaaagtgaaaagtttggtttacacctagtcaagttgtaactacggtaataaagacaggcccaagatgcaatttactctaatatctctgtattcctataaaccctttagttttttaaactagtactgcttagttagggtttgttgagttttttttttttggttacattcgagtgtcattccttaatataggcagaactttcttatacggacttggaatcaggtaaattatatatccatggacatctacagaaaaagctacatccaattctccccatcttcgcttggttcagtgaatttagaatctccaaattccgtttgcaagattatgttttagagacaagaagcttttcaatatagctttgaaaaattctacgtcacatattttgtccgtttgagcttaaattttatattgttggttcttgtgtgctctttaagtgtgaaaaaatataaaaaaacaaaaataaaaaagttacacatctctcctctatactagagaggaaggaagaaagtggtgtgtgggaagaggggctggcaccaacatcattggcatgctccctttgccacgtcagcgttggcccgccatgatggcaaggggatggtgccagagatgctggcgccgtcccattagaccacggcgccagcgactttggcgtctcaaaaaagaccatttctgaaataagtttacctcttgcttgtgaatcatattccataggaccaaataaaataactttacatgctcctcactgatgttcctttcctatcaaagccatatgtcgagcttaaagataaaaccttatacatatgctccttgctatcattttgagttttctcaaatggttgtgacccttgttagattcttttcatattctcattatccaaatcttgtgcacttaaataccaaatatattgctctccctctgcactagaggattagtaaaatattccacccacccaccatatggtatgcttctatgctggaagtcagcatccaccctatccatccaccaaataaagactccatacatatagtctctgatgaaccctgagttccactcaagaaactcaaggctaggattggtctgatctttcgatgagttgtagatattttattacgcctacaaagatgtttccaatcagaaaaatcatttttaattagaactctagtagcacacataaccatatgtttctcagacaagtcatgcttttgaaattctctatcaaccgctagctcccaaataatgtaagcatgaggatcataatttccctcgaaataaggcagtgcggatttgatcttacctagaacatcgccacttacctcataatggtcatgttgatcactcctcatgtctcgacgaagatgtcgatgttgagcacagttatccccaattatcttgcgtatctctgccattgttagtagaaaacaagaaacatacacaaaatatgcatgttcctattaactactaggtagtggaggctccaatgtgacacgcactcaagcctttaaccaagctcttacaagttcttaccaatgcaagctggatggtgacgtacaccgactcaaccaaacaccccaattgaggttggatatatcgatgccttggcaaacacttgctgtacggctgcaatcaaatccgtggagttttgggtaggcttaaatatttagcatagggatagcaaatgcttaaatcagagaatgcaaagttgaatgatcgttcaaagtcaagtaccgtgctggtcctaggctagaacgtactagagacgcgagcctagatacaaatgataccacaagatagcaccagaaacaactcaaacacactctaatatatggaagcaaactcaaagatacaactgattttgctcttttccttctttcttttctttttctttcttttttttgggtgcggcttttcttttcttctcttttatgcacctttttgcctttctttctctcttttttttgatttttttaccaaaaacaaa

SEQ ID NO: 74385 - DNA, 1095 bp, Oryza sativa
  unsure (1)..(1095): unsure at all n locations
aatttccattttggtgttaagaggcatcatgtggtaactagatcctgttatttccttttttattttttttaaaacgttatgtatcttttatctggtagcaattggccctaattctctcattctctcattcgcagaagcctttgtttgaaaggctatacactgcaaccatttgtaatagaatgcggatccatgtttttcatctatagaaaatccaagctagccattctccattgccttcataatatctactgtccagaagataaagttttagatcagtagtcagagactcttagcagagacctgaaaaatatttttgaatttttttaagttatgttaacttctttgtgttcctaggatctacttctgagtattgatatgaatctccttttagtgtcaaagtgcttaaatattgatttgtttcttaatatttctttttttttatcttcattcatctgaatggcaacaggaagtatggctttaatggatgctggaatacctgtaagggaacatgtggctggtgtttctgttggtcttgtcagtgaagtggaccagacaactggagatatttctagttatcgcatattaacggatattttagtaagtatagttgcataccatttctaccatcaatccttataaataactattcctttttcatccaactgtatattttggttggtgctgaactgaacatggccattgatgtttcccagggtcttgagnnnnnnnnnnnnnnnnnnnnnnnnnnnnnnnnnnnaacaaggagaggtattactgctattcaactggatataaaacctgctggaataccgttggacataatatgtgaaagtttggaacctgcacgaaaggctcgaaatcaaatccttgaccgtatggaccaggaaataagttctgcacgtgcttttaatgatgggagctctcctcgattaggtttgttagtgcacttatagtttagttcttttaaggagttcttttttggtgcaaacattgcttgatcaacaccagaattgcccttcatttgcagctacactgagcttcagcagtgattctcttaagaaactgctttttcacaggaaaaaaattgagcaagaa

SEQ ID NO: 74386 - DNA, 585 bp, Oryza sativa
cccgatagcttaggagatgactttgcaacctttgggcgtttcttcttaggatcatttgtaacatcttgcgcatcacattcagcagcacttcgaattataactgcaggagtagaacacccaggtgtctcctcaatcatgttgtcttcgtctttgctgatggatggttcagcattagcatccttgctaggcatgttctctacagccgtccagccaacaacttcttgacttggcaaaggatcagtatgattacttgctaaatccttcttttcatgggcatggggcagggtagctttaagagaaagtttaatgttacccctcaagtcctgtccaatgcatgtcaatgagagcacttggccaacagatacaacatccgagaccttagacacctgcaggtagaagggaaaataaaatgagcactaaatacatatatattaaatacaactgattaaaagctggttaatcaacattttaaccagtatgaatgcaatgaactaatggatcacttatactgtgaaacgtgattgaacctcttcttgttgctcaagtgtgtttgggtagaacaatagtcttatatccatgggtgac

SEQ ID NO: 74387 - DNA, 17495 bp, Oryza sativa
tttaaaggggttcagaggcggcggcgaaggcccaatgcggcggcaacggggaaggaaagcttggcttgaaaagagggaaaccgattccgaaacgaattgatttccacgaacttccaaaacgatttagccaaagattccaaaggagaaaaggtagaggagatcccggagattgttttccctcaaacaattcggccggagaaggaaaggaacggccggatttggaaaggaacggcggcggcggcgcgctagggtttcgggcggcggcggacgaaggtagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaatttcatttattaaaaatacttccttagctcaaataaatcccagaaaaatctaggaattatagaattaagccaagtatttaatgaaattttatctggccccattttatattggaatttattaattaaaattagattttcttttcaagacttttaaaattatttctaaaaattccaattaaacaacaatttatatattttgaattttcagggtgtgacaactaaggagaaattaaatcatcttggatgttataaaatcaagtagtgaatgcaagcatgcaaccaacgagtatttagatgactcattgggttctaatcaaacatttaatttatctcatcatttaagtcatgaatgcataaagaccacaaataggaacaacttatttggaagaactcaaatgtgaaatatgtctaacttttatggatagagggagtaatttggagttagaggatagaaagtatgggtgtatctaccccggaccaaccaaaaaatttcctaacctaagacccatgtagaaaaatatagtaagaaagaactcatgtaatgtgaagcgcgaagttgaagtgtggtcgtctcgatgtcatgtcgtgttctttttttagcttcctcactatatcgtgttgtcatagcagtagtcatcatgccagatggcaactatgagtccgagacagggccagggaaacaaactagcacggcaaggatgcattgcgatgtcattgcaccagtcatcacgccagacgaaaactagaagtccgagatggaggcagcaaactggcacggcaaggatgggaggttatcaagtagtcaagccgacatgtcagcaaaccggaaagggcaaacgtcgtgacacggcgtccacgcctctgtggcagccagcagatagcaatgtcacaagggcgaccagggccatgccgtcaaatttgtaggccctgtacaagactctaagtgagacataaatcaagtaccaaatatagctaaaataatatatatactgcagagcaaatgcgatatatcatgaatagtatattttttaactcctgttttgtataattagaaactgtcaaactgaaaacggagaatgttcgttgttgttgctagcttgctgcctagcgccttgcttgttggttgcttgctaagttgctattcgctggttgaatgaaaatgtgaaattggatgagccggctagcagcctggtgctcggaggagacgagacgtcgaaactcgagatgaattgaataagttacagatatgaaaacgaaagagaatacaaaacgccgtggggcctcggggcttggggttgagaatacgaagcgccacgcacgcgaagtcgccgcgcggagatacgcgcggactcgaacagggttctggcgctctggcctcacacgaatacatgggccttcttcggttgggctaattttttgaggccctgtaaatttggaggccatgtacggtcgcacgggccacacgcccctgtgcacggccctgagagcgacgaacatcggtaaatttgacaacccaaacctcaaattatagatgcgccaccgatataaaggggcctagtcccaaactatatataaggcctatattttgttcatacagttattaatgatatgttttgaccattgacttattccatgttttgtttccaacgaatatgaaattagcatcgcataaaactattttaaaatatgaatctagtgatataacatgtataatatttagcataaatatgattagcatgattattatttaaaagtaaccgagtttgaattttcttaaaatgagaacgaaggggctacaaaacttgctgcatactccctccatcccataatataagggattattctcttttgggaaagattaaggatgaaaataaaagactacaatacccctactagatgtgattttagttgtggtgattggatagttggaggttaaaatagatagaaatttgaattagaattgatagatgtgacaagtaatatagcaaaattttttatattatggaactaatagaaaagataaaatatcttatattataaaacggagggagtatgctacatcacgtcatcactcctcatcactcagccgattgtgagcgagttccacgtagttggtctcgcccttctctaattaatcacaggtgcctctctgttttcctatctccaatcaatggctgtgtttagttcacgtcaaagttgaaagtttgattgaaaattggaacgatgtgattgaaaatttgtgtgtgtaggacagattgatgtgattgaaaaagttaaaagtttggaaaaaaaactttggaactaaacaaagccaatacatcatcatgccagtgacaaatcaaataggcacattaatgtcacgactcccaacctgctcattaaaccatctatctgtcccgactggtcatgtctcgattcgaaccaaaatgccagacatccatagttccacgttgcatcgcgcttacgctatgtatattgcatactctagggagtagggagtagttatacaacatatggtaatgtttttaaaaaacatttatgtataactataatataatcagattacaacattttgataatgttttttactataacatagtagttacaatttatatacaactcatatataacatagaaaaaacatgtatgcgacaagttgagtagtacgcattgagtttgtgtcgaggtttgcaataccgccggtcagggaaagatgcaatgtaattcatgggtattcaaaacgcgaattttagggaagaatctaatatcaaataatttgaagaagtgagacttcgaacccatatcatctagcccaccaccttatggagctagccgaaagacccctaagcgtttctctaattcattggtattcagctgaataaccatgaattctagacacaaatctaatacttattgcccataatgcatatgcacaaccataatctagctagatctatgatactatttatatctaacaatttaattccacccctttctagttgtccccagcccacaaaatcagtaagcccgttcctttctttgcaattaatgctgattgaattatcttcttcacatatcggctttcacagttaatgagcaattagttaagacatagttatctctctaagtttatatgcatctagtatatattagcaacagagcttagttgcagcttcacccacccaattgttttttttctatattttgctatgtaattgatgtccattttcatgtatgatgaagttatattcaacggccaatttcatatttgccactagttgaccaggtattgcgaacctgtcattaagggtgcgtttggttgcaaggatggggtgggatgggatggaacgaacccacttttggggttgtttggttgaggggtgagtgggatgggttggtccctggagaggaatattcctctcagatctaggaccaaccgatccgggaaattctggcggacgaactcgtcccagttgggacgagcgaacggcgtgacgacgccttgcttgtgcactcgccctgctcgagctcggggccggcctgcacgctcaccatactcgccatcaggagcagcggtagacaccggcgggctcggcgatgtcgacggcgaccgcgggcgagctcggcgacgatggtggccgtggtgggctcgacgacggcggcaaccacggggggctcggctcgacggccgcgggggctcggcgacggcgaccgcgggaggctcgacgacggcgaccgcggggggctcgacgacgacgaccacgaccgcggccacgggtgctcggcgacggcaaccacggggggctcggctaggcgaccgcggggggctcggcaatggcgactgcgggaggctcaacaacggcgaccgcgggggggctagatgacggcgaccacggggggctcgatgacggtggccacgggggctcggtgacggcgaccgctgggggctcggctcggtgaccgcggggggctggacgacggcgaccgcagggggctcagcgacggcgacggcggatccagtggtggggagggcggtggaggtggatccgcatcctctgcctgctcgccgccggcatgctccttcgcccacccaacacagtgatagcaaacggctgacggtgatagcaaacggcgcccatcccatttctacctcattccttcaaccaaacaaaagaattgggattgtcccatcctacaaaccaaacaagtaaatggaatcatcccaactaaatcaggaatggtttcatcccatcccacctagtcccaaaaccaaacacatgctaagaaaatgctattacatacttgccataaaaacggttggagcccaacatatctgccaccaaaaaggttggaatccaacatatctgccattagattctaaggcttgaaataacaccgttaggagttgagttctcatccaaatcaggacaaggatgtccctgcccacgaaattgcaggattaacgttctttggcatcaatatacaagaaaaatatcaacatgatagcaacaagaatacagtcaattatcaatgctgctagctgtcgctacctcccaagccacgtgctgttgctgtcgccaaaacctataaatgcgtctttagtactggttgataacatcaactcgtgctaaatatacttttagtactgataccttcagagttagttcataagaaaaacatctctattcaagttagatatgtggagtaggtgggatgataatgcgcgtgaaaactgaggtgagaaatcttgagtttgaacctcacattcccaatttttttttacttagtatgcatctttagtaccgattccttcaaccggtacttaaaaatcaagaactttcgtcttagtttacttgtctcatttactacaaccggtacgaaagaggatttagaaccggcactaaagatcatttttttactagtgtgtcgatctcacaaaaatcgatctccatgagttctctcattgccgtctctagatctaagttcattacaacctttttttaagttgatttactctttgatttgaaatggatcagagaatttgggaatttaggattgctgcaaggagaggggaggggatcggttcttgcttcgtatgcagtaagtcgggagagaggggcagggaggagataattttagtcaagggcaaatcagtcttattatgttgccttgtttcttcgcttagttttatgaagtaatttttgttcttttagttacactagtttaaatggtaatggcaaagagaagcacctcaaaccaacttcagtggcaaatttacaattcgtgttttttttaatgtttgtacagagttaggggtgaaagtagtgatatatttgtaattcttcctacattcaatttctagtagtttcttcatggtttgtgagttttcttccttcgttagtaaaaattgaaaataactttgctacataaagctagcaaacctatgctatacaatattcccaacttccgaaattcttgggtacttttcaatcatacttaaatcaataggttcaacacaaaaattcatcaactgaataaaaacagtttgatgccaattatttcaaatcaaagaaagttcaatccatacaagttgaagtaacagtgatgtataattgtgcattgcaccgtcaatgtatcggtcagtatcattatatctaaaaaagctactttagaattatgaatacccatcctacaaatcctagatctgtcactgccatcagtaaaccgcgcttaccatggaggctcgggaagggcaactagcataatgatttagcaaatttcacccgaatccaaatttgagaaaaaaatataaaactcatggaagcggtacttgaattgtataactagttaaaccctatatctatatccaagccctgaacgagtggttcgggtgcatagatatctaaatcgaacggctgaagatggtgacagccggatctgcagcgaattataaacaaacagttttaagtttccaaataaaattgtaaaggaataagttcgctttagttccctcatattaacatcgagtttgaattacattcttgaaccacaatatcatatataatgtgcacctcatctttcgaaactggtataaatatagtcccaaggtagtattgtagattgttttggctaatggggtgctaacatggcacctaaatcaaaacaaataataaaaaaccttatgagctccacataatagtgaaaacaacattttcttcctcctttactctcctctcttccccatctctatccaaatctccagtgtgcgaccaagagaaaggcgaccgacagggagaagggtgcatgacaaccaacagagaggagctgggtggcagcagccgtgtcaccaagctcgacccgcagggaggtccagggatctcctctctcgcctcaccgccacgggcctcctccgctcccgccgcccgtcctccgtggagtcaccatctactacatttttgtgaggaggcaggaggcatgcacagtgtcaccgtccttactctgtatccctgacgctgccatgacctaatcgaaccagccctggtcgaacctctcccatgtccacttggggtaccactcctggctctccatcgggtgctaggtctcgaggtcgcaccaccactcgaggatctcgaacaccaacatgctgaatagctgaagctgtacacgttgcacttatgtgtcactggcaacaatagctacagctctagcgccacgtagccccgcgtgccccgcacgccggtcatcgtcaggtgggtattgtcacggttgcagagcttggcaagccttgatgttagcaccctttgctccaattcaaatagcaaacatatatgcttcaacactcaaatatttggaggaacaaaagaagaaatgggggatacaagttgctagtaacacaggaaggaggaggaggaggaagaagagaagtagatcaacgagggatgcccaccggccgcccaggtcaccgccgccgccgtgagcctcagctcgccaaattgatcaatcgatgcccccatgttttctgttgctgctcatatatgctggtagtggtgcttgcttgggcctgggctggaacatgactaaccgagcccatggtgcagcctagtagaggccctgacaatcccctcttcttaaaatttggcttgtccccaagccaatgaaagaaacctcttggatcccatggtacctttagtcctttaggctgcaaaaactttgcttccagcagataactaattgttgatataaaagctgcattccttggtaaaatctgaatttgctctgtgataagataaaaaaaaatgcatgtttgatagattgcagaggctctgaaatcaccatcttagtctgaaagcttgcccaatggttgccactgaaatcttcatcttgtttcttgactaccaaacgatttctagcctccacatcccaaattaagttggcagctattgatttaatcacctggagcatggaaattgattcacatatagagagcttgagtgtgcgcctatatccttgtgcaactcttctatggtacagtagagctgcagcattaaggaactgaagcagaaccccgccagagtccaaatgcacctccaagttccatgtcagatcaaaccgaaccattatgtctgaacactgggacaagcttaatgacttgatatgctcttgcttagtgaaggaaagggcatttggaatagagtgaacttgtagcttggatagcaatgacctcaaagatccatcatgaattaatgcttttgggttaatacacatcttcccaggacttgcaccttcaaatatacattgcagctctttgttgctcaactgtctttccttcataatacgagcaagttctttagatataatacgagcaagttccatagattggctattcatatgatgcccctgcattgcaagaccatagacctctcttccctccatcccccatgccaaagaacttactagacttggtggaggccatggtttcaacccagccatctcctgtgttaaaatcacggttccaatgactaaaactccaatatcaaaaggctcccatgccaggaagcttactccagccggtggtggccatgggggcatcaatggtaaaccttccaaatataatttggatcctggccaatgcaaaggttgcaactcccatcgtctaatcactccacccaaccaagaaggtggccatgaatttctcttagcattccccattagcagcttcttgtctttgggacatttcatcgaacacccagtgggcagcaatggaataagatccatttcagccatcaaccatggcgagaagactttggatgatgcatcaggtactagaacgccctcgggcacacccatcatggtccgacacgtgaccctggtatggtctgcgccacccttgacatcaaggccaaccgtcgaacagctggcgggcatcaccttggtactatcaagggtgtcgatgtgggtgtcgtcggtggtgctgccagtagctaccatctccattgatgactccacagaagtggcacaagtaaccacaacagccacagtgagatcaggcttggtgtcggagctagaacatatcatcgaacacatagtgggcgtgaactcaggaaggtccttgatgacaatgaagggcatgtgatccttgccctcaccatcctcatgctccaggatgacagtcggagcagtcccctcgttgatgtagatggatctcgatattgtgctcgagctactatcattggggcattccatcaaacagttggtgtgcactggaaggggtggtgccattggtgttggagatgatgcacccttgaggatgacggtgattgccctgatggcagcaatcatttcctcggaaaccttgctcctacgaacctttatcttctccaacttttgaaatatctaattgatcttctcctcttgcatgcgcatggcctccatttgttcaaacttctccaatatccgatctagagctttgtctagccatttctcctttttgttcacggtagaattgatggggacaggcttagatatcctctgattttccttgggcatctcagattggctaggcattccatcgaacaggttgtgggtgtcggtgtcatgagcagcacccttgcccaaatctaacaaccacttgcatggggcgttgctgcagtactctcccatcaactccatgctagaaatcccatgaatcgacagctctgataccaaattgttagcaccctttgctccaattcaaatagcaaccatatatgcttcaacactcaaatatttggaggaacaaaagaagaaatgggggatacaagtttctagtaacacagaaaggaggaggaggaggaagaagagaagtagatcgacaagggatgcccaccggccgcccaggtcgccgtcgtcgccgtgagcctcagctcgccaaattgatcaatcgatgcccccatgttttctgttgctgctcatatatgctggtagtgctgcttgcttaggcctaggctggaacatgactaaccgagcccatggtgcagcccagtagaggcccgacacttgggcacgtagtacatcggcaatgagcagcaccttgcgcaacttgatgttgtaatgcatgatccagtgctggaactcctcgtgcaggtacctcactggccttgcacaccatgccaccgccgctgccatgctcgaacatgacgcagtcaagcgagccgttctcgaggtacttgtaaacaagtgccttggtggtggtgccttgatgtggtaatatagctgctcctcggtgcggcggtccagtgtgcggtgcagggtcttgacagccacctgtacaccgttggaaaacttgccgtagtacaccatgccgaagccgctgccaccaagctactacgctccgcgtagcccccggtgaacttgcgcagattctccggcgtgaaccaggcgggcttctcccggagtatgtcatccaggaagggttccacccagggtttaaactttcaatttcaggggaaatttcggtgatttcggtgaaattttcaggatttttggcacttttcagaccaaaatgttatgaaattttgacatattttgactaaatttgaataaatttgaccaagttaaacaaaaatttgataaaacccaaaaatttcggtcgatatattgatttgccggtggggtctgaaatttccaaaatttcgaaccaaaattgcaatcactgggtccaccgaccccatctcaacgcggacattgtgatgataatgaggcgctgtgaccgcggccatgctgttgtgcgccgctcgttcgtagcgacactgcccttctcccctctgattccgcacgctggagacttgaacagagatgaggaagagaggggacatgaggagagagagaggaggaagatgtttcactgacatgtgaggcccacaaggtttttcatcatttatttttgcttcccgtgctacgtcagtcaaaatagcctacaatactgccttggaactatatttgtaccagttttaaaagaaaagggacacgttatatctggcattgcggttgaagaatgtaattcaaactcaacgtgaattatcagggacctaagtgaacttattccaattgtaaaccagtttcatttttattttttctagatgggccttcacggctacttactcgccggttacttgcagcggcccatcatggcatcatggcccagagcagccaagcccagaagcagcccagagccgcagatgcagcaagtccctactccctagtcgccggctgctcgcggccattgacggcgattggcgaagtagtcgtcgtcgccggtggcggtggcggccggccgggtctctggcggacggcgcagcgacgtcatccggccgggtttgaccacgacgccgcgtctcgatcgagaaaacaacggaggtggggatgagggaatccgaccgggatccccgagcatattccgctcccggtccacgccccgcctgcaatcatctccatttcgttactagtttactaatactatacgtgtgtatttatacgcttgattcttttatttatttttctttgcctcacctgccatgatctgcatgatgtcatactggtataatattctgaatataccatacgtgttccagtgtcagaaattaagcttaatttgatttagctgttccctttgctggtaactaattagccgctgtgtgaatgattagtaggattcggatacagcgagcatgtataatgtatatgttgtctgaactttgctgtcacagtgcgttggtgtcttcctgaagagatcatatatacatatatgtatatgtatgttgattctgctgtgtgtgaatgatgtggcctactggcgtgttctgttccctgacaggttaaatctcatatccatatatatacatatactctctccgtttcaaaatgtttgacaccgttgactttttaaatacgtgtttgaccattcgtcttattcaaaaaatttaagtaattatttattctttttatatcatttgattcattgttaaatatactttcatgtacacatatagttttacatatttcacaacttttttttaataagacgaacagtcaaacatatgctaaaaagtcaacggtgtcgaatattttgaaaggagggagtatgtaataatgtaaatgtgcataaatacaagaagcatgtctttgtacagtcgctgttgcgtcgagttcaggaaaccgagctcagccccatccatccatctattcggttatctctctcaaaatttaaacacacccacctacatatatatacattagtagtactacattatattaactttgttactccctccgtccctagatatttgaccgctgtcggcttttttaaacatgtttgactgttcgtcttatttaaaaaacttaagtaattattaattcgtttcctatcatttgattcattgttaaatatagttttacatatttcacaaaagtttttgaataatatgaacggtcaaacatatttaaaaaagccaacggtgtcaaatatttagggacggagagagtatatccgaaaacaggatattttttcgcatatacgagaacgtggaattaattacaagcacatgaaataatcgtaccaaatgaatacaattattatagtacccgcgaaaaaaaaaaagtcaaatttgaaacgcgcacacaaacacatcctctacaccttcgccacagcatgcagtgtcatatcataattcatacataacccaacacctcctctcctcccctcccttcgtcttcatttgctgcgtcgccgtacgtcgtctcgctcgctcctccacatggccgaggagtctcgggaagaaggcggcggcggcggcgtcgtggaggacggcgacgaagccggtggacggccggggaaggacggcggcagcggcggcgccggcagggggagagatgggaacaatggcatcagcacgtgggagatcgaggagatggaggatgaggcagggccggcgtcgctggctcctcctgccgacggccgccgccgccgacgtgtacgtggcggtggggaagggcgggtcaagcatggaggcgctgtcgtgggcgctgcggcggctggcctcgccgcggagcttcgtctacctcgtgcacgtcttccccgtcgtcatcagcatccccaccggatgtaagcacacacccctctctgtccatactcttaatttgaccaacagctaattgaaacatgtttccatttatacatttgcctcaagaaaatctggcacatgtgtttctgagatggaactagtgattactacttaatttattggatcattaattagaaatacaaacttcctatacatgtatggtatatttgtctaaggcctagctcatacacttgttgactgtgattatgaagctgctttgatcgtcttcttgagctagctggattagaacaagggtgttttagtattgcatatggaaaattagagactattgatcaaagagtaaattaaaacggttaattcgaaggactgttcttgtgtttcagttggtaagatcacaattgggtcccagcaatctttggttggagattggcctgcagcattgttgaaatcaaggtcaagttcttggactagcttagggggtgatttgtctttgactgaatttttcaaagctggcattgtcacaagctgtagttccattctagctttgttggcatcctgccgtcctacgttaggcatattttgccccatcgcaaaccttgcagcaaaaaagctctagagctgatgttgactgcatggagaattggagatagaaacaataccacccatgtggtgtttggtttaggtgtccatgctaattctagagtgatcaactttccaaaaattctagaatgatcaccaaccaaggcatgtatgaataggaagagatatatatatcatgtccacaaaagtttcacgttaacagatgttacaaaaaattctaggaaaaaaattgaacatgtacttccaatagtattgcacgtatatataaagtatcaacttcaaattcattactccctccgttttataatattataagtcgcttagaatttttctttctaatacgaaatatatttaaaatataacaacattctaataaaaataagcatattatcaaaatatattcaatgttatatttaatgaaaatgatttggagttatatatattgctaaatttttctataaacttagtcaaacataaaaaggtttgactaaaaaatcaaagcgacttataatatgaaatagagagagtatattttagccataatagaaaaggaaaaatattatatatttaagagtataaatgtgtcagaaatttgtccttttttctctctctctaagtataatgaatttgaagttaggtgtgatactattggaagtgcatgtacatttttttttagaattttcggtgatatttattagttagtgtgcacgggacacttgtgtgtaccatgttcggatagacagaataaccctttttcagaacaagggtagtggaagcgagcctacaattctagttgattcagaggagttacacctagttccttctctatatgggtaattttaccatccataagaaaataccgggaggtaatatattttctagtataaaacccgttaccttcagctattagatattttagtatgaaatttagtacctatggctactttctcatcaaggaccgtaaaatttctctagataatgtaagggcttgttctttatgggtgatgtatagaattaagtgtatggaaattattcgagaatataaatgaatgaattaaatattaaaatattgaattgttggttttcaaaaagttttctaagaaatgcccataattaaagtttttacaaataaagtatggttttgaagcttacgaagtgtgccgtatcatctacaatctgtaagctggaaagaacacgacccttatgcgagaaagaactatatttgtttttgtcgatgcatctacagttaagggataatggcccatcagtggtatatttctaaaacccacgtttaatttttcgatttgacaaaaccaattataatttgctcggtcaggtacaaaagtacatcccatcacgaattttgcttcatgtgattccgcattaattttattctctgttctcaactccatatacgtggagtatattggatggcaaacagtagagtagactagtagttcgagtgttataggtctctgagatgccggcgtgagcagggcgagtactttgttacacttccactgaaatgtgaacagaccagtacagtgagattccgttctcgtagcttttttttttttctttgacactcgcacagcaattcatcgttgattgctgaatgatgcagacaggccattctttggcatggccagataggggagctgagaaggacgactgcctagagcttaggaaaacccagggctttctggtatatgcagagatatatactgttgtataactctcattttaggctagctgagcaatatagataactcaccatacagtaaaaaatgttaagagcaaatcatcagtacataactctgaagaaaccgttcggtttttctggagggatagggcgcgcaggatctatatttaaagtcttttcatttggacatcatagtcatggttgagtctaggatttatgtttccttctagcttgagtcgttgttaaatattaggctgcgtttaaatccaggggtgaaaagttttggcgtgtcacatcagatatacagacacacatttgaagtattaaacgtagactaataacaaaacaaattacagataaactgcgagatgaatttattaagcctaattattccatcattagcaaatatatttactatagcaccacattgtcaaatcatggacatctcgcaatttacatgcaatttatgtaattagttattttttcgcttatatttaatacttcatgcatgtctcaatacattcaatgtgatagggtgaaaaattctggcaggggatccaaacaggcccttatactactcccacacatgatgtctacaaccaaaaattggaatagtagctttcttgtcaagataatttgtatttttaaaattttcaattggttctgacgaaacaaatcatatattctgaagctctgctctcaccgtctgaatagacaaaatttctgattgtattttttttttctgaataatgactgtgcgcctgaacttttttaagtctaaacagattaagttgatgcatatcttctgatgaacttgacgtatgtctccttggatatctgaaatagtaggaatgatgcccaagagccaagcaagcccagagcaggtagaaacttacatgaaccaagagagatcaaagaggcgtgtgatgctacaaaaatatttagaccattgccgcaactttcaggtgaactggttacatcagatcttcacatttctgtgctcatacaacagcttgagatgtatctgcaaggcacatatagaaatccaattataattcctgtcatatcttcaggttaatgttgatgtgtacctcatcgagagcgatcatgttaccaatgcgatcctcgaacttattccggtctttcatgtacaacagctagttctgggggtttcaaaatccaaattgcggtaaggtttatataccttgcaagttccaattaacagaactaccaaaataatttgctggcatttcagaaatacattctgaatttgtctgaatgagcacaggaagttcaagagaggaaacacaatagcaggacaggttcagaagaacgcacctctatactgtgaagtcaagattgtctgtgatggcaaggaggttacaactgtgccaactgctgatccaacaccaccaatttcaccttctcctgtaaataacaagagtaattctatcagcccaacgccactatcacctgcaccagatcataacaatcgcgctgtggctgatgatgacaaaaaggagactaatcccaatgaaaggaataaaatcacaaaatatttgaaatgcttctcattttgatcttatacttttatggttgctgcttcagtcacttttgcagatatagaacactgcacgcatagcatcttcagacaacaaaagcttgtaaaaaaacactttcaccaatgttgtgatcttgaatttcttgattcatttgtacaggagatgatggttgttatatgggatatttccagcattttttctgcattgttgtatggtgaagagttgtgcttgattataatataatgtctagaaccacatgaaaaatgcagccaaaggacagaaaatctggcactctattatatcctcaatttttcatgtatagccagaagaccgaacaataaaacatgctaggcagacctccagttggcaacctggcaatcctgacatggagcacttatcattgatcatagattacagcatatgcatgtgacaatttattactccaaaaagaattgtcctagatgggttaatccaaaccttcatagcagacaggaatagggcataggaacacatggctatgtcaagttgtcagccaatcatgcattaacaaaataattgat

SEQ ID NO: 74388 - DNA, 3702 bp, Oryza sativa
ttgatccacatgaagcggctgtagtcatcgatgaggagaaggaagtagcggttcccactcggcgtcactggtgagatcgggccgcagagatcgccgtggaggagttgcaggggcttgctagagcgagacagcgcccgtcgtgggaacggcgcccgtcgatgcttcccggcgagacacgcctcgcaaacctgatcgacctgcgtcaacaatggcaatccacgtaccagggtctccctactcattttcttcagcacagtaaagttgatgtgcccgaaccgagcgtgccaatgccacgcgtcttcgccggcgcgcgctgtcaggcaaactggccgcgcaaggatgatgtcgagcacgtacaagcgccctgggctccgagggattcgggcgagtaggcgccgctgcttgtcgcggacgcgcatgatgccatcctcaaccaatacttggaagctggtttcgtcgagttggccgatgctgacaatgttggcggcgagccgcggcagaaagtacgtgttggcgagggtgcggtgttctccattcttgcaggcgaacaacaccatgccgcacccctcgatagggatgatcgagccatccccaagccaaacgttgccggtgatgccagtgtcgaggtcggagaaggccgctcggcaacccgccatatggtttgacacaccggagtccatgatccagctgcgctggtcgcggtctgcttcatgatctaacccagcgaacaccttcttctcgacgagctcaacgcagacgcgctgaggcgccggcgtcgcgcgtggcggtggtggcggcaacatggagcctgcggtttcgacgtagcccccagtcaggagcatgagcgtgggcttgtcgtcttgggccacatgggcctggtcttcgtgcttaggcttgctccggcactccttagcccaatggctgagcttgccgcagttacgacatttgtcatccctgcgtgccggcgaggaggtggacccatccgagccaccgccgatgcacccctttccgccgcggcgcttgttacgtccgctggaaccggcgccagagcgtttcgcctcctgctcctttttgtggtgctccagccattcttcttcggttaggtagagcttgccatcggtgttttgggaggatggcggggtctggtaatcctcggccgcctagagtctcccggtgatttcctccaacgacaaggtagatatatcgagaagagtttcaattgaaagaaccagttggctaaacctcggtcgggcgacgtgcagatacttctcgacaaccttgtcatcgggctcgggatcaccgtgggtggcgagttggttgacgacactagtaagccacatggcgaactcctccaccgactcgccgtcccggaatgcgatcctctcgtactccgtacgcacccgttgtgcgctggccttgcggatgcggttgtcaccgacgcgcattgtcttgatgcagtcccatgcctccttcgccgatgccttcgtcgccaagatcgagatcatctcgggtggaaccgcactatagatcgcatcaagcgccatctgatcctcgtgcagctcaacggcagcgcggccacgttcgacagcgtcccacaggcaacgtgcctgcaacttgatcttcatgagcaatgcccagtcattgtaattcgtcttcgtgagaaccggatagttcgcagacgatcctgactccttgaccacgcggtgtataaccagcccgctgtccttcccgccgctgcccgaagcgcggccgccggaacctccaggagtgcgctcgctcggcgacaccgaccaacagcgcggggagctcgtgcgacgccttggcataagtgcttcttctagtgcacgatcacgtgtccaagccctaaaccttgctctgataccaattgtcaggaaacccttgatcaatcagcttgtgaacactggatgaactcacgcgaaagtggaagaacacaagaacatgtagaacacaatactgtagacgaacggacaacagaaatagagtttttggtgctgcctgaattgcttgcagcttttcggggtttttctctccttttattgtgcagaactgaaacatgcaaagcgacgccaaaaactcggatcgctacccacgactcgcggcttgatcgcgtccatccccgcgtccgctcatcgtgcgcatacgcccgcaggcttaggcacgccgcgagctattctcgcttgactcctacacgcacggcttccacatgttggggctcatgcgctgacaatgcacaaaacaaaatccaaagcttaactaactagctaaaaacaagcatgcaagatttatcctctaacaaaattaagcccagccatagtataagatgttagggggggcatcaagcagcctcccaatcgaaggagtggttgggaggtgggctaaaggggtcggccgaaccaccattgtgtcctctcgccatctgctgacacgtgtaggtccctaatgaagtcccgatggtggttgtgcggggttcacggcttggataaatgtcaaaaccgccataggatggctatataaggaggtgctcatctcacactcaagacacacaactcaagtggagtacaactcactttgatatctaggctactctctcgtagagttagaatatgggaagagggtgagggaaagctccaaaaggagtgccccaaagttcggagttctttataaggagttccggaggagtgttggagttgtgagcactctttccatggcagtcccagaggaatgccagagtgtcggcgctctctccgatcttgtaccttggtggatgcttcttttataaagtaagtatttgagatttctttatgttatttaattggtttacttaagtgatatatattctcatttgcgggtttgtcgcttaggggctgttcagattgatgccaaaatgaaccttaccaaaatttagcaatgtcaaaattttggcaaattgacaacattgccaaaattttgataggattggcttaataatgttgctaaaattatatacgcattgccaatatttggtaacaaactaaacgtagccatataattgtcaattttaccaaataatggtatggttgaaaatgtcatcaatctgaacaggccctttgtgtgcaattgagtgctctagtacaaagactctggataaagaaggaagttcttggccgaggctataatagtaatcgataacgtagacgtagtgtctacgttagaggttaccttcgtttgttgtgtgctccaaggaaagtgaggtaggcggcaggtggtgacaaccttgtccatcctttgcattcctccacgttcgggtacatcatagagctcaaggttagactcagtctggatgaccaaaggagggccggtgtacgaaacatttgatagagttttacctttaacttaagttagctagttgaatccatagaaatcctctctatcctaagcctaccatttagttgttgtctttggttgaatcctgttcttagactaggtgataccccacgctttcctacgggattcatggatgagtatatgttaaatattgtcaaaatgatgaaagttgatatgttgagaaaataatgagaggaagatgatttgacacatacttgttgatctctataatataatattgtagatgatatgtcatgcttgcacgggatttaaaataggctagaatagtaattgctagtgagtgaagatgtggcatgc

SEQ ID NO: 74389 - DNA, 756 bp, Oryza sativa
ctatttttatatagattgatgggctgaataaatgtgtgatgtgtgtggagatgggcaaatgtgttcatgtgggctatatttggcattgaggagacgttcatataggctatatttggcactgagaagacgaagagactcacctggttgggctcaatcctacattccatctaacctctgaaaagcacgaggtttaagcttttggaagaagggattcgtcagtcggtaggaaaagtactaaaattgtctgggccgctgtgggcctcatgcctggctctctttaccgggcctcggcctctatatgggcctaacaggtagacatgtttgctcatctcattcgtcgcgacccctcgcctctgtatatgggcctaacaggtagacacgttcgctcatctcattcgtcgcggcccctcgcctctgaatatgggcctaataggtactccgtaggcacgttcgctcatctgatctcgccggttctctgtaaagtcaaatgctgtgcctaaagaaaagaaaaaccaggcacggcgactatctgttttgccgtttgtttgaagtttgaacagctaataaactactactccctccgtcctaatataaaggattttaagtttttgtttgtactatttgaccactcgttttattcaaaaatttttttgtaaatataaaaataaaaaattatgcttgaagtactttggataataaagtaagtcaaaaaaaataaataataattttaaatttttttgaataagacgagtggtt

SEQ ID NO: 74390 - DNA, 3887 bp, Oryza sativa
cagatttatttgtgtgcgtaacaaataccaacatcggggatttcttccacctttagtcggcccctctctctctccggtcgggaagcccttgcggcttgctgcctccactcgcccacttgccatcttcccaaattgattgacaggaatcaatccccacctcatcctctcctattccccataatttcccactcaatcccattttattcatgttggattttgatagcacccatcaatgttgagctccaccatggcgcggtcgatctctctcctaggtgaccctctctcccctcttcggcctataaaagggagcccttggcctcctcccttctccccaactaccgcccgcacctctctccctccccggccaccacgccgctctccttttgcgctgccaccatcacacagctccagttgcccctcgctggcggtcgagaccccctcggacactggtaacaccaccgacgacttcgcctcctccacctctcccccgtccacccctccgtcgagcatgaggaccacaagaataacaatgatgccgatgacccgaagctccccgtcgcttctccctcaccgccggccaacaccaaggacatctcgccccatgcattcgcacggttagaactgtcgtttccttctctctctctctctgtttctcccatttgcgcattcgtcgcatcgccgccgcggcatcaactaccgccggcgagccacttggctcgagcgctagtgaggaaatgcatggctagtctccatacttcccactggccactgtgcacatcatttcacacaagcattggaaattaaaaaaaaaaacactatagtgcagaaaatctccgaagcaaatgagcaatgagaatcaacacctggtgtcaatcgatgtcttgattaattatcacgggatgtggttctggaagggagggtgttgatgcgaaaaacacacactggcctgcgatatctgcttagctctagtgcaggaccaagggttggtgagatgcgggcatgctagtcagtttgaccctgcaactgacaagatatgcaaacaaaagatcaaatagccgatcagctgacaagccgatggagtagttccagccgatgccgataccagccgatagcgatagggttttgagctatcggccatatgtccaatgtagataatgatataaagacaatcggctgatgataatcaatataattaaacaatataatccagtggaaaccagtcggctagcaatgatatgatataatatgcactgatccgaaggttaaagcatacatcggctggaggtcagatgttataaaatccacaagattagattaaacagtaaaatctttattgcgatcggctaaatccaacttatatatgcaatccttataagccgatgccatgtccagataagtcatcggctgaaaccctgatgaaacccttattggcaatcaaaaaacaggctagagattatgattctaagtatgacttagtagatcaaacttaactgatgtagcagtaagtacgaaaagaaacacaatatgtagacaatgaagctgttgactgattttttgtaacaccctgaaaattcgaccgacaaaatcaaaactctaaaaatacggattttcaaaaacctttttaaattaattgcatcatgccgatcttattcgcctattttatctggatttgatctcgaagattattaatcgtgagtaaagaatagttaatcaggaataaaccttaaaaacaaattggtaaaataaatataaattaaaaataaagattaggtgtggataataataaataaaatattatcacgaccatatttggatcaattaaatttaaatacgatggaataagaattaaccctaataaaaactcaaataaattatataaaaataaaatatgagtaatattaatctagggtgaattcattagttaagataccacaaatattgagtaaaatgcatatatgtaaaattaggaattgtggaatcaaatttatatggaaaatacactaaaatcgggataaataggaaaagtcactgtttattgcctcataggtgttcgattttggtcctagccctagacccttctctgccacgcgcccggccatgcccggagccccgcgccgcccctaccgcgccgtcgccgtcaccgtcccgtcgcgccgtcgcctgccgccgcgccgacgtcgccatcgccgcctgtcgccgtcgccatcgctgccgcgccgccctagccggccttgcgccccgcgccgcgagccgccccgtcgccccgcgatgcgccccgtgccgcgctgcctcgcgccccgagccgcccgcccgtcccatcgccgctcgccagtcgtctcaccccgtcgccgtcacgccgcgctatcgtcgcatcgccgcccgtcgcgtcccgccccgagccgcgcgccgccactgtcgccgccgccgtcgacgtctcgtcgccgcgcgtcccatcgccgcctcgcgccccgcgccgccgtcgcgtcgccccttcccttctcttcctttccccctcctctcccctataaaactccaccccctccccattttccccactccatctcccccttcctctccctcttccccttctccatgcgccgccgttgtcgtgccgccgtgccgccaccttcgaagccgccgcgtcgtcgccctggagccgccgcgccgtgcgtcgccgccttgcgccgccgtcgccgtcgcgccgctctcgcgccgccacaccgccgccttcgtgccaccatgtcgtgcgctgtgcgccgtcgtcgcgccgccgtcgccgccaccgccgtcggtaagccgccgcctcctccccttgctcggtcgccgtcgccgccccgggtagcagggagccgagagagagagaaagggagaagccaaggaagagagaaagaagccgggagggaggagagaaagaaaagaaaaggaaaagagagagaaggaagaagaaaagaaaggagagagagaaagaaaaaaaaggaaaagaaaaagaaaggaaggaaaaagaaaaagaagggaagaaaaagaaaagggaaataaataggaaattagagggagattagggaagtttagaaaatttaaaataattagaacttagttatagattagttatagtcgtagaattgcgaaatttaatataaattatggattattcttggtaatttctacaagaaatcaatttgcggtagtagtttaaatgtaattaagaactaaacgattagatgaattcttatagactattatagattattttgggtaatctctataagtaattgattcacggtagaaattcggacttaatcactaggaattttagacgtatattatatttagtcgtttagtcctagactaaaattaaatcctataatattataagataatttttggattccgtccgatatttagcttgcgatagaaatttccaacctattatatggatataacgctcgggtagattaaattaaaaacttatgataacaaaatatttatacccacaaaatagtttaggatatataaatcgaaattgggtttgccctagtacgcgaatagtaaagttaatataaaagaatcgactttcacgttcgactttcatttggatttatttggatttttatttgaattctaatcgaatccaaatcaattttcgcacgtaactatagagcccgagggagttgcggatccaagtgaaggccaagacccccaagaccttgagcaaggcaagtcatcactattccttgaacatgttgatcccaattgcgaaattattttgtttataaataaaattgcatgcaatgatgaacatcctacttgtgattatgccatgccttgattattgtttatcccttattccttcgtaaccatgtttacgtatgagtccctagtcaattatg

SEQ ID NO: 74391 - DNA, 1115 bp, Oryza sativa
caagagtgtcaattgatccaaaataaagttaaagagggtaccatatcagcgtaattttgtttactggatcctactgcctgtgataggcgagtcagtgttacaataattgttgattttccctgtctgtttccagcatcctctatgtttatatcaattttggggcctaatgatggcaaataactttttatgctatctccaaatggataatttcgtcctgttacggattctatcttcctagcatcagcagttgccaaactctcaaaagaatcaattccagcagtcttcagtgcctgggatgacagtgataacctcaagcattaattatgcagactgcagatacataaacataattacatacccaataaagataataaagttaataacctttgctgtgacaattccaattccaggcaattgcttcagcaaaaatggactactctcccaaagtttttggtgtaagcatttcgcaaggagcatagaacttatggcagacttgtaattctttttgtatataaaatattctctcatgcatttggcaaccctgcatccatttgagcatattgaattcatttcctgcatcaaatcgcaaaaattaaaatatgtcaaaagaataggtgacaaaatcaaatggtattttgaactggacaaacaaattacctggttgagagatagatcatggactagagggtccccagttaaacaatcatttgccagaataaatattttttcttctcttgtttgaatacgcttcttccttttcccatttgcaccaacaacatggaaccaaagccttccctctttgtcagcatttatctcattaaggagcttcttctcatttcgtcgtagttggatcccttgatattacagaaaaaaaatcaaatcgctaatttattatatttaattattaattagaataaactggagttacctacaagtaatctctgcagagtggcagatgatatgcaacagatcttccaaagtgcaacaggcagaagctttgacaataagcttcatagtatcaaatttcagatagaattttgtcatcagcctcccaggttctgagtagaaaatatatatctcagaagagtcatctttaatatgcaaatgaactgagt

SEQ ID NO: 74392 - DNA, 3072 bp, Oryza sativa
  unsure (1)..(3072): unsure at all n locations
tgctgagtactaattactatgagaaatatagggtacacaaaactgagctagcactgcacaagccaaaaagtggcggcctttctttgactcacttgaagattaaccatttcagatctttgctgagaaatataaatctgaatgccaataagtttacttcaagaaaaacaggacatgttgacagaaacaaaaaaaatctacatactaatctgcaagacactacatgtgaaaaccctactcaagatgatgcaaacaaatggaaaaaaaaattattgagtcctaaaagaaatcgaattctagatagctatcactgcttttctgggcagcatcagaaggggcagcagcaggctccgatgttgaaacaggttgctttggaggcctctcaatctcaacaggcctgggaacctctggagggcttgcgcagcgtatcaatgcccagttcacaccctcaaaaaatggatgctgttttatctcagtggcaccacgcttacaacccaatctttgttggggctccttgacgagcaggcccctaattagatctcttgccgagaagctcacaaccgggtattcagggaagcgcagcggctggccaatgacgttgaacagtgttgcacggtttcctgaccctttgaaaggtgtttttccaaacagaagctcatacaagaatatgccaaaggtccaccagtcaacggcactaccatgaccctcgcctttgataatctcaggggccaagtactcatgtgtaccaacaaatgacattgagcgtgcatcactaggttccgctatgagctcaggccatgggctgacctgattgacaacttcaggctttggttttcgatccttctttgacttggagaaaaatcggggaccaaagcatgttgtgggagtggcacacgatggctgaatcatgcaggatggctccacacaagcaggttgaacacaataggcctggttgttcttcccaagtgcttctgcatcagggttagatgatctgatcagtgttgggctcactgcacagcgcagggagaggtcaaagtcagatagcatgatgtgtccatcctcacggacaaggacatttttccggcttcagatcacgatatatgataccaagcatgtgcaagtactccatagcaaggagtatttctgccacatagaatctgcgaccaagaagaaagtgcaatatcagtttactatgctatcttgcaaataagtgaattcaagaagtacatggaacaaaacaaatattccaaagatatgcataccacttttcatgctgttgcttagttcatgctatttgaggagttttagctcttgaatgtggatgtaagctgcagtttttattaattcttaaaaaaactacattgataaaatgaaatatcatggggtagaaattaattttgcatgtattgacttcacattgacaacttgcacaaaattatcatcacaatcagcttacatacttaatataatccatccaattacgcagttacactaacttaaagcaaaccataaccttttctgaattgtgtatccacgttttcgaaatttatcggaacagaaaaacaacaaatgaaaaagatagtgaaccctacaagagtaccaaggtattaatgtgtatcatgtgcattgagtaaatcatacgtacttgacagcttgttctggaaaatacttgccacgctgcctttgtcgaagagtatgcaggtctccaccagggcaaaactccataaccaggcatgagaacttatcagtctcnnnnccgatataacgttggaagaaaaggatgatccaggcactgcaagatttccttctcagtctgggctcgaagcaatttcttgcggcttgcaagtgatgccttgtccataaccttcatcgcaaaatagctcttcgttccactcagttctgaaaggtacacactgccgatatcaccacaacctagcttcttcaatagcttaaaatgactcacgccaaggattccatccctagtcctgatcatctggattgcctcccatcgtgaatcattccccttgtgaggcttggtgacgctactaatgctgctgcaagcgctttaatcactgacatcactgcttgtgcttggcctgcatctgctggtactgaaacctctttctccagtctaagatctcccaaccaacttggcacttccacttgcacttgttatcccatgctcctttcctaaagctgaagatgatttcaagcttccgttcgcaaatcccatcctccacaacacccttttcctcatttgcaagacgctttggaacaggttaccctcagcctttacttctgcaggatcattgctacccgtaagatcaatggactcattttgatgctgagttgatttctgctccttttgcaccacttcgggattcggtttgcttgattcagctgaccttcctggcaccaatgcacttcgtttactcggactggttgtctccaaagaagaatcattctgagaacacagtttcagtgactgtaagttgggagctgcagggggcgctcgaggcattgcctttgaagccattgctcccacaactgatacgtatatatatcagaccagattgcagaaagaactactgaccaatcaaagatttataagcttggtgttgacacttgccttcagaatctgcaaagggcagcaaaagaatttcaattgattagaacatgcctagatacaaaagaactgcccaaaaaaatacagaaatccaccaattcgatgaacaagagatcatcccccaacaatcccaaacaaaaaaaaaaacaaaataatcaagaacccaacctgcacacgcagatccatcaaccttcccacaggtccactacaacgagactcactcctcacaagtcacaaccgaagccacccactgattttatccatctaactcgctcaaaagaaaggcatcatcacaaaagctaatgtcgaaaacactgaacctgtccaaccgcccactaaccgcaatcatacaactctactgtctctacagatctatcgaccatcactccccccactttggaataaacaagtgctagggatcagcaaagatggcttgtcccatcaaaggc

SEQ ID NO: 74393 - DNA, 585 bp, Oryza sativa
aacagtgaaattaaatttctttacgtttataattttacagggatgttttaggtctcactgttgactgtacaaacatactgttacataattatgtattattccctttcttgttaacattgttttgcatgtttttgtttgaaataaactcttccttttatcaggtgcaattgattatccatcatttcttacgctcctgaaccagctagttcctcccttatctgtccagctgtctggccgacggtctagcatagtaaaacaggtatttgatttaacaccaattcttgaggggctgtcaaattagttcatccaaaaatatttcattttagaagtacatgtgtgttatggaattctgttagaaaaaaaaaaattcttattgaatttgcaatgactgaacaaaccttggtgaaaaaaaattgctgaccaagtttttttccaggcatgccatctactttatatgctatcaaaagaactccttggtgattttgaagcatgtgctaaaatatttattccggtaaccatagaacctgtttcagtgttttgcaacagtaagtcagtactcttatacttcctcagtagggctaacat

SEQ ID NO: 74394 - DNA, 10142 bp, Oryza sativa
actaaaaagataaaaataataccatcattttgctcaataaaaacattcaattatggtcttcttttctcaatgcatgatatatgataagtatcagtatttatatggtatttttctaattctttcatattagtttttacatatatgttaatttagactaatattttttcccataattaaatggataaataaatcttttttctatatttatctaaaatattttaagtgtatgtaatttaatatgtaagatatggacttatagtataagatttatcttttttaaaaaaatgtggcaccatagtagatgggtagtttagtgaacaaccataagaaatacgccctccatcccataatataacacattcacctaaaatcttttattttatattatagtacggagggagtagagaatttgttgtatgccactgattttggccatattctatattatattaatgtatcaatgagtttgtcaagttctacaatatgccatcgtattttgtttaacttctataatataccatcgtcattcagttaggctccattagtgctattgtacaattttatcctaatgaccgaaataccccgtgatgaactttccaaatttggttaaaaattttctgaaatatcaaattataaatcttccaaagtttgagagcagcaagtcattgcaatggctgctgctgctgatattatacaaccaccagtcacatcaaaacgcaaactttctcgcagaaagccgagaggaaagcaagaataccaccaagaacggccaaaagcaagatgcctcctttcatccttttctgcaggaatgcagacgcagccatggaacctcgcgttcatcggacaaaacataaaaagaaagaaagggaaaaaggcaaatttgcagagaggctaagggggtgtatagatcaggcgcgtaaagttttggcgtgtcatatcgggtgttatatagggtgtcgtatagagtgttcggacgctaatagaaaaactaattatagaatccatcagtaaaccgcgagacgaatttattaagcataaataatccatcattagtaaatgtttattgtagcactacattgtcaaatcatgaaacaattaagcttaaaagattagtctcgtaaattagtcacaatttgtgcaattagttattttttaagtctatatttaatacttcatgcagttgttcaaccgtttgatatgataaggtgaaaaattataaggtggaatctaaacagagccaaaatcacatcccaagaaaaacagcagagaaataaacaacacgaaacaagaagagactgaggccctgattagttcccacgcaaaaacttttcaccctgtcacactgaatgtttggacacatacatagagtattaaatataggaaaaaaactaattacaaccgattgcgtgtaaattgcgagacgaatcttttaagcctaattgctccataatttgacaatatggtgctacagtatacaattgctaatgacggatcaattagggcttaataaattcgtctcgcagtttacaggtagaatctttaatttgttttgttagtagtctacgtttaacgcttcaaatgtatgttcgtatatccgacaagccaaaacttttcacccctaaaattaaacacgcctgaatctacaagagaagggatcgaaatggaaatactactcctacgctgctaccactacgactacgagagatcagtggatgagaaagaactgatcttttcactggcatttgatgtggattcgttctaagatcgcaatgattctgcctagtatatttggtggttgatgtggagggccttgatgtgatctcctcgcggatttgtccccccgaatgacatggccgccctgctccagtacaagaaactatccactttaaccttgggagcaaaaataagggcatgtttggttcgaaaatctaccaaaatattggtagtatcaaaccttgagcaaattttgacactaccaaatttttaatagtatagatttagctccactctattgatttggcaaaaattggctccaatccaaaatgctaacatgcattattcaaaactaccaaagaattagtaggggaagaattggcaccaaagaaaaatggccctaaatgggctagaacctggacccgagctgaactgctgaagcaagacacctctcagagcttttttaccgtagtgttcacaaccccggccgtataatttttttctcttaatatttatatatatatttttctcatactatattcaatgaaattagcacattgtgttgtcggttcgttaaaagaaatacctataatcaggtaaaattcatgacaataagtacttgttacatatatgtatatagtagttgcatatattatttgtttttactgaaccttctcttctttttatctcctttctttaacataaactagttgaatgctcttgtgttgcaatggcatttaaaaaggagaaccccgccgtacactctaaagcctaaaaactaaaattattcttattgtaaaatcttcagatcatattatttgtcatcatttttcctcacttcaaaagaaaattttcttgtttattgggttgaggttgagaaagtgataaaagtccacctatctcactatttggggagacttacatagtattggtagtgagtggtggcagatttaccattcaccaatatcattggtatttttaaaggagtataaatactattctagttctttctgataatagtaagcacttcatgcttttttatttctttttaaaatgatttcctttcactcgtaaggttggattagatcttaccgagaaaaaggggaagcattagaaaattttgagtaaatattgtaaaattgtagattatttctattaaattatcacaaaactacaaacttgacgatataacacataattacagatttagctataaacttatcacataattacatatttaagattgagtattagaaattgaaagactacatacttaaggcaccatattacaaaactaaaactacatagtagttcacattgaattgatatgaaactacagatttaagatagagtaatttcattatcttaaaaaaatcaagtaattgatactagtattttatgatgtaaacatctcataatagaatatcattccctattttgttggaataaaggccccaaaaatggtgggaaagccatgtgtgtaaattatgctgaccccacttaaaaatttccacgattatttgagacaaatcaagtagacgcctaattcaatggagtatatgaaacgtcatttttctagttggaacggtacggctcaaccaattagttggaacgatacaataatgtatatgacggttgtgcaacgtacacgactctccagtatcaatagttgtacagtcactgtaactgttttcagatgcaaatatttgtgagtatttgcagacgattcagggttagttgcagtgcttgtacattctatttgaagctttgggtaaaaagttaaaacttccggtatcaataaggcctctcacagtgcaagacacgcaataagggggcttagcctaaaaaagtgacctaaagacactcaagcctacagtgcaggtatcttcttttgagtgacctaacgagatgaagctactgttgaaggatacaaagtctacagtgggcataccctagcacatggggcactagcaggtgaaggaaatttaattcctcacctacccttctctttctctcagccgcgccgccccttcttctcctccctcccacgcctcttcgcctccttctcctcgacagcgccgcctcctccccgtcgacctcgctgcctcctccccgtcgaccgcaccgtctcacgcgcgcctcgccgcgcctcctccaccgcggcgacctcaagcagcggcggccaaggcaccctcccgcgtcgtctccgtccaccgccgccgtagcttatccgcggcggtgttggcggtggagctcggcatctctccggccgcggcgacctcgagcgggacggactccgtcggcggcggctggcctcgtctagttcgacgccaacggctgacctcgccacctcccgtgccggttcttggcgggcggtaggcggttcttggcggcggcggccggatctggagcaccggtgagctggtcctcctcgcctcccgtgctgctgtgcctcctcacctccatgtctcccgtgccggttcttggcgagcggcggcgagttcttggcggcgggttcttggcggcggcgaggaggaggggaggagtccccggcgagcggcggcgggttcttggcgagcggcggcgggttcttgccggcggcgggagcggcaagtcctccgccatcagcgtcgctccccacctcgccgtcgtcctcctcgtcgtcggaatcggagcaggcgggggtggtgttgcaggaggagtccgatctgttgaatcttgttgtgatgattttgctttcgttttcgttttcatcttgttgaatccgatctgttcttctcttccaatcttcaagattttattgcttatctatcaatccgatctgtggcgggagaaagaatgttgtggcgggaggggattttgggagggtgaatcaggaattttgctgccgcgtgaggggattttgggcgctaggccacgcgagcacgaggctgcgccgcccacagcgtgcgtgacccgccttttctcctcgctgcgcgccctcgttttggcgaggctttgcgtcgctaaggtaggggacgacgaacctagctaaggcgcggtccctccctccacggcggcaaaaaacctacgtggcatgactaagccactgtgaggggcctaaggccctgtttagatgggactaaaacttttaagtccctatcacatcggatgtttgaaaattaattataaatattaaacgtagactattaataaaacccatccataatcttggactaattcgcgagacggatctattgagcctaattaatccatgattagcctatgtgatgctacagtaaacattctctaattatggattaattagccttaaaaaatttgtcacgtgaattagtttttatttatgtaattagttttgtaagtagtctatatttaatactctaaattagtgtttaaatagagggactaaagttaagtctctggatccaaacaccacctaagtaaagcacagctaatgagccaaaagaagctctgtgtaaatactgccgggataaatttgtccggacatggtcaggatttagcaggctaaacgtaaaaaatttgctgtcttttctcgaatcttttgaaccctattttggccgtactcctatggatgaagtactccagcacagttctctctcattcaggagcattcatggcttctttatggcttggattctcatctctgatgcacggaagccaacgtacgtactagctgctcaaacgatgccaagattcaaacgagtccaaaaaaatctgaaaaatgcagagatcaaacttcgcctaaaaaattcaaaattcaaacgtgcagagttattgtatccataaatgtgggcaggtcagatagaagttccgtattcgctatcagtgcactccgatggcccatatcagcagccatcaatgcaggaataatgtccgacaccatatatgtaaaatttacaccatcattttaagatcagtacaagggacaaggaaggagaaagaagggacgaagtagccattttccgcatcgaaattttggttaaaaagaattttggagcactaatgtataaactgaaatacttactactttccaaaaaggcaaaaagaatagaattcagtaaaagcagagccaagttcttaaaaataatgaaaacatgtgtatataactaatacttcctccgtttcacactataacacttcctagtaggcactagcattgtctacgacattgtccacattcaaatagattcatagcatgaatgtagataacgctaggaagtcttacgtcgtgaaaccgaggaagtagtattttacggtggtccgtcggagtatttaccatatgtattattatcagtgtaacaatagagcatattgaaaaaaatatactaattaaccaatttcccatataaaaattaggaagcccacacaaaaatgagtcttaggcatgtgctcaagaccactggaagattcttttcttcttcctctgtcagtgcaggcctatgaagaattcctattgatggaagaagagctcagtcttttgcatttgtagccaggacaaggagatagctggagctttatttggaattcgggtacatacaattctaagagattttacaagctcaattttatgccccttcagcccccaagaccctatatttggctatggaagtcaaagtgtgttatgaaaattaaggtgtttgcttggcttcttttcagtgacatgctaaataccacggatatgcttgacagaaggcattgtgcaaaggagaatgctgatttaacttgtgtcctgtgtaatgggggtcaaagagaaaccgggcttcatctcttcttcacccgccctttcagtgttagatgttggcgacatctgggtatcacttggaatcagcacatggagttctttcaaatgattgttctatcaaggttgaactttgccagaatgggtttcttggaaattttttttattgcctcttggcacatctggaaacagagaaataggtttatctttcagaatgttgtgccctctttttcagtcatggagaagcctcttcaagaatgaaattcttctgcatatgtgcagaatgaaggagcctttagagcaattagttttttgattggttacaacctttataatccttttttggcccttgtaactttggttttctttgtacatatatagtttcttttttcaatgaaaatatactactagacaaagccctggtagtctttctagtaaaaaaaaatgagtctaaggctgagttcggaatttgctttgatggagattttctgcggcatacttaattcggtattaataattattataaacttgaaatatgggtttatttaatattttaaagaaacttataaaaattattaaaaatataccttaccagtttgaaaaacatgctcatggtaaagtggtaaaagagggagtagccaaaccaaaactcactaccgaactaagacttacacgagtgattgacgattgtaggtgtgtgttgatgcgaatgcccacctgcagtggaagatacaagaattatactccctccgtttcatattataagacgtttgacttttttcctagtcaaattttgttaagtttgacaaaatttatagaaaaatttaacatctaaaatataaaatgagtatgtttcagaaaactgcaacttttacgttatatgctactatagttgtcacctatatgtattgtagcaacatataacttttacattatatgctgctatagttgtcacctatatgtattgtaacagcatataacgtaaaatttacagttttatgataatttctcaagctattgttgcagcaaactgaaacatgccactaatgttgcagcaaattgatagttttgtcactaaaattacagttttatgaaatttactcatataaaattagtgtcatttaatttaacattgaatatattttcgtaatatgtttgttttgtgttaaaaatactattatgtttttctataaatttggtcaaccttaaagaaatttaactaagaaaaaaatcaaacgacttctaatatgaaacggagggagtagcacgaattattttccagggcataagcctgatttgaatctcctacattcttcgttttcaactgtgatttctacgacgcggaatcacgaaaagagcgtggtaacgaggcagtgcactcagggcatcaacggcctcagcgatcgccaaaacgacgacgaccgagtgcatcgccaaaaaatctacgacgacagagtgcatgggccgctagaaaaaggaaaaaagccttcctactcctcctctaatgccaccggcccaacacaaagcccaccttcgcacttacacgagtactgcgccaccgtgccccatgggccttgcgggttgggccgggaaaccacatggccatcacttctagcaagttgggcccttttaagctggaccaaactctggctgtttgggccgagcagaatcagtgaggcaaccatcattccaaatgtcacaaaacttgcaaatagttaactggaacgattttgctatatctcactcgaaagattttttcttatctctcactcgattttctcactcaaatttacagtgcattttcttgtaagttacagtgtaatttatgaaacttacactgtaacttttgtaagttacactgtaatttttgaatcttcacatgtaaattttaaattttgtatttgatttggtctttttcttgaggatatggtaatttaatgttcattatggtgtttcttaattgctttttgctttttattatatctatcggattttaatacaaagattaaaaatctgtgtgatacgattataaaaatctttcgaaagatgtataggtactccctaactggaatgtgcgggggttgaattccgctgcgcggtgcaacacggtgcatgagctcgtgctggacacgaaatgcaacatggcatgttttcaggaaacgaaactccaaaacatggatgattcactcgccaggttctaggaggatacaaactggatcgcttcgacttcaaaccagctagagggacaaagggaggaatcctgctactttgggacagtgacacattaaatgtgcaaaacgtccgagacggtcgcttctctatctcagcagatgtcaaagtcatccaatcaaacactaccttcatgctaaccggagtatatgggcctacaaggcaccgtctaaaagatgccttccttcggcatataagaagactcaagccatactcgggagagagctggctgctcctgggagatttccacatgatttacagggctagagacaagagcaatgggaacattaaccttgcgcgtatgacccgcttccgcttagcccttgaccattgtgagctaaaagaaatccacttacagaacagaaagttcacttggagtaatgagaggcgacggccgatcatggtgaaactggaccgatgcttttgtaacgaggcttgggacctagctttcccccagcacatcctaaatgctctaccatcaggcccttctgaccactgtccgctactcctttccaatacttcagggccacggaaaccacgtcccttcaagttcgagaatttttagacaaggataccaggattcaaggacgttgttgcggcggcttggagcaagcagacgactcacacagaacccatgcatcggttaaatcataagctgcaaattaccggaaaaagtctgcgagagtggtccaggggaatctgcactgaggcgaaaatccaattccacatggcgcttgacgtcatacagcggctagactccgcacaggagcaaagagagctcacaacgctagagcactggctgagagcaggacttaaacgccgcctacttggtctggcaacgcttgaacgcgcaaggaagaggcaagcttcccgcgtaatgcacatcaaggagggagatgcaaatacaaaatttttccacctcaaagtcaatgctcgaagaagaaagaattacatccaaagacttcgcagtggaggtggctgggcggtgagccaccaagacaaagatgatgttatcttcgaacacttttctaggatgatgagtaggccagaaccgagaacatgcgatattaactggcaagccttgcatgccccaacgacggacctctcgcatctggacgatcctttcacggaacaggagattcatcgggcaatcaaggagatgccagctgacaaggcaccagggccagatggctacacggggaacttctttaaagtttgctgggacattatcaagggggacattatggcggtcttcgaatcgcttaataatctgagatgtgcgaacatgaacctcctgaactcagctaacatcgtcctgattccaaaaaaggaaggcgcggatgaggtgacggactacaggcccattagcctaatccacagtatagcaaagatcctctccaaaaccttggctttgcgactacgattacacatgcgaaccctc

SEQ ID NO: 74395 - DNA, 1216 bp, Oryza sativa
gttgcaacccagtcatccttgtgtgtccttgttgactattacaacctttggctatagatattgttgtggtttgtcaggaggagacatcgagatttagtatgctatttgtatcttcggaaacgtatcctgttccacaactctgacttggtttaattaactagataaatctccttaaagacatggtaaaacttgtccctttgcccctgttcaacaatagttttgacattgacatttctttctttctttatttgtttgttcagttcaaattaaaaaccattcaggtccatgccatcatgttgaagtgaatctgagcaacaccaatatgccattgccatgggggaaaaatcgcctcaggaattacctcagtccttgcttagatgggactcaatcccaatccattcacgtgtatagggagggaatttgaaactaaaatcttgggccatccaaactgctcttattccgcaagtttagggggttaggaacctggttatgtagttcaggatgagccagagttcagggaataaactgaattactctgaagccttctcatccttgaaaacctgaccatgttgcatctttgcaggtccctttgcatggcaccccacatcaggtcacgtattatgcagagcaatctctttatcccctaatagtgtctgttcctgtaagtattagtatatgttattactgcaattctaacataatttatcattggcatctaattatgtttttgaggcattttcgaatatgttcaacacataaagtccaaataacaccctccgccacctaaactttgattgagagtccatctagcatattgaactttaaaaccggacgttcaaacccccaaactaaacaatacagtttatacaaccccctaaggtgattttgcaaagtggtttttcatctaatttgcatgtatgttggatgagtttgatcacatgacatacgtattagacatatatatgttaaaaatctccatgcaaaacttttttttcactcccttattcgctgcaacaacattgtgaaagtgtcacatcactatgtaagaagaaatttatgacctactattaatgatatgtaaatatgttgtatcagttattcaaagctgctcatttaagcttccaaatgtgcaaactaccctagggggtaatacgaatggtattgcaaagttttttttttttttttttttttgggggacgggggggggggggggggg

SEQ ID NO: 74396 - DNA, 6058 bp, Oryza sativa
agtgtggagttaaaaataaagtagttaccatacttttgagttgaagtgatatccctcttactgttttttaaaaggagtaggaactgcatactcgaccacaggaatgacatcatcaatagtactacaccaaaccaaaatatccgtcaaatgtgtgcaccatttggtttctctcaaactcaagttctgggaacctgaaaactgttccctttgatcataacaagaaacctgtgctagccagtgttaatatagactataatgtattttttttattactagctaatctgctcatatgttgccatggaatcttaaaaagagaacctttgtcatactacctcagtccaaactctaaaagtttagctaaatttagctattattatctggagggagtacattttaaagcataaaattgtttaactgttttagtcaatttttgccatcagtttctaaatacatgctgagctaggcaggggcacagagcactgttgcttcatgatgaaaaactgacgcaagtctttttttcattcactttctggatgcctgctgaattaatcatcttctctatttaatgtgaattcatgttatttaggtgcaatacaggtcagtacaattctgcttgtgagggcaaaaagacacaaacatatgcacattgcataataagttatgacaattcagtccttaataaattgatttctatcaatacagcactgctgtgatatcaggcaggccggctacactctcgtacaccagcaggaaaggcctggcccatttacaacttgctaaccttaactcccatttacacctgccagcggcctgcagcttgcaccattcgttgcgtcctctcctccctctatgagctggaccacgccatgcttcctcccttctccaacgttgccactcctatctcctccattctcaagcgccatcggcgccagcccctggccctctccagcaccacctgcctccagtcccttctttggcgagtctatctagcagggtcacgtctgcaattctgtccccttcccctagtacgatttattcccgtccccttcctctccctctagcaagtgaaccggcagcgccgagcccgggaccaccagatccgctcaacctgagcgctatggtgctctttgagcagcagcagcaacaaaacagccaacaagcggtgcgttgtggtggaattgaccatggcggaaggattcaagcattggcgaagcacgctcagctaccgtgctgccccgccaaattgacaaacagtggtgagtctctgcactgctgtacaaatacagtggcatcagaagctggcgccctgccagatccaagcatgggcggcacaattcctgttgcgagttccatgggcaatgtccaaggcaaggaggtgaacgggggagtaggcgaggattcccgttcccctcctatggatctgtggtccccacatgtcagaaggttggtggcagaaccaccaccaccaccactaacatttaaagtagtatagatttcttgtacttggtgggtgcatttccaatgctaccttttgcatatttaaattaagagaaaatctattctatgccattgagtttgtcctggttcaacaatttgccattgactacctctttctataacataccactgagcatatcaattgttctacaatatttcttagaaaaatgcctttatagacataagattaacaatcgatttatcccatccgaaatttcaaaaaataatgatgttgttttgtgtagcctcgttacgcagcataatagtttgtttataagtttcaaatttttgcattactattattttataagatataatttatgtgttatatgctacttcctccgtttcacaatgtaagactttctagcattgctcacattcatttagatgttaatgaatctagacatatgtatgtgtttagattcattaacatctacatatatgtgggcaatgctagaaagtcttacattgtgaaacggagggagtacatagaatacttttttgctgctgtttttgatgtaaatcatctaccatgtgttacacaaaatatttttatagtattatcttttgtttaagcaattactcatgtaccacacaaaagtaactttttaaaaggacgcgactacagggagcgcatgcactcgttagtgctaaccagcgaccatcttttttaccaaaatagtacagtgggtatcaactcgttacccttcttaatagcacctgccacttgcatcctcattgcccatctaaattccaaataaaatttttctcttaaattatttgtcggatctacgatccgattacaccattgtgctcgttgcaattaaatctgtacaacaagatcttacatgattatattatgatgaaaaaattatttatgtttgtaaactacttttattatatactaagttacttttatcatatatataaattacttttagatttgattaaattacttcctatacattcataatgctatgaggtgattacttttattattattttagtcaattccataatttgtgctgattaatttagtttctagatagagttatgtttttatactacaacggatttacttctaatgtcatgacaaaattactttctttttgtctcaagttacttctataatatatgtaaattacttttagactttattgaatttacttttatatgtctaagaagtaatttagtgaaatctaaaagtaatttagatatattataaaagtaatttgtaaattttcatcgtaatataatcatgtgagatcttattgtaaagatttaattgcaagttgcaacgaacacaatggtgtaattggattgtagatcagataagtaatttgagagaattttataagaagggaaaaaagacatggatgcctaacactccgatgcttctctcaaattgtaaactctgatgcttctcgactaaatcggatggccgcgccagtcgtcgctgtgtaagaccagatcgagaggcctctcgttatagattttacgtttttaaaaatattaaaaaagaaaaaagtcttaaaacatttacccaaacttctttgtcatgcaaggagaccaaacggaaaatttcataattttttggaactgctattggtgtcaatcaattgccaacccttgtatgtatataagggcagtttggttattctttcaaaaatagctgggcacactgtagaaacaattgacgaactcggtggcatattgtagaaagggataaagtcgatggcaaattgttggacctaggaagttgataaactcagtgacgtagagtagagactcttaaattaactgatagccatgagcctacggacagaaatatttagtaagtttttgacccaatgaatggtgcaataagctgcaaaggttacagaaaatttgtataattaatttttaaatttgaattcaatgtctgcttgtacattgtcttgatttcatgtgcttgcaatgttatgtattatttgtacatttcaatccatatttaggctatcctagattacaggaactcaatttgtaatactattttgcatttcaacatgcataagctggcaatttgcaataatgtgcactgctttctttaatggttgtggtgtctgaataatcctctgagattgtttctgtaacaggtcaaaaacttcgttttgtttggtgatattcataaaagcatttattttctgagctggaaagagcaaggttctcaattgagtctcctggcaaaagattttggatcactcgattgctttgcaactgagttcttaattgatggaagcacgctgagccttgtagcttcagattctgataagaatgtgcaggtcattttctttctcataattcttttcatgcatcagctctttttattcgagtttcatactacctccatcccaaaaaggcttcatttttgcctatcccatacaaaccaatacaaagtgaaaatactagaatgtctcccacttaggtctcgcttgaatctgctgaaaaaggggataaaaatttggatactcgtggaacgcttttcaaactgctaaacggtgcatttcatgcgaaaactttctatatgaaagttgctctaacttatcagattaatctatttttcaagtttgtaattaatcatactttaataccacctcattttacgtgaaacacttaatcttcattttcatcttcatcttcatctttacgtgaaacacttaaactccatgcgttgattgcttcaaagatagtctttttgggacacatggaaggcggcaaaaatgaagtctttgtgggacggagggagtacattattggcttacatttacgatttaatccatctggctagctctctagcaatgagattttgtgttgtcacttgtgtgtgtttcatgggatattattatgttcgtcagggtccaagatagcatccagtaattgcttcttttagaagtaaacaaaacaactggacaaacattttctcctagaactcctagtgataataatctggcctatatagtctgccatagacttgctattgaaaaataaactggtgatccggaatcttggtttggatcgttccggtgcataaaagttaagcttccctgcagcaaagatgagcaatagatcagatagatctgttctctggagctgcaatccaaaataagtgttttgagtcaattggtgaatatttgcagctttatgccaggagcagcagccagtggtggagctaggataaaattatagtgggggctaaaccaaagtgaccaataaaagttgaaacatgtctcatgtaaattggctatatgtctaatacaaagtataaatatatgtcattaacgaaaaataacatcatccataccaaagcaatatttaaatgtccaatagatgatgacatgatttgcgacactagtacaccctatcgccaattattcttcatcaggggtaatctatacaaaagaaatgtcaaattaatgaataatgacaattgacaaacaatagcttcaaataatttaaagacttaggtagggaatggaggcatggagcatatcactaaattatttgtaggcagtaacatccgacgttttttcatatcttcaaaccttcgatgattttttcattactaatacttctaaaaatatgcttctcagtatagcatatcatcaagtcattcagccattcatcccccattttgtttctcaaatctgtctttataagagacatggctgaaaaaatcctctcaactgaagccgttgccaccggaagtatcaatactaactcaatgagcctatacactaatggaaaagttcttttcttcctgtttgaacattaattctaccctaggcctctttgactgacttgcaatctcattattgagtggaggatcgctggtatttgtgttacttgaactagaataatatgtgagcagtgttctttttggcatcttcacaatctagcaatatagcagagtagcaaactaggaatcacaaacaaaattttcaattcaatatctctatgatttcttgaagacttgaactattaataacaactagtcttgacaattgaaattgattttaaataacaaatcagaaattttctatacctcatatcctcaagtacttggcctgctgctggcactgcttgcctgcttgctgctgccacccttggcggcttggcccttcgctgcttgcctgctagttgttgttgcacgcctgccagtggccagcaaccggcgtgcccgcgcgccgcgtgtttctgcagtgttatcgcgccgcgtccccccgcggccccgtcgccactctgcgtttatgcctggaggcgctagtttgccggctgccgccgcgcccgccgcatgcggtgccgtccctgcccccttgcgcgtttccgcctctctctacgcgagcagcacgacggcgcctctgcagcaagagccaagagcgaccgagggagatgagatttacggttgggtaaggttttttttgggtcttctcagccttttgggccttctaaaaatctcagacaaagtctatttaagttccccttcctatagatatatggattagaattttaggggagtattatg

SEQ ID NO: 74397 - DNA, 1134 bp, Oryza sativa
ttggaaggctgcgcaagacggacgtccaaccgatctttgataaaatagcaaaccgggtcaccggctggaggggaaaaaacatcaggccagcagggcgatcaactctagtcaagtcggtactgactgcgcagcctatctatttgctcactgccctcaagatctctaaggaagccttgggcgttctagatgcaaagagaagaaaattcctctgggtagggacgggggacattacaggagggaaatgcaaggtgaactggaaaaggacgtgcctcccaaccgcactaggaggactaggggttctgaacatggagatgtttacgagggccttgcgactgagatggctctggcatgaatggaaagaccccaccaagccgtgggtgggactagagacaccgtgtgatgaaacggacaaacttctcttcgctgcagctaccaaaataacaataggggatggaaacacgatctacttttgggagtccgcctggctggacgggcaaagaccaaaggacaacatgccgctcgtctatgctatttccaagaaaagaagcaaatcgctacgtgaaggcattgaaaatgacacctgcatcgatgacctggagctaaatgggaacactacttttacactggagctgatcagccagcttgtgtccctatggagcgcaacccaggacatcatgctaaaccaaaatgagtcggatcacatcgtctggaagctctcgaatcatggagaatactcggcctcttcggcatacaaggctcagtgtctaggaacagtcggcaccaacttcaatcccctaatttggaaatcttgggcccctgcaaaatgcaaattttatgcgtggcttgtgattcaaaatagagtttggacttccgatcgactagctacaagaggatggccgaatagcggagtgtgccccctatgccgtatgacgaacgagacggtatgccaccttttagcttcctgtagatacaccagaaggatctggagactgacggccaactgggtggcttatcagcaattgggagccatgccaaagcgtacacgaatggtgggaaatgctagccaacaaaagggaagtgcccaagaaagggctgcgatccttaatcctactcatagcctaggaaatctggaaa

SEQ ID NO: 74398 - DNA, 793 bp, Oryza sativa
atcgcaagaaaacaaaagcagagaacatatataaaccgggcgatctcgatctcgatcatctgcaaatgcttaacaaataataacagtagtagcaatccaaagccaacgccctgcaattatatgtgcgcatatgtggatcgcccttccctttccggtcgctgggctttatccgccctcgcccatttaacaatccggcgcgcgggacacctgtcgccggctcgccgcgcgactagcgcgccgtggccgcgggcgacagcgacgccgcgcgtaaactaatcggccgcgggagcttgcccgaaatggcagccattgaacgccggaatagtttagtctccccgcgagcgcgcctcgccagaaagcaacgagccgtacgtcgacgtagcagcggacagcgcgcgcggatggtgggtgtgggtgtgggtcgtggcgtggtgtgcgacggcaaacgtcctggcagggccgtgtggcgtgtggcgagagagagggaccgaatgcgtgagccaggtgggcgcgcgggctggagcagcgcgtcgcatcgatcccactcgccgtgacagctacgccggagataaaataaaccggctgaatcgatcgcccggccgtggctaagctagccgtgtaggaccaagctacttacgggctaggctacagggctctacgtggaggcgagggggctctccggtcttgccggccagccggccaggacggcatcgtgaggctgtgacaaagatgccctttgctcggtccccggttaatttagtgaggtctaaagagaagagtaaaagaacatccc

SEQ ID NO: 74399 - DNA, 703 bp, Oryza sativa
catttgtttcctttgtcttgttttttaataattgacagcattgagtcctattcgtactatccatttgttagatttattttcaatagtactattataatagtatagagttcaaatattcttaaatttattattattattgaagtagtggttaaagcttatatagctcagtcaacgatgtttaattattgaaaaacgaaccccactgtctagttaataattacagtatctggcaccatttcatcaactgaaacaagttgtgacatgcagatcttctattacgctccaaaaatggttgagagctggaaggggcagaagctcctctccagagcagaatttcatgtcggagcccatataacgaagtttttgaggctgcaaatgcttcctactcagggcttatcgtctgaaaagacaaatcgtttcgctcttctttttggcaatctggatggtggcattggatgcattgcgcctattgatgagctaacattccgacggctgcaaagcttacagaggaagcttgtagatgctgtcccacatgtgtgtggcttgaatccaaggtcattcaggcagtttcattctaatgggaagggacatcgtcctggaccagataacatcattgacttcgaacttcttgcacagtaagtttaccttcatatgagcttgattattttcccatttgcttttgggttcttatgttcgctgcaca

SEQ ID NO: 74400 - DNA, 879 bp, Oryza sativa
cttaagcttatggagaagggcgagcaattcattcatatttcaggttttcaacaagttgcttgtactagttagttgtgctaggtatcctgtgtaaattctttcaagcctaaccttgcagcatacgcatttgaaagaaatgatttttgtataatgaaaatcgaccaaattatgaatgaaaaattatattttgttacagaaaaatgatattctgaactaaaatagtatggttatttgactctgctattacacagtataactgtttgtttgatctgataaatgcaagcacttgcagataataaatgatgaagacgggggcctgcagaaacggtatccttctccatcattgcgtgagaagggtgtccaactttctcatgcttcatctcatgcaagtggtacacatttagccggatacagcacttcagctattgttgcgatggacaagagtgcagctatttcttctgaatcatctctttcgtcaagaagtcttctgtcgcagtcaaagaaaataggtagaactgctgaaagaagcatagagagcgttctcagttcaagtaaacaaaaggtttctgccattgaaagtttattgaagggtgtaagcggccggcaaaatttctcagctatgcgctcaacaagcttggatcttggtattctttaagctgcttaattggagtttgctctttcattatgtagtttaaaattcttagctattgctttccgacttatattataaatacttaagaaatctcaatttcttttttcttttcctcctagtgcaggagttgatcctccatcctctcgtgatcctcctatcccacttgctgcaactgcttcggaccatctgtctttgcagaattccatattgctggattcatccctgcc

SEQ ID NO: 74401 - DNA, 1678 bp, Oryza sativa
atattctatttgacacaacaaaactttacacccctagatctaaacacaggcttaatgtatcccatttccgttctgcaaataggtcgaacagaacatggcttttgtattgctgcaggctcttgaagttgagaccttcttgttgccttatgccgttgagtggaatgatccaaagaatcgcgagtgcatttactgaacactgctgcagtagtacccaagatgaagccatcatccgtgccttgctactgctagtctggctcttcgcgtcggagaaacgagaaaggtggagtttttcaccgtcggagaaagagcacatttgcctgtgctttgcctgcctgctgagctagtccattgtcaccgtgatttggctgtgtttagctcacgctaaaattgaaagtttggttgaaattcgaacgatgtaacgaaaaaatttaaagtttatgtgtgtaggaaagttttgatgtgatgaaaaagttagaagttttaagaaaaatttagatctaaacacggtgtttgttgaactggacacaagaaattcttccagaattagtgattcttcgtaggaccagtatcatcgtcttcatgccgtcctaaaagtgagaaaaggcttcccgatctggtgatacacgagttgaacaatcaacctgtactctttcgccgatcgattgctcctgacatgttttgggtagcagtacaataatactgcggtgatcaatgcagatctgtagctggcacagcgtcggggagattgtcgcgacgaacgcgcgatgttcgtgacggtgagttagctgcgagccacggcgctacgcaggagaaaatggtggctgcgccgtcgcgcggtgcgacccggaccgtgaaaaccgtatgtttatcatgaggattatcaaaaactaagaagattacggtacgcgataatcatgataactcacgctgttttgtaaaccactagccaatttgcacttagcattattatccaggagggcatacggatcggacgaccgatcatgacattagcgtccgatttacgtgcaaaactactttaaattgatttttctcttaaattacttatccaaatcatgatccgattgcaccattaaattcgttgcaattaaatcttcaaaacaagattacacatggatatattccgacgaaaaaagattagcttattattgaattttttataaatgttgcacgatgttccaccagctatatcggaattgtctcactaggtgattgaaaatgtttcactcgtttaaatcgggtgttgtttcaccttatataaaaacaatgtttcagcaaatagcgaaaaaatatttcagttcactgcaacattatatctatatatagtgaaacattgtgattacattaggtgaaacatttttcggtgaaacaaaaaataaaccaaattctcttaatagggggtttccaaaatatgtgggtttttttgttgcaatagaatatttcgttcactgcaacattagatctatacatagtaaaacattgtgagtacactaggtaaaatattttttatggaaaaaaataaaccaaatttcctaatagaaaggtttcccaaaatatgtgcgttttttgttgcaaaagagtatttaaattactggaacatttagatctataaatagtgacccattataaatacattaggtgaaacgtctattgtggaaaa

SEQ ID NO: 74402 - DNA, 1783 bp, Oryza sativa
cgaacttttgtcaattaaagccaatattggcacacgtgggtgcgatgtttttgaccggaatgaaaaatttcaaaaactaccgaagtatgatttttggacatattggagtgtattggatgcgttcgtggcaaaaagtcacttcgtgattcgcgcggcgatcttttgtcaattaatgccagtattaggatacacacgtgggtgcgatctttttgaccggaatgaaaaagttcaaaaagcactaaaacaatattttcgcacatattatagtgtattgggtgcaatcattgaacaaagtcacttcctgattcgcgcagccatcttttgtcaattaatgccaatattaggatacacatgtgggtgtgatgtttttgaccggaatgaaaaagatcaaaaagcaccaaaacaagatttttggacatattccagtgtattgggtgcgttcgtggcaaataatcaccccgtgattcgcatggcgaacttttgtcaattaatgccgatattggtatatattggcggacctgggtgcgaagattttaaccagaaagaaaaagttcaaaaagcaccaaaacaagatttttggacatattggagtgtattgggtgcgttcgttgcaaaaagtcacttcgtgattcgcgcggcgatcttttgtcagttaatgccaatattggcacacatgggtgcggtgtttttgaccggaatgaaaaagctcaaaaagcaccaaaacatgatttttgcacatattggagtctattgggtgcgttcgtggcaaaaaatcactccgtgattcgcgcggcgaacttttgtcaattaatgccaatattggcatatgtttgcacacgtcggtgcgaagattttaaccggaatgaaaaagttcaaaaagcaccaaaacatgatttttggacatattggagtgtattggttgcgttccttccaaaaaatcactccgtgattcgcgtggcgaacttttgtcaattaatgccaatattggtgggatacacacgtgggtgtgatgtttttgaccggaatgaaaaagtttaaaaagcaccaaaacatgatttttggacatattggagtgtattgggtgcaatggttgcaaaaagtcacttcgtgattcgcgcggcgatcttttgtcacttcaagaagcaccaaaacaattttttggacatattataagtgtattgggtgcgttcgtggcaaaaagtcacttcgtgattcgcgcggtgatgcagcaacgggggttcccgatctttcgatgagaggaggataaactacgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatatagttggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaacttgatggtgaggccacatatagctgaaagt

SEQ ID NO: 74403 - DNA, 23395 bp, Oryza sativa
taattgagcaaagattggcttgattaatcagttgattgattagcttgctcttggccatggccaaaccattagatttgccgttgttgctgataccggtcatggttgttatcctcatcagcgtgtcatttgcccaaacaaatgtcacttcgggcgcctccgtgcaggccgtcgccggcgccggctggtcctcgccgtcgggccactttgtcttcggcttctacgccaccgacggcggcctcgccgtgggcgtctggctcgccaccgcgcccagcataacggtgacgtggacggcgagccgcaacgacacgccggccaccggcggcgcgctgcggctcacctacgacggccgcctgctctggaccggcgcgaacggccaggacaggaccgtcgccgcgccgccccagccggccgtcgcggcggccatgcgcgacgacggcaacttcgtgctgtacgccgcgaacgcgacggtggcgtggtcgacgttcgcggcgccgaccgacaccctgctcgccggccaggacctcgcccccggcgcacagctcttctcgagcgtctccgccacgagcagggccaccggcaagtaccggctgaccaaccagctcaacgacggcaacctcgtcatgtacccggcgggcaccatgaacgtcgccgccgccgcgtactgggacaccggcacgttccagataggcttccccctcaccttgcgcctcgatgccagcggcgtgctctacctcgtcggcaacaatggcagctacaccaagaacttgacgaaggccagtgcagctcaagccgtagagcaagctcactaccaccgcgtcacgcttgatcccgacggcgtcttgcgttcgtatcgccatggattgctgtcgagcggcgggtggaagaccgacgtcgagtggatcgggccgagcgatcggtgccatgtcaagggcgcctgcgggttcaacagctactgcgtgcttgatcgcgacgcgcagcccagctgcttgtgcccgccggggttcgatttgatcgacgccggcgacgccgcgggcgggtgcacggcgagctccggcgccggcgagtgcacggggggcagagagccgaccctggttcgtccatggcgaccatgcagaacgtgtcgtgggcggacacgccgtgcggggtgctggccgcgggcacgagcgccgccgactgccaggcggcgtgcatgtcagactgcttctgcgtcgccgcgctgctcgacaccaacgacggcacgtgcacgaagcagcagctcccacttcgatacggccgcgcgggcggcggctacacgatgttcgtcaagaccggtggagcggcgagcccggcgctcggcggcggcggcggcggcaaccaccaccaccaccgcctcaggcgagcgagcaccgtcgcgctggtctgcgtcgggctcctgacgttcgtcgcgctgtgcgccctcctcgcgtcggcgcggctgctctggctgaaccagaggatggtgcgacggcgcgtcgcgctcgccgacgccgaggccctggacgaggaggcgccgctccgctcgtacagctacgaggagctggagcacgcgacgtacagcttccgacaccccctcggccgcggcgcgttcggcacggtgttcaaggggacgctgcggcgcggcggagagaggaccgtcgccgtgaagcggctggagaagctggtggaggacggcgagcgtgagttccagagggaggtgcgcgccacgtgggcgccaaccgcctcctcgtctacgactacatgagcaacggctccctcgccgacttcctcttcaacagcggcggcggcggctacctgttgagttgtgatccaaattcaattgcacttaataaagaccagcttctaccgtagtggagcggaggcccgtcgccgggaggttggggcgaaacggatcgtcatcctttttagggttccaccatatatatatatacacatcttgtaagccgccgtgcggcgttgtaacctcaccccatatatagtggagatattttgctggctggcgcccgtggttttttctctcctgttttgggagggttttccacgttaaatctcgtgtcttctgtgattgatctattgttctttatcgtttgttcgcttatcgtttcctaacaagtggtattagagcttgttcccacattagggtttcgcgatggcgtcgatgaagtatgatctaccgctgctagactataagacgagattctcgttgtggcaagtcaagatgcgggttgttctagcacaaacttcggatcttgatgaggcgctggaaagcttcgggaagaagaaatcgactgaatggaccgctatggagaagcggaaagatcgtaaggctctgtcgctgatccaacttcatctatctaatgatattttgcaagaagtgttgtaggaaaagactgctacagaactttggctcaaactggaatcgatttgcatgtctaaagatctaaccagtaagatgcatatcaagatgaagttgttctcgcacaagttgtaggagagtggttctgtgttgaaccatatatcggtcttcaaggagatcgttgccgacctagtgtcgatggaggtacagtttgatgatgaagatttaggtcttttactgttatgctcactgcctagttcatatgcaaattttcgtgacaccatacttttaagccgtgatgaactaaccctagcggaagtttatgaggcgctccaaaatagggaaaagatgaaaggtatggttcagtctaatgcgtcgtcctctaagggcgaagcattgcaggtcagaggcagatctgagcagagaacctacaacgacaacaatgatcgtgacaagagccaaagtagaggccgttccaagtccagaggtaaaaagttctgtaagtattgcaaaaagaaaaatcacttcattgaagaatgttggaagctacagaataaggagaaaaggaaatctgatggtaaggcctctgttgttaccagtgctgaaaactctgattcaggagattgtcttgtcgtttttgctggttgtgttgctagttatgatgaatggattcttgatactgcatgttcgtttcatatctgcattaacagagattggtttagttcttacaagtctgtgcagaatagagatgttgtgcgcatgggagatgataacccacgtgagattgtgggcattggctccgtacagatcaagatacatgatggcatgacacgcacgctaaaagatgtgagacacataccagggatggcgagaaatctcatctctctcagcacacttgatgcagaaggatacaaatactctggttcaggtggagttgtaaaggtatcgaaaggttctctcgtttatatgattggtgatatgaattctacaaacttatatgtccttagaggaagtacattacatggttttgttaccgctgctgctgtttctaaagatgaacctagtaagactaacctgtggcatatgcatcttggacatatgagtgaacttggtatgacagaattgatgaagaggaacctgctggatggctgtactcagggtaacatgaagttctgtgagcactgtgtttttggtaagcacaagagggtaaaattcaatacctcagttcatcgcaccaaaggtatacttgattatgtacatgctgatttgtgggggccttctcgtaagccctctcttggtggtgctcgttatatgcttaccattattgatgattactctagaagagtgtggccttatttcctgaaacataaagatgatacatttgctgcttttaaagagtggaaagtcatgatagaaaggcaaactgaaaaggaggtaaaagtacttcgcactgacaatggtggtgaattttgttcggatgcttttgatgattactgcaggaaggaaggcatcgttaggcatcacaccatcccgtacactccacagcagaatggtgtggctgagcgcatgaacagaacaatcatctccaaggctcgttgtatgctgtccaacgttcacatgaacaagcgtttttgggcagaggctgctaacaccgcctgctacttgatcaacatgtcgccttctatcccacttaataagaaaactcctattggggtatggtctggtatgcccgctaattattcacagttgagagtttttggatgcactgcttatgctcatgttgataatggaaaattagagcctagagctattaagtgtctgtttcttggttatggttcaggagtaaaaggatataagttatggaatcctgaaactaataagacattcatgagcaggagtgttgttttcaatgaatctgttatgtttaatgacagcttgcccacagatgtcataccaggtggttctgatgaggagcagcaatatgttagcgtgcaggtggagcacgtggatgatcaggaaactgaaattgttggtaatgatgttaatgatattgttcagcactcacctcctgttttgcagccacaagatgaacctattgcacatcgcagaacaaagaggagttgtggagctccagtccgccttattgaggaatgtgatatggtttattatgcttttagttgtgctgaacaggtggagaatactcttgagccagccacatatattgaagctgttgtttctggagaccgtgagaagtggatctcagctatgcaggaggagatgcagtctcttgagaagaatggcacatgggagcttgtgcactttccaaaatagaagaagcctgttcgttgtaaatggatcttcaagagaaaggagggcttatctcctagtgagcctccgaggtttaaggcaaggttagtagcaaaaggtttcagtcaaattgctggtgttgattataatgatgtgttctctccagttgtaaagcatagttcaattcgcacattcttcagtattgttgctatgcatgatcttgagcttgagcagttagatgtgaagacaacatttttacatggagagcttgaggaggagatatacatggaccagccagaagggttcatagtacctggtaaggaggattatgtttgcaagttgaaaagatctttgtatggtttgaaacagtctcctcgtcaatggtataaaaggtttgattcatttatgttgtcacatggctttaagaggtctgaatttgatagctgtgtgtatattaaatttgttaatggatcacctatatacttgctgttatatgttgatgatatgctgattgctgccaagagcaaggaacaaatcactacattgaagaaacagttgagtagtgagtttgatatgaaggatcttggtgctgctaagaaaattctaggtatggaaatcactagagacagaaattctggtttgttatttcttagtcagcaaagctacattaagaaggtcttcagcgttttaacatgcatgatgcaaagcctgttagtactcctattgcacctcattttaaattatcagctttacaatgtgctagtactgatgaggatgtagaatacatgtctagagttccatattctagtgctgtgggttctttgatgtatgccatagtttgctcccgtccagatttatctcatgctatgagtttggttagtagatacatggctaatcctggtaaagaacactggaaagctgttcagtggattttcaggtacctcataggcacagctgatgcttgcttgaagtttggcaggactgataaggggcttgttgaatatgtggattctgattttgctgcagatttggataagagaaggtcactcacaggttatgtgtttaccattggcagttgtgctgtgagttggaatgcaacattgcagcctgttgttgcccagtctaccactgaagcagaatacatggctactgctgaagcatgtaaagaatcagtttggttgaaaggattgtttgctgagctttgtggagttgattcttgcattaacttgttttgtgatagtcaaagtgctatatgccttactaaagatcagatgtttcatgagaggacaaagcacattgatatcaagtaccattatgttcgcgatgtagtcgcgcaaggtaagctaaaggtatgcaagataagtactcatgataatcctgctgatatgatgataaagcatgttcctgttgctaagtttgagctttgctcaagcttagttggtatagtggtttagcccaagaggctatttggcgccgaaagtgttttttgtctttgttgtgttcagggtgaaggattggttcatgctacaagaaggaatttgtctcaaggtggagtttgttgagttgtgatccaaattcatttgcacttaataaaggccagcttctgccgtagtggagcggaggcccgtcgccgggaggcttgggcgaaacggatcgtcatcccttttagggttctaccatatatatacctcttgtaagccgtcgtgcggcgttgtaacctcaccccagatatagtgaagatattttgctggctagcgcccgtggttttttctctcctgttttgggagggttttccacgttaaatctcgtgtcttctgtgattgatctattgttctttatcgtttgttcgcatatcggtcgcgctcgacgtggcgcggggtctccactacctccacgacgagctcgacagctgggtgatccactgcgacgtgaagccgcagaacatcctgatggacgcggccggcacgacgaagatctccgacttcgggctggccaagctgctccagcccgaccagacgcgcaccttcaccagcgtgcgtggcacgcgcgggtacctcgcgtcggagtggtaccgcggcgccggcccggtgatggtgaaggccgacgtgtacagctacggcgtggtgctgctcgagacggtggcgtgcaggaggagcatggagatggaggaggccgccggcgaggaggagcggacgctggcggagtgggcgtacgagtggctgctggtgaagagcgaggcaaagagcgccatgagcagcgacgagacggtggaggcggcagaggtggagagggtggtgagggtggccatgtggtgcgtccaagcggagccgcagtctcggccatccatgaatggtgtcatcttgatgctgcaaggccgtttggaggtgccatttcctcctcctcctccagcttcttcttaagatgctactactaacatcgttgcaactccagctatatatctaaagttgttactaatcgggccttgcaattgaagttgtgttgcatgaatgtgctaatctacgttgataaagtgacaagggcttgagtgatcagttaatcgaacggctgggttggtacagccgttgcatcttgtgaagctgaagtacgtgtatgtgggatacacatgcaggtgtttgattgcttgcatgacatatagctggatatgataaaatgttgtttggttggttgtagcaaagggaggatgggatggttgcatacaagatatgttgtttagttggatgggtacatcttgtgtgtagatacttgttcttatgggtggtgaggttacccctaaaagcttttggagcaagatttttttccaagtcttaaatctgtttatgggtggtaaggttaatccgtagtagagttttactgatatggtcatatttaagaacccaacaatcgcatattcatcccctctagtcgatatctcgatccaacatagcctcctccgtgcgagagcggtgttgcgctaacatccaagtcctaaatctgtttatgggtggtaaggttaatccgtagcagagttttactgatatggtcatattttaagaacccaacaatcgcatattcaccccctctagtcgatatctcgatccaacatagcctcctccgtgcgagaacggtgttgcgctaacctcgcctcaccggcgtcacttgcaaggtattggagatatgaatagttaatataggggagaatatactaacatgtgtgtcaacctatttttaaaatattacttttgttgaataaactgccacgtagaaccaaaaccactcctgatttatttagtgggtaactcgttccatttgaagaattaggggtgtgaaatgtttggtatttaatttgggagggataattcgtttatagtcttgaggtgtaattcaatttattttcctttacgacccaaataatgctatacaattacattcagcggacatagcatgacattttccacaaaaaagctcatcatgagtccacatatatatcgacaatttgggtccttaaataactttgcgattggtgcagaaaccagatcacccagatattcacaataagaatgtaccactaattaaatttctgagaaaaaaactatcttaaattcatagtttggaactgttattaaatattaaccactaaccacaagtaggtcataatatcttactaacactacggaatacagtacaagatcaaatagtgttatgatgaatataatcagaactacttacagtgtccagagggactaggcgttgatagtcatccagggaagcaagcaagcagtattcagggcgaaaggaccaatctaatatgccatcttcctcagagtgcttaaaatatccatgcttctgaagaagccgcagcttactgccatcatccttaatgcatagttatccttatccaggagaacatacagaaggcaataatcctccttcagcttatcgtcaccatgctgcttgttcttctgtagtcgctgttttgacaagtgatgatgatggcaatgagattgatcagaaaagatattattattattcaatgaaaataattggaggttagtgaaaccaacaaacataagtagaagtattacgagtagaagtattacatgtaagtatttataccttatagtatttgaggcgatacagtgcgtggcgaatgtagaggtctgttcaccttgcagcttagtcttgggtcaggacgaggaggcccgtgaggcagatttccgagacaagcaaggcactcctcgccgatgctctctcaaaaaccccagctcgtcccaaaaccccccagctcgtccattcttctttttcttctacttttctgtccatcgtccactgtagctaactactccctatgtcccataaaaaaaatctagtactgtgatacatcctagtacaactaatctagacatacatttgttcagattcgttgtactaaaatatatcatatctagtcctatattcactttttttttatagagggagtaacttgtaaaatcttgtgattttcccgatgcttggcggcaaatatgattctttacaacaaccttgtgcacatctagttggtgtgatttcgatcggcaatagctagttgtgtgttagtgatgaactctcgtcgagatcgaccacagctctcgcgaatttcaccgtggaactcaacaaggcatcactaatctctaataccgaaatttgtgcaaaactctagcagctgctcgtgccatgtggcttaactggtttcgccggaaagagctcctacctcgcacttgtgttggcgtgacttttgctaaaaaataggcccacggacaactgcaaaattaacaggccgtgcaaaatatgaaatatcactggacgattctagagaaatcagaaagaatcccttgcaaaatatggaatatcactagacgattctagagaaatcagaaagaatccagatttaccacaaccagccatacatgtggtcaacctttaataatattataacacaaattctgtataaattaatcgttggcgcacgtcttcactcacggaatcggtctccacgcaatattgccatatatgcggtcaatctctaatcttataacacgaattttgtgcaaatttgccgcccggcacgctgattttctaggcatcgctaatctcttactatcgaaatccgtgcaaattatcgagcaattagcgatgccacgtggcacagcgtggttcgtgcgtgcgctcccacacttgagaaggactaaaatataaaaaacaatcttacgttggagtaaaatcaaaaagtgcaaagccacctgatgtttccggaagggtcacgactcttggtcttctacaatcttgattcactcttcatcttctataatcgttcctcttttctcttgtcattgtttcacattcattctccatcttgtctgatccaccgggagaaagaggtagcgacctccggccggtacctctgcggcaagcatgtcctgcacagagacaacaccacgaggaggaggcggtggccttcggccggtatctctgcggcgagcacgtcctgcaccgcgaggacgacgttggcgagttcagtgaatggcaatcacatgtattagtgatataaatattgcagatttttcattcttaaaaaaaaaccagctagatctgttacttcactgatatatattagactatttgttatagtataagttattgggaatggaagcattcggaaagaagttttactgtccctttgttattgtaaacgcataatgaggaccatcttcattaagaagatagaacccttgtagaatatattttgtttagtgatgctggtactactcctactctaccaagttccaatatcatgaggttttctgtttttgtttgacaatttcgccaatgattaattataacatttgaattttatttgttaagtctttgcttagctccagctttggggcttgtattgactaggagactacccatgcataagaagtttcagactttcagttggttaacttaatttaattcctcgaatatttattcctgtgattatctggtggttaaatttctctgttctgccactatagtgaaaaattgacacacttaatttagtgagaaccaccccaagatattcagagcatggaagctgagccatgtaatttagagacaagcagtttgtcaggcaaaagagcttatgaagatccgaacagtaatgatcaggtaaacaattgctcatatttaaaatcatttgtttttcaatcatataattaacctactactgtactgtgcataagcttggcaccatttcaagcaagtgtattaccttatatggctgcttcaatttcacggttacctaccagataccctgtttacatgtagtattcacatatatacctgacactacatagaaacctcatacttgcccaacctagctactgcatcgtgttaagtactgcatgagaaagaattgctggttcctcagtaacatactttgacaaggattctaattattgttttttttgggaaaataatgaagaagaaaacactgacttttgctatttatagcccaagctggatacttttgttatcctctcatctaccagccaatttatttttgatgtatttagcactcaccaagaacctacactcatctactttccagttactctaatacaaaattgatagggagctttattaaaatcttccattatttaagttccagatcaaatgtctataatatgtcacatactcataccccgcggcgttgctgcggaaaattaagttgcataatatgtacaaaactaaaaacaatttgatacaattttgagcctaaaagtaattgagattgcatgtttttaagagagaagaaagaagaaataatttagaccatagatctatcatccaaaggctagaaataattagggtgatgtgggttaatgagaagagagaaatagcattaactacacttaatggagatgaactatataagtatataggataactattgtgttttgttcagattatacagtctatatcacattatatgccatagattaatttttaaaatttaatactctgctgtagtaatcatgattgtgcaatatagtattttgctacaacttgcattgttgttaaactgatcattctgtctcaatacgaccaaatagtgtggcccatcgagtgttgcacgcgtgtttttttctagtctactaatctaaagctggccattctttctaagtttgattggtccacgtggcgccgtattttgcgaagtgactcgtgaatacgcatctctagctagcagcggtttaaactggacgtaacaccggcaaaaaggaaaaaaaaaaggaagaacgggcgcacgcacagggctgaggttgacaccgagctgtgggctatacagcccaatcatgtgtacctgggctggtcgtttcatgctgttcatgctagaattcgcacgttggacgttggctcctcgtggccactaacaggcacccatgagcaaacagaaataggagaagaaatagtagggaaaaataaatacaaataatttcgtaaaaatatttgaatatataaaaaacatcataaaaaataaacgaaagaagtaattttggcacccctaattacatgtttgtcacaattaacataatttggtttttctcattctttgacaaacacaaaattaaattcccgtaatatgtccttcttaaaggaatttctaagcgtgtgaaactactatgtaatgtacacccatacctatagacacaccacatacacatcctaccactactgtacccagggttttcaattttgaacagggtttttttttgccaggggttccgaattcacgaaatcaccaaaatttcggaagttttggtattttttggcctaaattatttgaaaatttaactaactttaaatgaatgtaaataaacttttaccaaattcacataaatttgcaaaaaaaaaggaaagtttcgggcaagatatgtgcttgccggtgggggcaaaattactgaaatttccgaaatttgttccgaaatttcaatccatatttgtccctttgaagattaaatcatcattcatatctaggaattgataatggctggtacatcacctaccactgaaaaaacaaatagctgtaaataagaccacacatgttaactctataccttaatcctgaatagacatgttccaccacacggaatgtaaccaaccgatctacacttagtatatcctggatatataaaatcaagataagtatctttaccatgttggtgtcctttatttttatttctagaaaatgaaatgggtaatcaaatacacatttatttagatatgtatttcctactaattatgcaacatctatgacttacatgtataaaaaatgatgcatataaataaaacaagttttttcactaatatatatcatctttagccatttcctgaaattaaatagtcgttcagcatgacaagaccactaattagaattctgccttgatttgttccacaacattttacaaacaaaaaaatttaaaacccattaaataatccttttgaatatatggtttataaaagaaaatacacacgggctataaactaattggcgtgccaactgacatgcttattttctagtctatcttctaaagctggctcgtctcgagccatttcattgggtcacatggtggtgttaaattttaggttaaatctaaggaaattatgcataagaaaaaatagataaaagaaaagaaaagacacaaatccaatttctagagacttcatgtcacgccccgaactagtcccgaccggaactagcccgtgacgctccaaattaacctgttaattgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagaaactggagctaagccttgactaaactgcagcgggaacaccactccacaggcatcctcgacggcacggacgaagcctactcctcagggaagccttcatctgacacatacccgtcctctggggttgggaaaagtagagcaagactgagtactacccactgtactcagcaagtcataccggaataggggtatgatgcaggggattaacaaagaagagctagagtggttcatttgcataaaaactggcatttataaacaggaattgaatgcgaaaacggttgtaataattaagcagtattaaatctccgctgtccaacgctaacccacgttgcgacaggcccaaccatccacctaaactatccaagttcaacagattactctagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctataatctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaaaatgggatcaacatgttcaagtgacaagcatgacttgccttgctctgctgctggagggacctcggcgactatctcgaagtacaccggagcgtcggagggatcggaatctaacgacatacaaagcaaacattgcaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaaggggtggcggctcgcgggcccactggtcagtggcacggggaaaaggaggggcggcggcgccacgtggcggccgaaccgacggccccgatctacccaagggtagatcggacggcgacggggacctcgcggccggggcgcgcgggcgcggcgcgagacggcggcgaccatggcgccggcggcgcggcgctcacacggcggcggcgcgcatgcggcagcggcgcaaggcggcgaccgaaggcgaccgaccggcggcggggagcggcggctagaggaggagcggcgggcggcgataaatgcggccgccggcgcggctcggcatcaaagccgaccggccggctgggttaaacggcgacggcacgcgtgcgacgacggcggctaccggcggcacgggaaacggcggcggcagtcgaaggcgacggccgacgactcgaagcggcggctagcggctctaggaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcgatagaggtggcgctcacccgtgcgcgtggagatgagggctccggcgacgaacctcgacggaggaggggtggacgaggtggacctcgaccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggcgatgcttaaataggggatgggggaaccggacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagcgacggaggcgtgggcgcggcggcggtttcggcgcggcggtgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaggaggaaaaagggagggaaaagaaaaagaaaaaggaaaaggaaaaagggttttccctggaattaaaaattgcactttagtgatttttaattggttaaaattatttctagagctctgaaaattccactaaaaatcctgttaatgcatttcgacatgtagaattcaagaaaaattccacatgtcaaatccgattattatatgcattgttttcttagggttttatcctgatttcctctgcattttcttggggtcatttgtaatttacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccattgaactcggcaaaaccgggtgaccttgtttctggttctcctttcactggtatcaagtatgcgaaccggcttctccacatatgtcaggtcttcctggatatcaatgtgttccgaatcagcctgttcttcgggtacccttaagcacttctttaactgggaaacgtggaacacgtcatggatgccgatcatattggatggaagttctagctgataagcaacttctccccttcgttccaaaattttgtatggtcccacgaagcgtggtgccaacttgcctttcgtctggaaacggtgtactccccggagcggagtgacacgaagatacacgtagtctccggcctcaaaagttagctcccttcgacggttatccgcgtagctcttctgtcgagactgagcaatcctcaatctctccctgatgattctgactttctcttctgcttccgctaatacttctgttccgaacagttgacgttcgcctgtctgatcccagaagagaggtgtgcggcacttccggccgtatagagcttcaaacggtgccatctgtagactggcctggtagctgttgttgtacgagaattccgcatatggtaagcttttgtcccaagctccaccaaaatcaagagcgcaagctcttaacatatcttccaggatttgattgactcgctcggtctgaccatcagtttgcgggtgataggccgtgctgaaattcaaacgggtccccaattcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtgagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgctggcaaacattgcagagtgcgacgaattcagctatttctctcctcatgctgacccaccaaaacttctctttgaggtcttgatacattttagtgctgcctggatgaatggagtacggggtctgatgagcttcggtgagtatcagatccttcaattccttgtcgtccggtacacacaatctttctcccatccagattgtgccatgctcatcctcaaggaaatcccgagcctttccgactctcatgttctttttcagttctgctatttccggatcatttacttgagcggctctaacttgatccacgagcgtaggccgtgcctccagagcggctacgaacccgtgttcaacaattcccacgttgagatgctcaaactcctgccgcaattcctcacacatgccctcgatgcatagagcagtgcagtaacttttccggcttaaagcgtctgccaccacattggctttacccgggtggtagtgaatactcatgtcatagtctttgattagttccaaccatcttcgttgtcgaaggtttaggtctggttgggtgaagatgtatttcagactcttatggtccgtatatacttcgcagcggttgccgatcagatagtgcctccagatcttcaaagcatggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataaccagccagtcctagaaaacttcgaatctgcgacactgtcttcggtggggtccacttggtaactgactccacgttcgatggatcaactgctacaccctgagctgtaatgacatggcccagaaatttgacttccgtcaaccagaagtcacacttgctgaacttggcgtatagctggtgctccttcaacttctcgagtactagacggagatgttgttcatgttcttcctcggactttgaatagataagaatgtcgtcgatgaataccacaacaaacttgtccagaaattccatgaacactttgttcatcagattcatgaagaatgcgggtgcgttagtaagtccgaaggacataaccgtgcactcatatagcccgtaccgagtggtgaaggccgtcttcggaatatcctcttcccggattctcaactggtggtagcctgatcgcaggtctatcttagagaacactttagctcctttcagttgatcaaataaatcgtcgattcgcggcaaaggatatttattcttgattgtgacctcgttaagtgcgcgataatcgacgcacatcctctttgtcttatcctttttctccacaaaaatgaccggagcgccccaaggtgaagtgcttggtcgtatgtaccctttctgcagctgttcatcaacttgcttcttgacctctgctaattcgttggccgccatcctgtatggtctcttgtaaattggagcggttcctggtgccaaatcaatccggaattcaatctccctcttgggtggcatggtggtgaggtcttcggggaacacttctggatactcgcagactatgggtatgtcctccaattttctcaagttcttctcttcggtgtccactgggatttccgtctcaatctgattcaacgaggctcctttctttggcgagactagagatttgtacaccacggtttctcctttctcattggtcagggtgactgtgcgactcgcacaatcgatgactcccttaaacttggtcagccaatccatcccaagaatgacatctaggtctttggattcgagaaggatgaggttggctagaaacggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacgacctctggtgctgcttgtgcctcctccgcagatgcgtggttgacacgagcctggataaaccttggtccggcacgcctgggcttcgggcatttgtcagcgaagtggccaagctcgccacagttgaagcaggaccctggttttgctcccgtctccttcttggcttgtgcgggctggcctgactgtgccggtgccatcggtgggcgtggagctgcaccgcggttgggctggcctccatggtggttctgactgccactagtgccctggtggaagttgctagggttgaacgggcggtgctggcggacgatcatggtggtaggtccaccctgctgtccgggagtgaagcgcggtcggtgctgactaccttggttggaccggaactgcgccgcctttcttttcctgtccattttgttgcgctgatcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctgttgccctggtggagcgcccggaattccctcttcttttgtgccacgaccccatctggcacctgtgccttcctaaagctacggcagaactctgcccatgtgacttcagtacccggtgggcgggtggccatgtggttgtcccaccaagctgacgcaggaccctgaagctggtgtgtggcgaaagcgactttctcctggtcattacactgcaggagattcagcttcttctctatcgcatggagccagtcatttgcctccatagggttggtggtgctggagaaggtgggtggcctgacacgtagaaactccggcaacttggactgagggggagggggaccaaactgctggtgctgctgttcggcgtgctgcatcatcctctggtgcatctgttggtgctgctgctgcatctgctgcatcatggctgccatcatctgagtctgatgtgccataacttgggcaagggtcggattctcgggaagtggtggcggaccattgccagaatcaccgttggggtgcacaccatcagcgcgttcttcaccgttgctgccctcgcctgttgcgcggctaccagtcctggtgtagaccatcttgaggggaaagcagacggggaaaagaagaaaaacagatgctcaaggactaagctttattatataggaattaaaactgcaattgttctgatctgaattaaaacacttaaaaaggcaagcaaaaatccttattaagacagccatatcataggcacatgatatcgaccgtcaactgaccccaaacaagcaacctaaacacacaaactaacaagcagaaactagacaatcgataaactaatgggaaaacgagcctaatgctcggaacggctcctgcggtcggtggagtcgaaagcgtcctcctgctcgtcacctggtccctctgagcgactcctggagcctgacagatcagtctcgccgctgccactgggagtagcggacaaccaacctccggtaccactggctgaacctctggcggctgatgctggagcgaaggagagagtgaacgcgggagctggagctggagctgaagctggagctgcaggaactgcgggcagaactgaaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctacctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcatgatctgcggtgcctcctgacgcctcaaccgccatgttagcgaggcaagtccccacgtagccatggacctccaagcggacacggtgaggaagctcgccactgagcggtgggatggtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagtgcgaataaataagactcacataacgataaaataatgggaaattagatacataataataataacgaacaaagcataaacaccttacaacccatgttaccgagctaggacctaatgcatttcacccctcaaaccccaactgactgacgaataaatcccaataattttactaaaaccctagactgactcgttttaaaaaactcactttaaacgagcgaccaagatttttcccttgaaccacaagaacagatccccattttcccggaacaaaatccaattgcaaggaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtgcacaaacgacaatgttgacatacagatccacgtcttacaaacattataaaggtcttacagaaatgcagcggaaaacaaaagaaactggagctaagccttgactaaactgcagcgggaacaccactccacaggcatcctcgacggcacggacgaagcctactcctcaggaagccttcatctgacacatacccgtcctctggggttgggaaaagtagagcaagactgagtactacccactgtactcagcaagtcataccggaataggggtatgatgcaggggat

SEQ ID NO: 74404 - DNA, 2693 bp, Oryza sativa
tggtatacacacgtgggtgtgatgtttttgaccggaatgaaaaagttcaaaaagcaccaaaacaagatttttggacatattcgagtttattgggtgcgtttgtgacaaaaaatcaccccgtgattcgcacggcgaacttttctcaattaatgccgatattggcatatattggcacacgtgggtgcgttatttttcaccggaatgaaagagttcagaaagcaccaaatcatgatttttggacatattgcagtgtattgggtgcgttcgttacaaaaaatcacttcgtgactctcgctgcaaacttttgtcaattaatgccaatattggcacacgtgggtgcgatgtttgaaatgaaaaagttcaaaaagcaccaaaacatgctatttggacatattggagtgtattgggtgcgtccgtggcagaaaatccccccgtgactcgagcagcggacttttgtcaattaatgctaattgcacaagtaggtgggttgtttttcaccggaatgaagaactttaaaattcaccaaaacatgctatttggacatattcttgtatattgggtgtgtccgtggcagaaaatcactctgtgacccgtgcggtgaacttttgtcaattaatgccgatattggcacacgtgggtgcgatgtttttcaccggaatgaaaaagttcaaaaagcaccaaaacatgatttttggacatatcagagtatattcgcgcgacgaacttttgtcaattaatgccaatattggcacatgtgggtacgatgtatttgaccggaatgaaaaagttcaaaaagcaccaaaacatgatatttcgacatattggactgtgttgggagcattcgtagcaaaaaatcacttcgtgattcgcgcggcgaacttttgtcaattaatgtcaatattggtatatattggcacacgtgggtgcgatgtttttgaccggaatgaaaaagttcaaaagacaccaaaacatgatttttggacttattggagtgtattgggtgcgttcgtggcaaaaaatcacttcgtgatacgcgcggcgaacttttgtcaattaatgcaaatattggcacacgtgggtgcaatgtttttgaccggaatgcaaaagttcaaaaatcaccaaaacacatattggagtgtattgggtgcattcgtggcaaaaaaatcacttcttgattcgcgcgacaaacttttgtcaattaatgccaatattggcatatattggcgcacgtgggggcgaagtttttgaccggaatgaaaacgttcaaaaggcaccaaaacatgatttttggacatattggagtgtgttgggtgcgtccgtggcaaaaaatcactttgtgattcgcgcggcgaactcttgtcagttaatgccaatattggcacacgtgggtgcgatgtttttcaccggaatgaaaaagttcaaaaagcaccaaaacacaacgatttgggagaaacgttgacgatccgactacaaccgtacaagacattgcgttgtgccttagcgatcgatacacctctccgtgggttgttgatcttgtcggtacaaatcaaccctattcctgcaagaaaatctaaggaataagcaagaacaagataaaagcaatctgatgttgcaaataggaattgaatacaaatgataagttggggttctgaagaagaagtagacggacggtctagacgacacgcacgttgcaagcaagtagcaatggctaaactttaatctaacaaaacccgaataaccctgaaagggtacctacctaattataggggtgggaggacgaccaaggagtgccaatggtcgttctccacctagttggggcgcacgccacatgggcccaacttgggccggggtcccaaacaaagttacaagcccataggcccaagacatgtgacgcaacaccttttttatgtgattgtggccaaacgacatggaaattggcgatgaggctggatcagttggaaagagggctccgagagctttccatcaagtactcacgagccgaaaacggaggtcgtatacagattcggcggctgtttgaagtcagcagtgtagcaggtggctgaatcggattctagcacttggagaacttgatctcgatatctccttgttcatgcatgatgtcagcaatggttgtatccgtagtagccattgtcacatcatcctccccttcttcacaaaaaaaccgtcctcggcttttccatatggtgctcatcacatggtcgatttaaaacaacttgtttcataacaagacaaactagaagtaatatgattagaaataacatgcctctctagcttgcaggttttatccacatgtacaggaggttctaaatccgaacatatataaactctacgcaccaaacatattcctctatcatcatattcgccaaagatatgaaaaatagcattagttggacatggcaaaccagacttagcaaataatttctcctccaaattatcgagctcacaaaaatcatcgaactaaacatagcccaaagtatttaaagaagatagcaattcatgttcctctacttcattagcaatgtgaacaacatgcttaaaatcagcacacaaagaaacactagaaatagcatgttcattcaccagttgtggcatagatataagtgaagcattatcacacaactcttctttatcacaaggaacagcaagtaaatcaacttgtgacaaaggaaggg

SEQ ID NO: 74405 - DNA, 10103 bp, Oryza sativa
tcgactttgagatatggcaaatgaatgtcaaaatagctttcctcaatggaaatctcgatgaggatatgtacatgacacaacccaaaggttttgttgatccacaatcaactaaaaagatatgctaattgcagaaatccattcatgggttgaagcaagcatctcggagttggaatattcgttttgatgaagtagtcaaggtgttaggctttttcaaaaacgaacaagagccttgtgtatacaagaagattagtggaagcgcactggtgtttctaatcctatatgtagatgacatattattgattgggaatgatattcctattcttgaatccgttaagacattgttgaaaaatagtttttcaatgaaagacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatgacattaatcttggcaagaatcagtgtcctcaaacgactgatgagcgaaacaagatgagtgtgattccatatgcctcggcaatcggatccatcatgtatgctatgctatgtacatgtccagatgtttcatatgcacttagtgcaacaaaccgatacccatcagatccaggtgagagtcactggatagctgtaaagaatatcttgaagtacttgagaagaactgaggatatgttcctagtctatggaggacaggaagagctcgttgtaaatggttacactgatgcaagcttccaaaccgacaaagatgattttagatcgcggtctggatttgtgttctgcctcaatggaggcgttgtgagttggaagagttccaagcaagatacagtggctgattctacaacagaagccgaatatattgccgcctctgaagcagcaaaggatgctgtttggataaagaaatttgtttcttaactaggtgtgatgactagtgcttctagccctatggacctctattcgataatagtggtgccattgcacaagccaaggaccctagatcgcatcaaaagtccaaacacattttacggcggtatcacctcattcgcaagatagtgggtagaggagatgtgaagatatgcaaaatacatacggatttgaatgttgcagatccgttgacaaagccactccctcaccctaagcatgaggcacacactagggcaatgggtataagatacattcatgattgactctagtgcaagtgggagactgttagtgatatgccctagaggcaatcatagagatgattgtatcacatactatgtttacatatttatccgacattgttccttgaaatagataactccttattggttaatgaatatgtgattctttcatgagactctttatgttgtttgttactatttctaaaggatccctgatcaaatatcatatgtggaataaatatgtttatattatcagcacatgtattaattgatgatcatgtctcatggatcatggtatagagataccaaattaataatgtggacacatgttggtgaacatgttgttggatagacccaacatgagacactgcaagagccatatgtgttgtgtcatcagtgatctcatttagtgttggtgttgaatccttagacctgagattatcatggttctcaacatttgtagtagcttacttagggactgctaaacgctactgcgtaattgcgtagttataaaagtagttttcgggtatgctatgaaacatgtagtgggatatgaataattaagatgggatttgcccctcctatggagagatatctctgggcccctcgatgttgtagattatggaagtgcatggccatgcgaaaggtgaatgaggagtcaatcacaagttatataatctattaacaggttcgagtgaatgattgagctattagaggatgtcacatatctagccttgagcttaatcgatatcgtgaggcaaatggattcatacaagtatacactagaggttcagccgatatgatcattatgtatgtccggtgggtcaatacgttctgctaggggccgctgttgatgtgtggaccgaaaaggagtttttggtttacagccgagtatacatgaacctacagggtcgcacgcttaatgggccggaataaggcgattggatggagatccaatataagcttaattcggatagggatccgaataggagtcctacaggccttggaggcccgagtgatggatcctatatattcgtaaggggtgcgaacgacggagatattgcatcacgtgagaaacctaagccgtcacttccctccccacacaaaaccctagccgcgcgcgggtgctagcacatctccgtgcggcgttctgtgtccctgtacgtgtggataccggtagaggcgccactggtttgcggtgctgatcggtgtgggagtacggtgaggagaacgcacgaggaggagaaggtcgagccggtgcgatcgactacttcctctacatcgacgcgcgctacttcgcgagagttccttcgactttgcagcgtcttcttccgctgcgcagcgcgtcgagtggtaacgatctatgatctaatacttgcatggttcctggtttacgcgatagaaaattttgatttatgctattgtagcctacgcgtatcccaacacaaatatccagagatatgttcgcctttgcctcctataggttttttatcagagctgtagattataaaaatgctcaaccatgatgaccgtgtctccttgcgagtgcacctattcaaaccctcgaagaagaatagaggaggagaactcatctagtctcttatatgaatgaaattgtgagctacgtaaatcactaatcaactgcgtaaatggaatcttagcagatgcgcttcaccatgccattgaccggctgacctcatcaccgcttcaatcctcgaccatgtcggcagttctccctccgatatttttctagtgaaccaattcaaaccctcgtaagaacgaagcgatgtgggagaagagaaagaaagcacaacctgatttttttcccgtgtagatatgatcgatgcctaggtagatttacattctctagcgttgtggagtttatggataccccatacctacacggcatgtatagtctgactgggtatggggtgtcatgtatagatagaatatatttaaaaggactcgggttaaattccaaacttgtatgtcaaggaaatatctgagatcctagttggttacgattgtattttatctgtaactacatattccgttagggatatggactgtattttgtaatacggactccttctcctatataaggaggggtccgggtgcctctaggggcacgattttcacccagatcatacgatcaataatacactcggcggatcaatccccggacaggagtagcgtattacttcttgattaagaaggcctgaacctgtataaaattccttgtctctaaacccatccacttttccagcttgatagccacccccttttagtattgctgaaatcttgtttcgacagttggcgcgccagctaggggtagcgtcaagttcttcgccgactagtgcgatgggtttcatttctggcatcgacgacttcgtcttccctcccgggcaggcgttccgtttcggcagcctcgacttcattaccaacgacttcggtaagatttctctcctcgactcggattcgaaccagtcgggaagaggccagatctccgctccgttcggcatcccgaactcggccatggtctaccccaagatcaactctaccgagttggcttcaaaccacttggacgagatccaatctacttcaacacgacccgatcaagacgattgggcctatccgccaatcctgatgaaactccccgatgatttggctactgtcttcaccacaagggtgtcttctccccataggcctaggcgggatccggcttcagccccggtccggcctagctccagggaagtcggcgtcatactccagccgctcggcacggtttcgacggaacaactggacggctacctcagctcccccggcgtcgactcacgaccaacagagatcgtggagtacgacaacttcggctatcgctacgacaaccgcaacctcgacgacttcgacaagggctttgaagataactacacgcctctctacttcggcatcttcatggctgacaacgagacgggggaacagcgcaaagcccgagaagcagaagagctacgcgtacaacaggaagccgaacgacgccgactggaagaggagcgccaagcacaagagcgagaacggcggcagcgtgagcaacaggaacgcgaacgggctgcaaaggaggctgaggaccgacgacaacgggccttggacgccgggcgacgagcacgagaacttatcgtgcagcaagacgtcgagggaactgcggtctttcgcacccctcaatagaacgcggttgcagcgatcaccctcctcgacaccctcctcaaggaagacgcactcaaccaagctaatcacgtcgtcaacatcttgaccctgaccaagaccatgatcgttgcctcggtcccggttaactccgcaagcgtccgcacgccgactggcagccgagttccccatcttcgatctcaagactatcaccagccgagccttcagcatcgccggcgcaggatccaatcgcaggagcaggggtcacgacgggcgatctgtccactcgcctcccgaacgacacagggagcaccgagttgaacggccacgctccccacctcgcaggcgccccgtcgatcttcgcgatacaatcaaccagtgccacgcggcacgaggctacgtcccccaccattcaccggatcacgacgacgatgtggatggagtcgctgtctaacccagagtggattggccagccggtttcaagccgactggaatcgagaagtatgacggcaccactaacccagagtcctggctcaccgtctacggtctcgcaattcacgtagcaggaggagacaacaaagccatggcaaactacttgcctgtggctctaccgaattctgcccggtcctggcttcatgggttaccccgtggcacaatcggatcatgggcggagcttcgtgaccacttcatcgccaacttccagggcacatttgaacgccctgatacacattttgatctctacaacgtcattcagaagtctggagaatcccttcgggattacatccgatgcttttctgagcaacgcaacaagatctccgacattaccgacgacgttatcatcgccgccttcaccaagggaattcgtcacgaagatctagtcggcaagttcgggcgcaagcctcccaagacggtcaaacagatgtttgaaaaagccaacgagtatgccaaagccgaagatgccattatcgcgtccaagcagtcgggcaccacttagaagccaaagaaagatacgccgactacagaagggagtggaagtgccaatcacaaggatcgcaagcgtaagcccgaggaacttgtgacaactacaacaccatccttctgacaacgttcgcgtgtcaacacttttgacaagatcatgaactcccaatgtccgcatcatcccaattccaatcatgtggcaaaagattgtttcatctacaaacagtttgcagaacaatacgccaagaacgcacgtaaggcctccgacggagatcaaagcacgtcgaagaagaaggacgatgacgatgatgccccgactggttttcaagaccatcacaaggaactcaaccacatctttggcggacccctggcttatgaatctaagagtaagcaaaagctgaccgaatgagagatcaacgctgctcagcccgatacgccccaatttctttggtggtcggagacaacaatgaagtttgaccgctccgatcatcctgaccgagtggtctacccggggcggtaccccctggtactagacctagtggttcgcaacgtcaagcttcgcagatccctcatcgatggtggcagtgcactcaacatccttttcaccaaaaccctggacgacatgcagatccctcgcacggaattaaagccgagtaatgcgccctttcacggagtcattccagggctatccgctacaccactcggccagatcactcttccggttacttttggcactcgggagaacttccgcacagaaaatgtttgcttcaaagttgctgatttcaagacagcgtatcatgccatactcagacgcccggcgttagccaagtttatggctgtcccgcactatacctacatgatgatgaagatgcctggtcctcgaggagtcatatcccttcgaagtgacatcaaacaagccgtcacatgcgacaaggaaagctgtgagatggcctagacccgcgagatcacgatcgcccgagaagaaatccgactggctgcgtccacagcaagcgaaggagaagtgcctgcaaccaagatgccaaagagtggaaaaagcgacgccaagaccaagaaaattcctctagatccctctgatcctactaagactgctgtaataggcactgagttagattgtaaataggaaagcgcgctcgtcacctttcttcaaaataataaagatatctttgcatgaaaacaatctgatatgcctagtattcctagagaggtgattgagcactctttacatgttaaggaagacgctaaaccaatcaagcaacgactccgccgcttcgcacaggataggaaggatgcgatcaaggaggaattgaccaagctgttagcagcaggcttcatcaaggaagttctccatcccgactggctggctaacccagtcttagttcggaagaagacgggacaatggcgcatgtgtgttgattacaccgacctcaacaaatcttgccccaaagatccctttgggttacctcgcattgaccaggtagttgactcaacggccgactgcgagctactcagttttttggattgctactcaggatatcatcagatccgactgaaagaatccgactgcttaaagacttcattcatcacgcccttcggggcctactgctacatcaccatgccctttggattaaagaacgcaggagcaacttatcaatgcatgatccagagatgtttttcaactcagatgagccgcaatgttgaagcttatgtggatgatgtagtcgtcaagaccaaacagaaggatgatttgatcacgtatctagaagaaacctttgcgagcatccgcgcttttaggatgaaactaaaccctgaaaagtgcatcttcagagtaccatcaaggaagctgcttggatttatggtgtctcatagaggcatacaagccaacccggggaaaatcaatgccatcctcaacatgaagccgccaagttcccagaaagatgttcaaaagctgactggttgcatggcggcgctcaactggtttgtttcgcgactcggcgagcgggggatgccctttttcaagctgttgaagaaaacagacaatttccagtggggacccgaagcacaaaaagcctttgaagacttcaaacaacttctcactactccaccagtcctagcttcaccacatccgagagccgctgttgttatatgtgtcggcgacttcccaggttgtaagcacagtcctggttgttgagcgtgaagaagaaggccatgtccaaaaagtccaacgactaatttacttcgttagcgaggttttggctaattccaagacaagatatcctcaggttcaaaagctattatatggtgttttaattactatcaagaaactatctcactactttcaaggtcactcggtcacggtggtcacatcgtttccactcggggatatacgtcataatcgcgaagcaaatgggcggatcgcaaagtgggccttataattgatgtccttggatatatctttcaagccgcgaacttcgatcaagtcccaagctttagccgacttcatcgacgagtggactgagtgccaagaagacatgcctgagaagaagatggagtattggaccatgcattttaacgggtcgaagaggctctcaaacactggagcgggggttgttctaatttccccgactggagaaagactgagctacgtattttggatacatttttctgtgtctcacaacgtgactaaggattgtgatttctttgggaatccggcgtctgatagttcatggagactctcagctggttgttaatcaagtcatgaaagagtggtcctgccttgattataacatgaccgcctaccgacaggaggtacgcaagttggaagacaaattcgacggacttgaactcacccatgttcttcgacataataatgaggcagccaacagactggctaattttggttcaaaacgagaagcagctccttccgacgtatttgttgaacatctttacgaaccaaccgtaccgaggaaagaaacaattgaagccacggacactcaagacgtaagtatgattgaagccgactggagggagcccctcataagatttttgaccaaacaaaaactctctcaagacaaagatgaagccgagcggatctctaggtacagcagactctatgtcattcatgagaccgggttgtacaagaaaagtccatcgggaatcctgcaacgctgtgtgtctttggaagagggtaggcaattgctaaaagatatacattcaggcatctgtggtaatcacgctaccgcacgaaccatcgttggcaaggcttatcggcagggttttttctggcccacagctgtggccgacgccgataaaattgtgcggacatgtgagggttgtcaatttttcgcctgacaaactcatctaccagctcaagagttgcaggccatcccgttgtcttcgccatttgcggtttaggggcttgacatggtcggcccatttaaaaaggcagtcggtggttatactcacctctttgtggctgttgacaaattttctaagtggattgaagctaaaccggtcatcactatcatggcagacaaggctagagatttcttcatcaatattgtgcaccggttcggggtacccaatcggatcatcactgttaacgacactcaatttactggcggagtatttaaagacttttgtgaagacttcggcatcaagatttgttacgcctccgtagcgcatcccatgagtaatggacaagttgaacgcgccaatgtcatggtacttcaagggataaaagcgcgagttttcgaccgactgcatccctatgccggcaagtgggtagaacagctgccatctgtactttggtccctgtgcaccactcccagtcgggccacgggccagtcgacgttttttctagtttatggagcggaagcgatgttgcccaatgaggtggaatttgaatctttacgttttcgtaacttcaacgaagagcgctacggagataactgagtagatgatctcaatcgactggaagaagcccgcgaagcagctttaattcagtcggctcggtacttgcaagggttgcgccgttatcataatcgcaatgttcaatcacgagcctttttagtcggcgacctggttctgagaaaaactacacgggatcgacacaagttatctcccttgtgggaaggaccattcataatttccgaagtcactcggccaggttcttaccgactcaagcgtgaagatggtactaccatcgacaattcttggaatatcgaacatcttcgtcaattttatgcttaggcattacttttgtatttccctctttgactgataacatcatgtttttccttgagttatcagtcgagggctactataataataatagagtatgatttttatcaattcaatttgcttacttgatttatcattgccttgtttgattttttggcttagtcaatgaggactgaaagtttttaataacttttgcgggttttaggctcaataaggtttgacaaaagcttttaagaaatcaggagctaagtttgaaatatcaagcacagcataaattcatcagtattgtacaaattgtgcctccatcatcttcatcatcagaatcattgttataatacaacatcagtcggtgtcagtttttttatcattggaattatcagatccagtcggccgaaggtcgttgtcctagaatctctcaactacatcaacggct

SEQ ID NO: 74406 - DNA, 22588 bp, Oryza sativa
cctcgggggaggcaaaatagacttttgcggaggaatttgattggaaggaattggattcggagttgaactcgacgatagatcggggattgagatcttgagatggcacggacactagacaacaagcaaagaaacaaatttcgcaattagggtttttaagagataattttcccgctaggcgccacgacggaacgggcgctacaaaccaacccccctaacaagaatctcgaccccgagattcaacacctaagggagcaggtccgggaactcggcgcggagaagatcttctcgctcccaggttgcctcgtcttcggaatgattgctccattggactttatagaacttgatggtcttccttcgagtctgacgttctacctcttcaagaaccttgatcggtctttccttgtaggtcagattcttttccagctcgatattacccaggggaacttgctcttctggaactcgaagacatttctttaactgggatacgtggaacacgttgtgcacatctgcgagaccttcaggtagctcaagctgataagccacttcgccatgtctggcggttatgaggtagggaccgatgtagcggggtgctaacttgccggacatcccaaaccttctcataccacggaggggtgatactcgcaggtacacatgatctcccttttcgaactcaaggtcacgtctccgattgtctgcgtaatttttctgacggttctgcgctgtctttaaacgctctcggatcagcttaacttgttcttctgctgacttgagtatgtcaggaccgaataccagggcttcgcccacctcattccagcacaagggggtgcggcactttcttccgaacattgcctcattcggcgacatctgaatgctggcctgataactgttgttgtatgagaactcagcatacggcaaacaacgatcccaagtgccttcgaaatccaaggcacacgcacgtagcatgtcttctaggatttggtttaccctttccgtctgaccatcggtctgtggatggtaggccgtactaaaatttagatcagttccgagggcttcatgcaactgcttccagaaccttgaggtgaactgagtgcctcgatccgacactattttcttgggacagccaaatctacatacgacatgagtcatgtagagttctgctagtttctttccatcataggtggttttcactggcacgaaatgagctgacttcgtgagtcggtccacgattacccagatggagtcgtacccgctgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacgtctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgcctttatcgtctatggagaaattggtgtctttcttctcctgtattctttttattaattcttttatcccttcgtcgtctttctgagcctcccggatttgcgactctagggtaggctgtactgtcaagctggcagggacacctgactgtaccacggtcagtcttaacttctccaattctctgcacaggtgatcttggtcaggccgtatttgagctacattgcaataggccttgtgacttagcgcatcagcgaccacgttggctttaccaggatgatagtggattccaagatcgtaatccttgattagttccaaccattttctctgtctcatatttaactcggtctgagtgaagatatacttaagacttttgtgatcggtgtatacttcacatctgttcccgattaaatagtgcctccagatcttaagagcatgaaccacggctgccaactcgagatcatgggtgggataattggcttcatgaggcctgagctgcctggatgcataggccacaaccttttgttcttgcattaggacacatcctaagccttgtcttgatgcgtcacagaagatctcgaaatcttttcggatatctggcaaggtgagaactggggcagtggtcaaccttttcttcaattcttggaagctgtcttcacaggctgcagaccattgaaatttcttttccttctttaacagctcggtcataggtctggctagcttagagaatccttcaatgaatcttcgataatatcccgctaagccaaggaagctgcgaatctctgacacattcttgggcgggttccaagcaagtacagcttcaaccttgctgggatctacttcgacaccgttggacgagatcacgtgtccaagaaatgctactcggtctaaccagaattcgcacttcgagaattttgcgaatagttgatgatctctgagcttttccattatccgcctcaggtgttcagcatgttcctcctcgttcttggagtatatcaggatgttatcgatgaataccacgacaaactggtccaggtattccataaagattttgttcattaagttcatgaagaatgctggagcattggtgagtccgaaggacattactgtgaactcatatagaccataacgcgttgagaaagcggtcttcggaatatcttcagatctgattttcagttgatggtaacctgacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaactcttcgatttgtcttttaacttctgctaactcattagctgccattcggtagggtctttttgcaattggagctgtgcctggtgccagttctatggcgaactcgatctctcggtctggtggcattctttttaattcttccggaaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacttttcggcacaatctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttaacagagaacatacccatcacaacgtctggagcatcctgagcggtttcagcttgaatgtgattcacacggcctcgaccaaagttgttggaagcacgtgaaccttgtccacttgcctgagagctaggacgagactgagctgccgctggagtaggagttctggcagtgctgccattagcatgccctgagttggtgttggtaggattctgaggacactgtctagcatagtgacccatctggttgcaccggaaacactgaactgctgacggtccctgcggtgacttgaaagagataacactgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcggaaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcataccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcatcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtgggaaagggaggcgttcttctccagaattgtgactggcagtgcggtgagagcggtgagactgtcccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaaaaccaaagcgggctggtgcacgagctgcacggcgggggcggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtaggggagctgggtagtggaaacggaacacggtggcagaaccaacaacacgcttccgcgcagtgcggataaagcgtgggccacggcaggaggaagcaactggggtgtgtcctggggtgtaggaagggctaactgggtgtgggtagggcgagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctggagagtgggcctggctacagtgaagtggtgtgggcgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggaactgaaactggcgttcactgccatctacaattttgaaagagggagaaagatcagtaaccattttagaaacaaactattgaaaataaagaagacaaaagaaaccttagcttttcgcaagtagttttgaacttagtatccttagggtcgtcctaagtgtcgggtttcgccctagggccaagcctgtgctctgataccatctcttgtcacgccccgaactagtcccgaccggaactagcccgtgacgctccaaattaacctgttaatcgataccagtcccaggaaatagtgctggtatcacagggagacagagtatcacagcaacagaggtctctttattatagagtagaagtacagtcatattgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggaggattatttatatagagcaagggtgagtacgggagtactcagcaagccaggggaaataagtgtttaatgcaggcttcaaggaaaggctgtttttttcgtaattgattttgtttgaactcttttctaaaaagtctaagtgagtgcttctcaaacgacacggatgagacagtgcatctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcagacaaaactacactaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattctaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaatgatcaaatgcaacaaattaggtaggtctgccaatctgccttgcagacgggacaacagattaagtgtgatcctatcaatgcataatatttcgcaagcaaaataattaaatttcaaatataggctcaagatgttcaaaggtggcttgccttgctcgagatctggagcttgatcctcgaaatccttgcactgcgggtcttcgggctccgaaactacacgcgaaacgggacaactcaacaaaacggcgaaaatagagccctattaaagacctctaagcgtgccactagatagatctcgagatttgggaaattttagaagttgaatggagtcaaatggaattacggttgggaagatattgaatttataagattattggatttttggtctaaaggaaaaggatttaattaaatcctttttgaaaaagaaaagaaaagaaagaacagagggatggaaattagacttttcctcgggcggctagggcgcggtccaaggtaaatggagcggctcggccgagcttaacgggccggccggcccaagacggcccaagcgcgcgcgcgcgggagggagaagagagagtccggtggaccgggctcaccacgcgcggtcccgggtgggacccgcttgtcagcggctcggctcaccatgcggagggagtacgtggctcatgcgcgcgggcggggaaaggacgcggtgcacgcgcgcggtccgtggtggacgcaggtgcggcgggcccacgcgcagcctcacggctcgcggtggaacgcgcgcacggggagggactgaccggggtcggctcgatccggtctaggctgagctggcgccgacgtggcgcctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcggattgggcggaactacgccgagcgaggccggtgacgagcgggtgctacggagctcgagcggcgacggcggcgaacacacggcgagcgacgacagcggtcggggcggcgccggctaactacggggaggctactcaagctactaccgaaagctagggggaggagatggagcgaggaggaagaacggagagagacatcaccgagaagaggaggggcgctgtgacgagaggccggcggcgcgggagtaatctctccggcctcgggccggggaagaggaaggagagggcgcggccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggaggaaaaaggggaaaaggagggggagaaagggggcttgcccctttgccgattcgggaaaaagggggaggggagcgggggcgacgcggcagagaaaggaggggcgcggcctccttcccttggcggcttgcgcgcggagtggcgggggccgggcggtgacgacggcgatgacggcgggcggtttggagcggagcggcgacactggcgacaggcgcggtagacgctgacgacggcggcgaccgggcggtcggccactcggcgcgcgcgcgcgggaaacaacgggcggcgtccgcgcgggcacgcgcacgcgaacacggcgcgcgggaagcgtctttgcgagcggggagctcgcgcgaggggaggggcgctcggcgcgggcgactcccgcgcacgcgcgcgcggcgcgcgggcggggcggaggggggggcggggagagaggcgctcggggaggctctcgcatgcgcgagcagcgtgtgggcgggaaagagagagagagagagagagagagagcccaggggggagagggagagatgggccggggaagaggggaagatgggccgagcgagattcggcccatcgacctcgggggaggcaaaatagacttttgcggaggaatttgattgaaaggaattggattcggagttgaactcgacgatagatcggggattgagatcttgagatggcacggacactagacaacaagcaaagaaacaaatttcgcaattagggtttttaagagataattttcccgctaggcgccacgacggaacgggcgctacacttcacaattatctatactctttgagataaatctagagaatatccatacgaaaaaaatatcgagaagcaaacaaaaggtacaacatccagattctaaaggcttcctaaaatatcgttccccttttcaatctatctatgtatctcatgttggttggttttatgccagctaattggctgagcgacatgtggcgagatacaagcgacagaaaaagcaccgggtaagaaaccctctctataaaactggcgagcgtgcgagttacaatggtgaattgaaataaaagagaagaaaagccgctccatgtgcgtagttgggccacacaatgcgtgattgggccagtgcaaatacataaaataaggaggaaaagaaaaataaaaaagacaaaaaatatgaaaaattaaaaagacaaaaaaatattttttataaaattctttgcaaattataaaacccgcgaatttccgaacatcggatgaaaaattccttgtctcttatctcatctaccttatttcatgtaattctatgcaatttacattcatagagacatacttaagccctatcaccctaggattgcaaaagttaatctagttgcttagttagtcttatccttcacaaagcctagtcacttaagttagttttgattaggtgtaatttatttttaatattgcttattcacccctttagtgattgattcttatagaaagggaacatgtataatattatttcataaaagaagaaagaatggaacacctagagagtgcagtaaggtgaaaaaacatctccactgtcggaaatttattgaaagtactaaatctggttagcttctcataaaagttgataaattgatgagctacatttgccagagagcatattacgttatgaaatacttttctgaaaagcaaaggtaattgaagatcagcagacctagcatgacaactaagtattataccttgtagtatttgaggcgatacactgtgtggcgaatgtagaggtcatgtagttgttcaccttgtagtttagtcttggtgtcaggacgaggaggcccgtgaggcagatttccgagacaagcaaggtactcctcgtcagtgatactctcccccaaccccagctcgtccatctcttggatcattggctctgcttcttcttcttcttccacttttctatccatctatgtaactaattaaacctgtaaaatcttgcgatttgtgtgatgcttggctggagatatgattctctacatcaaccttgtgcacatccaaatccaaaagagaataaccttgtgcatatccaaatccaaaagagaatatattggtgtaatttcgattggcgacatcttagtgatgaactctcgtcgagatcgaccacaactctcgcgaatctcgccgtggaactcaataaagcatcgctaatgttagtggagacgatgcgatattgtggatgcaagacgagggtttccttgttggaataagttcatctaaggtcccttaacttgtcaataaatccaattttcgtccctcaaccagaaaaccagacacaacgggtccctcaactaccaaaaccagattaggtccctcggcggttttgagggcagttttggctgacgtggcacctacgtggctaatttaactcggtcttcatctgatgtgtcattgacatggcgcttacgtggcaattttgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctatggctccatcttcacaggcgctcaactggggtataagctaggactccacctaagacttcttctccaaagcttctcttactgaaggggggaaagatagagcaagaatgagtacaaccacagtactcagcaagtcacaccgggagatgcatgattaatgcaagggggtacaaggggataataatatgggttaagttttgcagtaaacagcatttaaaagtcacttagttgcccaaagccattttaaaaagacgatcctagagctacacagtattattaatcaaggccgtgaacccgcacgaacctgccttaacccaaggcctatgatgattcagaccgaactggcaacctgaccctaggtcccagctcgtcccaagccaacccaggccaaccattccacattttagttgttaagcaggttttaagaattaaaacactaacttgggtacattgctaggcttgcccataaccgagggcgcggctattcgaatagattatactctgatcagaggtgtacatctttacccacaagacacgtcttcctcacgtgtaaccacgtgccacataccaccacggcatacggacggaagacgtgacatagtttccaacccatcctagccatagacaagagtgccgacccaaccccacctacggccggaacctccgggacaggtaggcaggactgagcccctagcagcaggacaccagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgaagaccggtccttatgtggccgaggtgctactatcaaatccatgcaccccgagcctagcctaaaaccattttgagggttttgaatagagggggaggtgtgaatccaattccacaataatccaaccattccacaatgtccaagtgaaatggatattcccaaagtctagagttataaaaccacctaatgttgcctaattaaacagcgaagcatctacctaaattcatactagtggtactatgaatagagtacccactagttggggttttgtttattctagggtgaacaaggtaataataacaataacaataataataaggtcatagcaaaggtaaataggcatggctaaataaaacagtgataacgcgggaatttaaataaagctataatgcattaattcaaataaaaataattttataaactgggattcaatatattcaaggatgatgtgacttgccttgctcgctttcccaaacgtcggcttcaacctgcacgtagagcggatcttccgaagctgcagcgtctacacgaccaacggaaaggaaaaaggcttttactctaataaactccatataacaagtaggaacaaagcacaaaaatgggttcttgacttcttgaggaaaaattagagacttgaacggtccaattccgagttcaaatggccaagttatggccatttgaagtttatatgctctttaagtgaatatttgcgaatttctttatttaaattttaatttaaaaaggatttattgcgtcagccgaggagagggggcgcgcggaccgggtccacgggagtggggcccacgcggcagcctcatggtccacggtggaccgggcgcacccgggctcacaccagccggcgccgtgggccccacgcgtcagccgtacccgagggcgcgggcggctgacggctaggccccacgcggcggccacacagtgcgcccggaggcggccacgacggtgcagccggcgggaggcggcgcccgcgcccctatggtcaccggcggcggccataggcacggcggagcggcggccgagagaggggaagggaagggaagggggaaaagaggcggcggtccacggcttaccccgggtcgacggcgacgacaaaggaggcggccggagcggaggaaggcggcggcgcggctcgggtggactgggacgatggcgctccggcggtcggcgagctcggcgaggtggtggacggggtcagcggcgatgcgacgaagccggagaaggcgacgccgaggcgggagacggtcccggcgagcggagagggccggccggaggtcgtcggcgacagaggagagagaggacgacggcgcgagctcgattctggcggggagacggtgcggcaagtggcggaaacgggcgagagaggcgcggggagggtttaaatagggttgggagggagagagggcggccgacggggaaggaaaccggcgcgggaggtctggccgccatcaatggcgccggcgagatttgcgggagcaaatccggccgtttgaatgcgagagagagagagggagaaatggggggaaagggggaggggatcacggggaataattcccccccccccacttaattgcacgcgggggcggcgggatgcggcggattcggcggcggcggcggcggcgctcggcgcgggcggggcggcgagagcggcgggaggacggggatgacgggtgggccccacccgtaagcgagggtggcgggcaggcccgcccgtcagcggcacgcacgcggggagagaccgaatgggctgcgggggagaggagagagaggaagggagatgggtcggattcggcccatccgaggggagagagattttagggtttttctttttataaaaaccttttcaactttttttatttcttaataattattatttgtgctctgaaaatttaagtaaaatttgagggctctttttagaccaaggagaatttaacaaaaattctccgggtcacattcgaatttttcttgtacgcattttaatgtttgccaatttctttttgaattttaattaattttattattccttttagagaatgatttttatttcgggatgaatttattaggacgtgacaaatttgatcccaaaaataataaaaaccgtgggtcctacatgtcggtctcacatagaaaataataataaaaatagtgggacccacgtgggcctgagggcactcaaccgaggccgtagaaaccagaggagaactggagaaaaacaagatgccacgcctacgctcccggcacgggacgaacccgagaaacaaaggagagagagacctatccactcctccatgcggcatcgcacctcacttcccagccactacttaccagttgccaccaccactaccacccacaccgaactaacctcgccgtggaaaccaaacccccgcgcccgaccaccacctccctcctcccacctcttcttctggccccaccgcgcgccgcggcagacctcggcacggcgcgcgtggccgtaccatgccgtgacggccggaacccgccaccgccttgatcgccgcgcatatgcaccccatggccgtggcagtggccgccggaacagccgccgtctcatgcccgcgcctcgtccccgagcgtatccccctctccgcctccgtcgccgtcacatgtggccgtggctgcggggtggcggtgagggcgcatggccaaagcgcaacgcgtcgcggagagaagctatgcgacgaccacgacggccatggtggatgccagtgcggcggctggtcgcagcagcgccgaggagcggcaacacgggaaggggtcgtggagtggagtagccagaaggaggtggtgagggcgaggagctcgcccgccgccgctcctcctctgctccgccccgccggcccgcgcccgcccgctcgtccacgcctcgccgccgaggtgctgtcccgctcgtcggcctccccgcgcgctcgccggcctcccccgagggagcacccaagatagagaggagttagctcgagccgccgcagccagggccacctccccccgccgattcctcttccgccctcaaccgccggagccgtgcctctgccgctgcgcgccgctccctcctttggccgccggccgccgcgtgccgctgcctctccgtcgcctggagagagaggagaggagagagatgaagacaggggagatggggagagaggaagaagaagatgaagggtgaggatgacatgtggggcccacgtggggcccactattccggatcgaattgccacgtaagcgctacgtcaatgccacgccagatgaagacctgagtcaaattagccacataggcgccacgtcagccaaaaccacccttaaaaccacaaggacctaatctgcaccggttttaatagttgagggacccagtgtgtctggttttctggttgagggacgaaaatcggattcggattcgtcgacaagttaagagacctcatatgaacttatttcttccttgtttggttcgacctcgatcggggttgagtgggctgtggcggtgaaatcgagcccaaatcgacagttgcagcatggtccaaagcgagcccaaaatcaacaagaaggccggcccaaaggctgaggcccatggacagctgcagccatcaaagccgccccaccaacacaactccccacgaggccccgagcatatcatcgccttcgccgcaaagtcccaacactagcggcgaccggcgaggactccggcggcgacgtgggtgggactgagaagcgccgccgctgacaccagcgagacgaggcggcgacctccgttgacggtaacctacctaccaacctcgccattcctctccaaactgttgtgctgctgtctagatctcccacactacactagttactcctcgtagatctcggctacctggctcaagatccggggtcagatccgggtccggggattttctttgtgccctatggctgtattttggcgtctgtggctgatgacagcgtgtgttctcgagtgcggatgcaatctgagttatataggcaaatggccttgtcaactcgggcagcggcattgctttgctcagtgtgtttgaatgtgctgaaattcatgtagtaggctgtaggctgtgcatttcttgatttgcgtcttgcataattcactggtggattttctaaacctaacaagtttaaaattagaccattcaaccaaagacaggaggaataagtgaagctgttgtagtcacagcttatggccgatccaaaatttgttaggaatgtgaatatgtgatgctacaaacatatccttgtaagctaccatgctatttatcatgttccatcatggtgattggtgagcactcatgaaaaattcagatccaaacctagtgttacatgtggatttgtgctctgcaatctatcgccagtaataaaatggttgagtgatccagctactacaaaatcacattgcatactttttttttttgtagattatgcatcctggttttgggtggtgggttcctgatgtcaggaatataaatttagcctgctgatttaggtagcactgccggtgcacactttggtttttgaatacttgtagtcttccagcttcttgtagaactggtacaatgtgggccgtatataagaagggctgtcaactagcacatgctcactaattagtctaaacatttatgtttttattcattcaggtcaggtgcaatcatagaagtagttaatgacaatactttagttgttctaatattatttatgtatggactcaaattaacatgcaaaacatatgagattagtggcatgcattctttttcttaatagtggaaaatacgagataatgataactgtgaagctctgttagtactcttcattactctatttgagtggcagcatatctcatgctagccataaagcaagttctagacgtattctgttgttaattacttgtagctatataacccaacctagtcattccagcttatgtctcttagagatcatgtttattagcacctcaagatttcctctgcacagtatagtaactatcgaaaaagatattatttctttgtttttaattgacaaccttcacgtgctacttatttttgcagagtaaatctataggaaatggctgacggtgaggatatccagcctcttgtctgtgacaatggcactggaatggtcaaggtcaggaacttcatcttttaaaccatctatcatctccaagactccaactgcatttttaccaatttgaattccttaaaattttgcaggctgggtttgctggagatgatgcaccaagggctgtttttcctagcattgttggtcgtcctcgccacactggtgtcatggtagggatggggcagaaggatgcatatgttggtgacgaagcacagtccaagagaggtattctcacgttgaagtacccaattgagcatggtattgtaagcaactgggatgacatggagaagatctggcatcacactttctataatgagcttcgtgttgcacctgaggagcaccctgtgttgctcactgaagctcccttgaaccccaaagccaacagggagaaaatgacacagattatgtttgagacgttcaatgttcctgccatgtatgttgcaatccaagcagtgctttcactctatgctagtggccgaacaacaggtatgtgatgttttacttaacttctttctttccaatttcttggttcttttgcatctatagattcatttagatgagagctcggatgattaagaactattcttatacatttttaatgttggtcagtaggtgttagaattatattatctatgctcaataatagtcgtgcaattatttaatgttggtcagtgcatatggctaatgctgttttaatcaacaggtattgttctggactcgggtgatggtgtgagccatactgttcccatctatgaaggatatgcacttcctcatgcaatccttcgtctggatcttgctggccgtgacctcacggattctcttatgaagatcctcactgaaaggggttactcgttcacaacctctgccgagcgggaaattgtgagggacatcaaggaaaagcttgcatatgttgcacttgattatgagcaagagctggaaactgccaagaacagctcttcaattgagaagagctatgagctgcctgatggccaggtgattaccattggctcagagaggtttaggtgccctgaggtcctcttccaaccatccatgattggtatggagtccgctggaatccatgaaacaacctacaattccatcatgaagtgcgacgtagatatcaggaaggacctgtatggcaacgtagtgctgagtggaggcacaacaatgttccctggcatcgccgaccgtatgagcaaggagatcactgcccttgctccaagcagcatgaagatcaaggttgtcgctccacctgaacgcaagtacagtgtctggataggagggtctatcctggcttctctcagcaccttccagcaggtaagtccttatcattacagcttcttagatgctcaccagaattagttcataactacttcataaccaatccattttgtttatttgtccacaccaagttgtattttaatggttttgctaatgcacatgtgatttgtttgcttggcattgataaaaacagatgtggatatcgaaggatgagtatgatgaatctggcccagcaattgttcacaggaagtgcttctgagtttctcatgctgccctgtgcgtcggtttgtactagaggagaaatagttgcctttatgcagccataaactgcctgtgaattgtacgtcactctcttatgtggttggttgctccagatatcgttgtactatgttcttagctctgtgactgtgaggtcacctctggaacttctctggcttggttggttggatggagttgtgatagctgatagccctggtgttgtttggggtacaaactcatgtggaattttgaactatatatatccgtgtctggtcatctggtgacatgtttgatgcgtttctagtatacctaccaaagtgacaaggcattttgtcccggatggttttcgcattcttattctaagggccgtatagattacctttctttaccagacttctagttttttttttttgaaaaaagaacttttttatctgtatttcgtaaactctaaaactttttaatgttccctccatttgataaatcattttgatttatttttatagtcaaatttctttaggtttgatcaaatttatagaaaaatagcaacatctatagtaccaaattagtttcattaaatataacattataatatattttgataatatgttcattttgagttgaaaatattgctatatttttctatatatttgactaaactttgaaatgtttgaataagaaaaaaattaaaacgacttataatataaaacaatatatagtaattcattggttcgtgtcctcgagtaattatcataaattcaatttcatccattatcctattttagactactctaagcatcctttggaacgaaggaaggaatttgaagaaaaaatatgggaaataaaccgatatacccatgaaatcgtatgggcccttagcaatttggtggacgaataccgccctgttaagtataagaggattaacacttaaagaggcaacgtgattagagcgttggctgcgtgattagctggtgttggttctagaagcagggcagcttaagaaggttgtacacgtgggcaaccgcccatctccttctcccttgtaatccgttggtttgattcgattcgctttcccactagccgagccccatcgatcgtattcgcgtcaagcttcttctcttcctctccaaatttccaacctctccatccatccatcccgcatccgattcttccaaccaatctcatcttcttcctcctcctcggcggctcgccgattccccgacggcgatgaagatcacggcgctgctggtgctcaaatcccccggcgacggcgactcgtcgtcgggtggcggtggcggcgagcaggagcaggagcagcaggcggcggtggtggtggcgaacgcgaccgacgtgagccacttcggctacttccagcgcaaccccgcccgcgagttcatcctcttcgtcgcccgcaccgtcgccgcccgcacccccgccggccgccgccagtctgtccagcacgaaggcaaacctcctccccttctctccttcgctcgctctaaactctaaaccctactaacaacgaacgattttacgatttgcagagtacaaggtgcattgctacaaccagaatggcctctgcgccatcgccttcaccgacgaccactaccccgtcaggagcgccttctccctcctcaacacggtaactaacccctatatggcttcatccaattcaattcaacctagttattatgcttacgattctccttgcatagtcattctgattgacccactcaattcaacctagactgctccaagtttgacccaaacttagtccttccttctctagtactaggagattggatcgagtaggtgcaatgctttcctgtgtgttctcaccttcttctgttgttgggatggatttgtagcctgtttgtaataatttcttcgctagctgttgtgaggttctgtagtaatttcaggcagccttcacatagggatttttctggcgagttgatactttcaaagttattgcttctatttttcagaaggaaacaatgtgattgttcacttattttttttgtctgaaaggttatgtgttccttttgatttttgcaggtgctggaagagtaccacaagacttttggggagagatggaggacagcaaaaactgataacacccagccttggcaatacctggatgatgccttgacaaaataccaggtttgtccgtttcatattataagtcgatttgactttttccctaatcaaatttcgttaggtttgactaagtttatagaaaaaaataacatctacaataagaattagtttcattaaatgtaagattgaatatattttgataatatgtttgaatatattttgataatatgtttgttgtcttagaaatgttactatatttttctataagcgtgatcaaactttttttaaaaaattaactaagaaaaaaagtcaaagcgatttataatatgaaacgaagggtttactaatgttgtcactgcttgagtaagcggttctctggggattgtagatttggaagaagcaaattcaaacctatgcaggttgagtgcatgtcttggaattcttcgatcatgaccatttttattcggcttgaatagtacagcagtaataggatgtgtctacactaaatattacaaccaaccaacagaagaagcaatggcttgccatgctcatgcctatgaatcacactgcatcctgttatgtgaatgaactgcttattaatgtagcacctttattctagtttacatatattcttgtattattagagattaggacactgaaataatcaatctcttcatatacatgagatgtccctgtatcattattaaccaagggacaagtaatcttttgccatccatcctacggtccaatatcctttttccactgtccttatacccttgaagccatgctttgacttctttcaatgggaattgtaaaattgtgtaatgttctca

SEQ ID NO: 74407 - DNA, 687 bp, Oryza sativa
gacaaaaattggctgcgcgaatcacgaagtgatttctttgccacgaacgcacccaatacactccaatatgtccaaaatcatgttttggtggtttttgaaatttcgcattccggtcaaaaacttcgtacccacgtgtgccaatattggcattaattgacaaaggttcgccacgcgaatcacgaagtgagtttttgctacgaatgtacccaatacactccaatatgttcaaaaaaatcatgtttttgtgctttttgaacttttgcattctggtgaaaaacttcgcacccacgtgtgccaatactggcgttaattgacaaaagttcgccgcgcgaatcacgaagtgatttttttttgccacgaacgcacccaatacactccaatatgtccaaaaaccatgttttggtgctttttgatctttttcattccggtcaaaaacatcgcacccacgtgtgccagtattagcattaattgacaaatgttcgccgcgcgaatcacgaagtgattttttgccacgaacgcacccaatacactccaatatgtccaaaaatcatgttttggtgctgttcgaacttttgcattccggtgaaaaacatcgcacccacgtgtggcaatattggcattaattggcaaaagttcgccgcgcgaatcccgaagagattttttttgccacgaacgcacccaatacac

SEQ ID NO: 74408 - DNA, 19960 bp, Oryza sativa
gggtataaagacttggtcattgccaacgccaggcttgctcccatacttccagcttccttgatattcttaaagtatgtatccggagcaattctcagcttgtcgaaaatctcagaagcatcaaatgtactcggaccattgttattgaaaaacatggcttggatgagtggggtagcagcgttggcgacttcatccctagccccttcaagcctcttgattttgttgaccaagacattaaattgagcctaagactttattttgcgatctgcataaatagatttatatcaacgagtgggcataaagaaaggaatggtttttggagtattagtcaccagtaccttcaacgtctttccgagccgagtccctttgtctcgccaattcggccttgtcattctccagagcttggatccgcttttccaattcaaatatcttggcagcttgcactgtattcttcttgttaattgatattacaaggatggtagcataagtaggttggatagaggttgtatttaccttttcatgaaccgctcagttcaaagttggagtcttgcagctcggcaatccgatcccttagatcatgctcagttttcctagcaagctctttagcttcgtgcagctggtttctggtggcctcaatggttccaagatggggaactagcctttcaagagtcgcagtcttcgcctcgttcctgagatggattctctgcaaggcgagtttgtcggcatttgtgcaaagcggcaaacaggatggttgaagctgcgtatagggagacttacgtttacgatacgagtagcttgcccgagtgcctttttcagcagacatacttcctcgtcttccttttgcttgtttatcatgattccctgaggttgcatgtcgtcatcccaccacttgacttgaatgggtgggcgagaatcttcagccgatcgtatctgaaggacctcttcttcatcaccaatcattggcccttgtatattcatgaataaaggtgaaacaatcgaagaaagcctgtcagatcaaaatgggttcagaggatgtgtttacctataataatttccggtcagggacgagcaggctcttgtactttaacaggagagctggaccctggatcagcactagtatcctttctaggagggctggccatttgagcttctacttcagggacatctttatttagttctgcacccgactggtttccagccgggggctcctgattagcaccgactctagcttcggctgactggtttccagtcaggggctcgttgctgggttctacattgtcggttgccgactgattgtcattcggatgatcttctgcagccggcccgtttcttttgaaggacccatctccatgtcagttggctcagagtcttttccagaaggatctatgtcagatggcttcctacgaatttgagttatgctatcagtgctatttcaataatgaagtgcgcatcaatacaaggataatggctaaatgatttgtacctggagaacttcctgatttttggcataggacgactggatgttttcttcttcgggttagcttgccttgttgattttccggtcaccctcttgctgccagctttttcagagtcatcattttggtcgtcactcagaaccaatttcctctttcggaagtctgattggttggccgattgagtggtgctgggttgagagtcagatcggatttttggtcctccgttagcttgactagtttgccgacggggtgagtggcgttgagcagttggggggtctgacttcatcaaggcgaattcctgggcatgatgatccaagttttccatcaactttgtagatgataaaagcatgcttttgagaaaggctgggattttaaatacatatcggtggaggggggttgaaggcattgtatggcaccactggcagcaagtgcgaatagctgactgcgattgcatttgagaagatcttatacattctctccttcataaccttgaattcaagagattcaggatcttcacggttagggtcatgtttgccgtcgaattcgaaggccgtgcgagatctttctttgattggggccagccggctcttgataaaatgccgggtgatctgttctccttgcagaccttgctccttcagcttcagcatatggtccatcagggcaagcgcctgggcggcttcttctcccattggtagtgaattccaagtgtcctgataaactggaggatgacaggagtactcagggagtgcaggctcggggttttgtacatagaaccaatttgcatgccagcctttgtttgaggttttgaagggcatggagaaatacttttggctcagagttcccctaagttgaaatccagctcccccaactacgcatggcttgcttttgttcggttggggcttgaggaagaagatgcgacggaatagggcaaaatgtggcctgatgcccaaaaaagcttcgcaggcatgtatgaagttggcaatacgaactatggagttcgggtttaggtgatgtaaactaatcccgtagaaatccaaaattccccggaagaatcttgaggttggaagagaaaatcctccatagaagaaatgagaaaataccacgacttcatgtgtgtcgggggtcgggaatgcttcgccgaatgctggacgccatccaatgatctccttcgccggaagaacaccgtgcgccaccatctccttcaggttttcctctgttacatcggagggcgcccactgacactcgaagctttctttctcttctgccatgaatacgaattggatggtgtgatttggtccaagatatggctggagatggatggggaatcgatgcggtggttgcgcggaaggtttttgtggagctcaggaggatggatcggagaggatttgttaaccctagcttccgccagtgtagtttacactgtagcagagaatggggaaaatggcgagagttttggcagggaagacgaaacgacgctctgacttcggcgtttattttgctagggtttcaggagtggtgatggacctgggcctatacagtacttcagcccaatgctattgccagcgtggctagttgtgatccttagggacttaggcatttttgctttggcaaattttgctcacaacagtatggcccaatgatgttaaaatcctttttgacgcagttagatgattccttggaattactatgatgcaaataaaaaaggtactcgacagaaaggtgttatactaattttgtaggccttattaggctgcaaaggctgtttgggttttattgggatgactggttttaatacagtcattcactcggcatgttatatgcttatttttatggtgagagtcatagcctaggctatttagactcatcacttgttgtgttatcacatttacatcacgtttgatggatctttttaagagtttttactcggattcttatcaagtgtgtgaatttatggatctttagagtgtttttcactcaggccttttcatatctccatttttggtatattaaagctaaaagcagtcggctggatgttttattgaacgccgcatatgctttactatatgatattcggttgtcaaaccactcggttgaatgtagtttgcatcttgactatatgtttagttttttaactaatcacgtagtcgggggctacacctaattatgtgcatctagtcgatgcacccggttttttctatttttagaccttcacagtctttgatttttggtactcgggagatcagggcagaagaagtcggagtactcggattatcattctgtgctacgagaagagattgtttcgtcgactgtaaaggtctcaggggctactgtggagtttatggataccccatacctacacggcatgtatagtctgactgggtatggggtgccgtgtatagatagaatgtctttaaaaggactagggttaaattctaaacttgtatgtcaaggaaatatccgagatcctagttggttacgattgtattttatctgtaactacatattccgttagggatatggactgtattttgtaatacggactccttcccctatataaggaggggtccgggtgcctctaggggcacgactttcacccatatcatataatcaataatacactcggcggatcaatccccggacaggagtagggtattacttcttgattaagaaggcctgaacctgtataaaattccttgtctctaaacccatccacttttccagcttgatagccaccccttttagtattgccgaaatcttgtttcgacaagcgtacagtaccgatcaacggagcaaggtattcaattcggcgataatggcaatatttcactagttaattactcctctaccattggttacaatatatttttattccataccttacccctctcttgatcaacggtccacattactccacctcttaataactgtaagtacatttaataatagttgcatatgtatggtacgtatttgatctagtagggtggagacgagccgatcgagccgctcagtctgtggaagcttgacacaagagaggctagttgatttgcttatgaccaccacttacaaggtaatactgctataaaaaccctcatagggaccggtcttataggtgccccttaatttaaaaccatcacctaagggccgtttctcaccgccacacgctgagaaaaataaagaacatgtacctttaagaactataggtaccggttctagaggaaaaaccggcactaaactgtaggtaacggttttctaaaattgaccgagccaagacgatcgatcagtgcgccaaccacataaaaaaactcgcccaaatcttattctctacccggcgtgctatatccctttcctcctcctccttcctacaacccccctgcctcctttatctgtcctcttcctctctgtatgcacacagtggcaatgccctcccctccgccagatccagcgggaggagaggaagtgggcggcggcagcgccccattcggcagatccggtcgtgggcggctgcagcgtcttcccctccgccagatccaacgggaggggaggtggcggcaggggcagtgggctccccactaggaggcagtggtgggagcgcagcgccctcccttctccgccggcaaggaagcagaaggtggagcaaagaagcccggtggccagccctcgccctcccctcccctccaatccccagtctcttttgtaaatgtttttgtgaattattttgttgttgagtatgttcattctgtgatgtcaatagatcatggtcacaatttaattttgatttggggatttcaatttgatttggggatggcgcggtgtcaaacgttggtgagttcggctcgattcgagctggctctctttttcttttctggctcatgctaatctataggtgccagttctaattttcgcataggtgccgtatgctaacctatgtaatgttctgtagccgtgtaattagtttatgccccatgctttgctgcaggatatgtagatgaatgcatgttatacgttataggaatgatagatgtatatgtttaaataatatgaaaatgatgtggagataataatttgacattgcttgcatattgagttctaaaaatataacaaaattgtaaatgatatgttatgttggcatgatatttaaaatattctagataataattactagtgggtgatgatgtgtcaaacttgcatgtgatttaaaatactctagataataattgctagtgggtgatgatctgtcacacttgcatgtgatttaaaatactctagataataattgctagtggatgataatgtgttacacttgcatgtggagctttagtagttagtgggcatcaactttatagtaagatatgatttgacacattaaaagaaaactaaattctattttaccacctaagttgtttcttatcagtttaatattccctccattttagaacataaggtgttttggttttatcctgtattaaactttctgtaagtttaacccagcttataggaaaatatagaaacaaattgttaacgccaaaatttggtaagccccgaggtcatcatcggcctaggaaccgtatcggcttcagagttctagaatcggctaatgggaaatgtcactcgccagcggtcagattcttagtggattcggggcatggcaattacaggaagattatcgagaacagaccaagtttaaagagtatgcggcatggcaatttttgtattaactagatagagtcagttagttccttttatttttaggaaatattgtttagagtctgatcaggacttgtatattttactttatctttaggaaagtttgtgtctttttccagcaaggactaatatctacccatgtgtataaatatgtacatcccgtatccttgtaatatatctctcgatcaatacaattatggcgcatcccaccctttttatttccttctttctcaacgagttcttgtttcaagttaggtttcattggcgtcgatctccgatgaggggtaaggcttgttaaggatgtttgatcggcagggctagggcctcgatactataatcttgtcgatgtaaacatctattcattatatatcttagttaatttaagtcaatgtctgaatttacctgtatcgactagatcttttctagggttttattggtattagttaaattgtttcatcgatctagattagttaaggtatccaccaccctgaaaatcagtcaaaggccttattgtttagacttaatgctgcatcaattgggtttgacctacaaagtcgtgcttagaatcataaaagctaatctgcctttgattgacaataagggtttcattggtattttagccgatgagttatatagacgttgcatcggcttacaaggattacatacaagttggttttagccaattgcaacaaaggtttcactaattatctaatcttgtggaattatttgacattgaaatatcagctgatgtatgctttaaacatcaaatcggcatttattctatcattcaatttttggtcgattggtttctattggattatattactgttttattacattgtgatcaattgattgtctttatatcattatttactcaagtatcataatctagattggacatatagccggttgctcaaaaccatatcgacatcagctggtattggcattggctagcattgctatcaacttattggccgagtggttctctgatcttcatttcatacgtcttgtcagttgcaggataaaactgattggaatgcctacatctcatcaatattttggacctgcactggagttaagcagatctcccaggctattgtgttcgttgagttagttcgcgccaatacagatctggcaccatcggccgagcgcggatttttcatcaacacatatacaacaccaacattaaattaatttaataaaataaatctactattgtatagtattcatgtttcaggttaaaatgttaattattatggttttaatagaaacttgctcaaacatggagaaatttgacttagaaaaaccaaaacatcttcattttaaaatagtggttgtactatatgacaaccattatatctagacaatttacacccactaccaaaaaaattcatttttcctgggagccaaaaccggtcctggcatgcggttggccagcacgcatgcacgaaaatgtctgcaaaaatcactattttcgcatgcgctcacccttaatgcagcacatacaataatcgatctttgcatgcaactgggttaagtggcccgcatgcaaagatcggttttcgcatgcagacaagttaggccggccgcatgctccatgaggcccattcccaaactgggcatttgggaagatcgtgtctcgtatgtaatacaacatttcccgcaatttcataatcgaaatttgaaattctacgcataggagctaaccaagttgtcattctaactacaatattgcattgacatgtaaatagtcttagaataaataacacaaaacatttatggacgtgtcatacatatattacaaataaacaacagtttcatcacgaacaaaaatattatattttcactatatatgttcttcctcccactctcctagtgggttgaatatgtcttttattgcgatttgactctccttttcgtagaatagcccaagtgcattgtaggcatcatgatgggtgaaacggcagtgctcagcgcacatgttccatataattgtgtcgtcgaaccgatttgctacgtaagggattgacgggatctatggacaaagtggacaataaatgttacaaagtaattttcgacagaataccctgtatggagtgcaatatccggacttacttcatcactgtttgttgtgtacctcttattgactctaaccatctcgcacatgtattatttacatagggaagtctgtggggttgtttaaaacactgtgaacataataataagagaccggtcaatactaacaagtaaggattctacgaaaaattgtgttaatatcatttgtcagtactgacaagcctgtcttggcgtgtagattattccttgtcggctcttttactggcccacctcttttgcggtaatacatatgtgtgttgttcgaacaaaacatttgttatagttacttagaaatttcataatagcaattatgcacatatggattattacattacttacaaaatcagaatagtgaggaactccatgaacgtttccttgtcgtagtgtgttgggtccaatgctacgaacaaatggtcctttggatatactaggaatagtatatagtgatcgctgcaaacaagaaagatgaattagagacatcaattgttaaaaaggatgtattactgcggaaaaaaaatacttagatttacgagcggctgcttatgtaaaagcataagggactgttatgacatttttgtcggcatgcactaattaacatcgctagtgccaagtatgttcctcaaggcgctaagtattgcattagcggcttgagcattcctgtgctcgttctcgtcgtcctccttcgtgggatcctcgggtttctacaaaacatagcctttttcgactattctccaaatagatgggttaatagacttcaaatgcatcttcatcttatgtttccaagcgacatagcgcgtatcgttgaagtacggagctttgccgctataggtactcacataagaagtagatgtggatggatagtcataaggaaacgtatctcccttatcaccatctttgccatcccccgtttggcccgacatgatctctccaagcagttaaggctaattaggagattaggctctgataccagttgaaagggtcaattaggcctagagggggggtgaataggctaatttaaaactttatgcagaagctaaaactgaattagggtcggaaagtttgatccacagccagactatccgaaaataatagatagtctgatgttggatcagactgtctaatctactaaagagtcacaacaagaagatctagcacacaaacaagagtatagcgcaaacagcgactagatctatagcagcacaattaagcaaagctaaagagaggatgaagagagatcaccaacgatgaagttcatggagttgttcccggagttcaaatccttgaggggattctactctccgttgaggagctcactaagagccgggtctttgctaaccctttcctcaagaggttgcactaagcactcctccttctactaaggggtatctctgtccttgcggagatgagatccggccttcacaaacttctcccggccaaccacacgcagagcggtggctcgggagtgacacctagccgtctaggagtcctcaacctccaagagtaaaagacaccacacaactcttggtcaaaccctagtgctcaagatcgagtgaaacacacactaggccctcaaacaccaaatccacaaccacatggatccaccacacaaagaacgaggagggagaaagagctcaaagatccaaagcaccttagcaccaagctcaacccaaagtgaatgagaatgaatgagttgggtaaccctagaaaagggttaggtgaggggtatttatagattcccccaaaatgtggccgttgagagagaatcttttcatcccacctcggaaagtccaaggtgacatcagatagtccgatgttttgacccccaagcaagccacagatagagaacgaaattctggagaatttcgggcaatccgatcgatcggatagtccgatgtcatatcggatattccgttatttttgaagcaagaatttcatcctcttacagagactcaagttccattgaatttcggagtctctgggtcatcggatactctgatcacatcggataatctgatttcaaaatcactcaagaggaaaaaaacaattcaaaacagagagtgaagttctgagaaatttcagatagtccgatgtatcagacaatccgaccttatatcggatagtccgatattttttcgccaacactcagaccaaagacagagagcaaagttctatgaaatttcggatagtctgagcatcggatagtccgatcaggatcggatagtctcacaagaataaaacaagaacacttcaaacaaaggattttgagcactagtgttctaccaattatatgcatgtggtatccctcttaatagtacggcatcctaatactcaagaacacaagatatacatggattagaagacgattaccacaaaacatgctgcaatgcttttaaactcaagttccactcctttttatccttgcattcatctcaacaaaaagcattagtgaacctctaattgtgttgtcattaacaccaaaacaattgaggggtcctagatgcactttcagcagtgaagcttgaactgtaggcggagagggaggagtcggcgcttgagcaggagatgcgggtgatgacctcactagagttggggaaggtggactagtgttgacgcgaaaaacacacactagcctaggagatctgcttagctctagtgtaggtccaaaggttgatgagatgcgggcgtgccagtcagtttgatcctgcaactgacaagatatgtaaacaatagatcaaagagccgatcggctggcaagccgatggagtgattccgaccgatgtcgatacaagccgatagcaatagggtttttgaactatcggctataattctgatgtagaatccgacacttgaagcaaataacaatataaaggtaatcggctgatgatagtaaaatataacaataatataatccaatagaaaccaatcggctaataatgatatgatagaataagcactgatctgaaagttaaagcatacatcggctggaggaccgatgtcattaaatccacaagattagataaacagtgaagcttttgttgcaatcggctaaatccaacttgtatgtaatccttgtaagccgatgcaatgtctagataacttatcggctagcaccccgataaaacactccctaatgatggttaaggggctcttcggacaaggtcttataaatatacctcacttcactcacttgaacgcacacttccaagcttgagctgaattataagagactctattgtactatattgtatactagaataggaagagagtagagtagaagaagttagaagaattccggagttgtcggtaatcttctctcatttctttaattctgtttattactctgatttcaatataatattctccctgagtaatttaaatttatcttgtgagaattatctcttgtttagttcctaaatagcatacaggattattgttcactataatcaactaaaatatagtgattgctttggtgagttgtaaacactaaagtagatattaattgcttagacgtggtgtttaggtaattattatacagtaattgctgtgtatcccacggtatgtttgaggtaggtgtagaggtggtgacagccctcgagatcacttaagtcctccctgtccgggtacgtagtagagcgacatctgggaacagcaggttaccagtgcccgaagtattgcattaggattaaacttaagctttccctagacattgtttctcactagtaaatcctctctatccttgcctatcctttgcttggtgtccttagatgaaccagaggaagatctgatcacacacgttcccttggattcgataccctttcgaatactccgtagggggaagtgctacatcggtatatccatgcgcttgcggatttctatctgtgactgtaagaattacctaacagtcagtcagtttgatcctgcaactgacaaggtatgtaaacagcagataaaacagccgatcggctaacaagccgatggagtaattccagccgatagccgacattagccgatgccgattctagccgatgtcgatagggttttgagcaatcggctatatgtccaacatagataatgatacaaagacaatcgactgatgataataagatataataataatataatccaatagaaaccagtcggctaataataatatgataggataagtactgatccgatggttaaaacatacatcggctaaaagtctgatgtcataaaatccaattgatttagataaacagtgaaacctttagtttgtttagtttgtctaatgtgatggatataataaatctatttataacagcattgtgattgtagagatatatcggctaagacagtagatcgggcctaaccaagacagtcccatctaaatcgatgcatctctaaacacaatgcaattagagatagaattgagatatcaggtaggcaaatatatcaaccaaaccagagcaattcaagagatcgaagtgatgtagccttgaacaacaccaatgtagctgatagattcaccagggccgacggaacgtaggacttacccctccgccagagatcgaactgaactgatgctgccccgcgtcaggtgccaaattccgccggttgataagtaaaacctcagaaaagagggtggcgatacgccgagagtagtattgattgagagatagtttacaatgacctcggtgtacatatttatgcccatcggtagatactagtccttgtaggtcaagaaagaaactttcctaaagataaaaggaaacataaagtccttattgaacactaaacacactttcctaaagataaaaggaaactaatagactattcttaattaatagataaacttgccatgacgtatcctccttgaactcggtcacttctggataagcttccctaatagatttatttccttaaccgaatatagcaagaatccgactattagcgacttgataattctcgtcggccgattccaggacaatgaagccaatactgactctaggtcgatgataacttcgggacttaccaaatttccctgttaacaggaaagtggtgttggagcaacaactgtcgttggttgcgatggagctgggtgttgacagtcgttaagtaccactttcgactgccaactagcacaattaataaagggaaattataatttcctacatgtatactaataaaaaataatgtagttgtattgcaattggagaattaacctggatgcaagaattctatatcaaagtgaaggagaaatgcggctagcattgttggtattttttacgatcacagataaatccgcaagcgtacagaataccattgtagcacttcacccatgagtattcccaaagatatcgtattaatatttccacagggaggcggcggtatgaagacatacttatatatatttaatcaatctataattaattcaccatagtctagacaggggttaggataatgatttatagggtagtagacacatacaagagattcacctctaaaagagtgcctagtagtaaatagctaaggatactatgatacaactatacttctaaactaatcatgtctagtacatacttaatatatacatgcttacaacatagaacttagttccaagcacccaagtactaccgagagaccactccctgctggtttgccagcgtggttatggcatttacgcactcttacatcaaacctagacgtggagaaatacaaaggatggacaaggttgtcaccacctgccgcctacatcactttccataggatacacccacatccaacgatatttatctagcctaaacaccacgtttatgctagtaaacaatatcactaactcccctaggactcttacccttcggaagaacaagttggagctagcgcaacctataaaggtcattggaccattaccatagcatggatcgactaccctaggatgaagtagatatacgaagtatatactactcataacaaatatactcaataaagaattatataaaatatgagcataaataaataaagaaaataattatattaattcgactatagtcttacacaaagaagagagtactagagacatattcagaactctgagaagactataggactgaggctcctaagcttatttcctactagaaactatagagaataaagtggaagagagaattgatccttgatgtgtgtgttacaaagtgaagagagctccatttatagcctctcaatagcagttgtatgacggttattggtctgctaaccatgcataaccaccatcaggagttgctgtagagtcaccatgcactacaccatgtcctaaacttagctacatcccttctgtcggcaaatgccacctctagcatcggtggcgggggcaccaagcctggttcggctgaaccctagccaccacctttgatgggaggatgacatgtgggcccctatgacggttccttgtagtttggtctgatccaaagtcggtttgcgctgacttgtggacccattaatcctcttgctcgcacgtgatccaatttttcataaaaaatttttcacattatctcacataaaaaaattcacattacgacagaaaaaatcacataaatataacatatgaaatattcacattatctcacataacaagttttcacattatatcacaaaaaaatttcacattattcacattatctcacataaaatgttttcacattatcagctaaaaatcacataaaataacacttataatcttacattttcgcaaaaactggaggacggtggaaaagaagtccccgagaccgcctacgtggaagatgacctggagaggaggattgccgccccccaggaaggaagtggaaactaaagctgcaaccaacgccgatcaagagacgaccatggggcgctcaacgaaaaggtgcgatggtcgtagagtccgacgaagaggcgacatctggcaacaaagaggtcgcagcctatggcgtgtacaaggcaacctacgcagataggaaagggacaacaaggaggcagtcagtgcggtgagcgacggggacgaggcgatgcaaggtgaggcagcgacagcggcatgggtaatttcagcagcctggcggctagggttcacgggctccaagacttggaagtcttccaagccccgcacccgcctatatagagctagatcatcgcatgcggtccacctaaggatctgcatgcgaatatgatcgttccatgtaggcggcggaaaggaccatatggaatgattattttcacatgcaactgattaagccgacatcttgcacaaagattatctttccatgcgaccacatgcgggtaccacatcaccatggaggaatatttttctacgcacgctcggatgaatctaggtcaacaacctcagtaccaaaggacatgtttctctctttgtaccgacttgtttcacatgttgggcaaccgtccaagtctgcaaattccttatggtacaatacatagtgatttagacaagcgtgaatcttttggacacctagagataatggaaatatgagtttcttcagttgatacgtgttggatgacaaaaagttaggcttaggaagcaaaactctcaagagactcatcaaatcattaaaactactatcggaccatccatgctttgccttccaagtaagtagtttaagcaccgaacgcaacactgtgatgtccttaccacatccattggattcatcgtaaagaagatcttttgatgacttctttaatgactcccaattctctaaacctcgtgctctacgtagtagtagctctggttcaatgtgccatagcatgtcctccagatcgaaaacggcctcaaaatcatcattaccggtggaaccatctacatccatcctttctcaggagacatatatatccatgattgcaaaattatgtctcatccatctggaaattgaactcttcaccgtcatcttcaggagtaggaagtccccttgatagggccaaaccttgtagttgtacatgaatccatgctccactatgtgtgccaataatttctgattcttgcaatcaaagcatggccaaaaactttgcctcatattctccttaaagcatgtgcctttgccaaggcaaaaaaatttggatgcttcattcacgaatgtcggatgagttcttcgaatctcgtacatccatgcccgatccatttatgaaaaatcaaaatcgcagtacgaataaaaatatagcacatgtatttgaaaaaaaaacatgaaaatacatgtatctcctcaaaattaatgcagcattacgattaagtagtatgtaatagcgcttacatcaacaattcgctcatcgaaacattctattcgagctagattttgcaaaaaaaaaaaaaaactcacataaaaatgagaaatttgccgcattgcactgatgaaatttaaaataaatggagataaatgaagaaggaaagcaagtgcgttaccttctatatcaaattcaagcaaagatttcgagttgatatcccccccccctttttgttgcttggtttaggagagagaaactttgagttcaaatgggtgtagcttgaggtaggtggtgatatatgggccatcattgcctgcatgtggtcggcttaagcagacgtatgggataatagtattatggtagtggctgcttaagctgaccatatgcgataatagccgcattatcgcatgcggcatcacatgcggtcccttaggaatgccgcatgcaataatgtggccaatatcgcatgcggaccgtcaaccggcccatggtggggcatgtttttataggcacagctacttataatcacctgcaacctactggggtcttatatggaaaaaacttttatgtagtagtgaccttttactacaaaatcagacaaaaaaaaactcttttaaaggcaatttaattaaaccagttttaataaaagtttttgcaaagctgacatccaaatcatttgtgtactttaattttgatacggcaaccatatactccatccaaactaaaatatatatatagctatttctcatgagtggcatatcaaagatagaataactaagaaaaacatgaataagattgaacgtacagagacatatgtacatcactagctaggactgcgcgcgggtacactgaggcgtcattttataattaagtgcctccggatcctgtgaaactataattttttaatgttttcttaagttgtcacagtgcagattaatattactaatttacatttttactgatgtagatataatagaagaaagcttgctgccggctgactttactgaaaaaaaaatcatattccgtggagtcacctcccagaccactcaagcggccggccgggttccatatcaccggccgcgcgtctccatttgctgattgccggatgtgtgttcagaaattaaacaaggttggtaattgaaaaatgtcattatagtcgtctagatttatcggtgtatttggcttcgccactctggatatgcatagagtggtattaatttaatttagcttaaaaggcagccccatgtatataaggggctaattaattatctctagatataccctaatagtatagccaactactagatccaatttatctatagccaatctaatagctcattcatacaatagttatatactacactattaatacctggtcccacctgtcatacacacactgcgtcttggagtccgtgctagaactggctacaaatctatagcccgctgctcttctttttcctcatttatctccttaaaatatgtttgcagctagcttatagcttgctattgtacctgctctaaacaacatccggaacaagtgtagccacacttataattatgttatccgagtggacttaaatatttaatgctaaatcaagaccttccaccgtggtttacgtcagtaccactagtcactcatatggacgtacacatcaaaaaacatcccttttaaatgatgagattgtcgtagaactatttttttattaagttcattttactcactaaactacatttgccacagaatttaacccggaaccctagctaactattttcaaactcgtaaagtactaaattaagttggcttactttacttcctgtgtcaatatgtttctttatttttgttactgtttgtacatgcaaacatatacgacaacataatgatccaattaagtagtagacgggctaagtgtcaccaaaacaaacataattgcctaaattttatgacgagtaacaatcaatactacaaaatcaatttttgcataagatcaaaatcgattttcgcagatgaccagacggtccacctacaccaggtgtacgtgtatgcgaaaatcccatttttttgcatgcagctagcgtaaccacatgtgagacatgtggtcacctataccgaccgcttgtgaaaataatttcaaaacaccaaatcggctaccctagaccaccaccactagtgtcatcgtgcttgccatagtctaccgccgccgttgtcaacctgctattcgtggttttaggcctgtgatgacaacggcgattttcgcagaggcctgcaatggtcttaagcggccgtccgtgatagtgcatttcgcaggcggccctataaccaatcccgaggggagtaattttttcatgcaggagcagttaatacctgcctgcaacctattgggactagggagccttgtctgcaaaaatctttttatttgatgatatctggtttatatgtatcacgctatacgatatttgtggcagaaagaatgaaaatgcacgaaaaacaccaaaaaaaatgacattgcaaaaaagatgattttagaactaacttaaggatgggtttcattatattttattttcctagagatgaacttctttaattatatactgctggatatggtagcttgatttgaacttctgctagttagtgtgacgaccaaatttggccttactttagatttggaataaatttgaagaaaatttggaaagggttaaagtcttcgtgtaaaggctggtgtgttcagaggtcagaatgggcaattaactgctatctgactgcaggtattaattcgaaatagtgagacatttgatcacaatttaggtattttcgtgtttacttgcttagaggcctgggtttttcgagtctaatacatcacagcctaataggaaatgcattaattaggctctgtttaattaacgaagttccagaaatgtttgaaccatccataaatcgttaaaattaatctattacccctacatctatctcttatttatcatttttcattcatgtcttactcgttgtctcttgcctctacactgttagagacatcttacttgcccctactgagtttaggacaaatcaacgtcgtgcacagtccctagcatatccctctcgtgcacactacttatttcttagttatgtatggtaaacaatttcaaacaaagttctttaattttgttttcgaaaaacaaaggtgatatctgttcatatgcttggcagaacaatatatattcctctatcccattcaccacttgcatgcatattagtcctggactcctagctatagaatccttcagtttagttgtgggccaaaaacaccggcgccaattagctagtcgcctatcagtgtgcacaagctgcaacaggatgtgagcggaacatatatggtcccatttatcaacttatcttgttctattattcgcaagtccaaactcaagtcactttc

SEQ ID NO: 74409 - DNA, 1275 bp, Oryza sativa
atcggaaagaagttcagagcaaatgcagtaaccgcacttacagagttctgctaaaatgtgcataaaacatggcccgtatagtatagaagttcaatgatcttgaaaacgaacttacagcttcaaccatgtcgcactactataaaaaaaaggaaatccagtaagctcaactagacttctgctgaaaagagggcgcagacctaattagcagtagattagtctcgtccttataaaccactatggcaaacacagtgcctttctaattaatcttgatcacttccaactgtcaagtgtcaatgatctcttttacattgtggctgctatcttcacaaggtgtcaaatggtcaggtcactgaattttggaagaatatccagcttctccagcatcatgtggttttaaataaaaatcgtagactagcatggttgtcacagtttgctgagataattcccttaatggcatacatcaactattaacccttgaggactagcaaggttacaccaaagctggtgccaattgccatgagatcacagaaattaggaagaaacttcatgtggcttcagagttggctaactgccagcttctaaatctgattgacgctattatttccaatgtaatctacaagaaactagtgcccagtgaaatatcactgaagttggacagtatctgcgagcgggtagttccaatctgctgtgcaacatcaagctgctcatctaatgacaacatctcatagctacaagagaaaaaaccggtcaattagctaggcatgttatgacgtacaatgattaaataacccaccataagaacttcctacaacacagtacaatttgcatcaatgcctcagaaaaccagttgcctgctcacttcgcggccaacagtagaatttccgttcaagcaatatccccagtcaaagaagcctatcagattactacttgtttgtgtagtcctttcggagaaatagtatgagttcgtacaaggtattaagctaccattatgattaaaccattacttatagacatcagttgtgtatcatgttgtggggactaaacattattaccgaggaatatatccattttacaccacttaacaattgcaaaggtctaaattacatgcttcttcaaaattatctgtttcataaaggtaacttttatattatttatctgaatctcttatgttctaaaacagggttaaaacttgtctgaaggcacaactcaaccaagggcgccagctggtctatggcatagactagtttagcaattgacggaatataaagtggataa

SEQ ID NO: 74410 - DNA, 10658 bp, Oryza sativa
tccaccgccgccgtctgccgcggcgggagatgagggcaacggcgagcgtgatgaagatggcgaacacggtggcgaccatcgcggtgaggatccagacgcgcatcttcctatgttggccacataaaagttctatacaaatttccatgttgtgtaaggaggccacataaaagtttttatgtttttttgaaacttctagtgagataaaggttattttgggtatttttggaaagaaggctcaacccaatgttgtattatagaacaattgataaaatcgccggtatattataaaaagggacaatgtcaatggtaaattgttgaactcgaacaaactcagtggtatagaatagattttctccttttttttatacattgaatactacaggtttcggttgtggggtaagaaccggcacgtataatctctatcggtgtcgattccaaaactggcacatataccggacataggtgccaatatatcggtgtcggttgggaaaccgacacctaaggccagttcccaaccggcaactatggaggttaccgtactagtgaaattagcaaaaccaaagtgctaaattaaaattcatccacaccatcatcaaattgttagtttgatgtggttttgcaagaggacaatgaaaaggggcatcatgcatggtaccggaccaccaattttagaaaataaatattcaaattcacctgacattaaatactctctccggtttttaatagatgataccgttgactttggacatgacgtttgaccatatgtcgtattaaaaaaaataaatttgatttattttgttttgaactgtcttatcattaaagaaactttaattatgaaggtaataattttaaaagtcaatcgtgttatctattaaaaaatgaaggtaataattttattttttactgtttctttgtgtgtgtagatttcagaggttaaatgatatgaaaattttgacatatttgccctttcggaaaacttatttagactatcttagattatattgaatgacctatatatgaaaagtagagctgaatgggccggccctctagattgcttcaaacaaattaaaataccttagattatattgaatgacctatatatgtatcacctcccaaacaaactactattataaataaattgagttggattgtgaagtgatttgactaatatattaattgcaaatgtaacttcaacccaaccatccatatatagaacaacacaataataagaatgaaatggtgttcattaaaaaaagatgaaatggtacctatccccacgcaaatttttaccaattttaattacttgtggattatgagaattcatctccacaacctcctccacagctgaactggtacctcatccttttatggtttagggaaagtggcatcaagaggaccatgaccagttagggatagagtgcaatcctatatgctcaagccctaacagctctaggcttgtctctctaatccgttttaatcgtattaagaagtaatgaaaaatcgttaacacaaagcaagatcttatacgcatagcttaatttctaggaattagttctgatatatcacaccaataattacaaggattatacagacattgcacaaaagtacctaatcacttgaaaaaggcgtttataatttcaaacttcaattcaaaataacatttttgtgaactatggccagtaaacaatatcactgaaaaaaactgcagcctatttgctgtacatacacagtgaatttcccttaatcacatgagataggagtgacctaaaactaacagttaattaattaattagctaattgctccacttttagccacctttttgcacccctcttctgaccagacgaaaggtcaagctcatcatcctcgactttttttttcttctctgacacgagggcatctccagcgccgtcggctcgctgatcggatggcccaaggctccccttctcttggaatgttccaccgatgttctatggttggaggcgctgtgattccccgggccccacactacccattcccaatgacaccacccgctgggccccaccttagccgatcgccctggacacgaatccgaacagtagcagccgtcttcttcgtcgccactgtatataagctagccactacctctcccttctccttgcaccaccaccattgctgagctccaaagcttctagctgtgatcaagcaaagaagaattgaaaaaaaacatatatatattatatatatggcaggggtgtgggtgtttgaggatgggatggtgaggagggcagatagcgaggcgccgtcgaaagggctcggtgtctgtggtggaggtgggggagggaaggtgcttgtgcacgtgccgagcagcgaggtggtgacgagctacgaggttctggagaggcggctgcgggagctcgggtgggagaggtacctcaacgacccgtgcctcctccagttccaccagcgctccaccgtccacctcatctccgtgccccgcgacttctcccgcctcaagctcgtccacatgtacgacgtcgtcgtcaagacccgcaacgtcttcgaggtccgtgacgccgccaccactgcttccccgccatgatcgcatcgatgtctatgctttgatcatcatcgatatgaccttcctcgactccgggctcaggccagacacgccgccatggcgcctacaatcgtatgtgtgtattgtatgaatctcaattcaggtaatgaatgattgtatatcatatgatttgtaattctgtacaggtataacgtatgcgtatatacgtacgtgtgcgatcgatcgggtgtgtgtgatatatattaaaataagcgtggctggtttaattgcaagtgagtgtttagttatttaattatacgagagccatgagcacgtgtgtagctagctttggagtcttgtactttgtggtttggagccattgcttgactgattccgtggcacgaatcaatcatccatgcgttatgcagtgacaataaataattagttttgtcacaattaattaatagtatgttgtttgctgtattgattatttatatttccatatgattatgtgtgtgtttctcagatattgtccattcttgtcccacttcacttttctttctttgttagatggcggcgtcagctcaatttgggatcgaacctagtattgaattcatgatattgcctgctacatgctcatgagagagattgaatgacagtgacaatttcaattaatgtaaaatctaatctgatgaggggccggcttattcgatcgtaccaatcaagctagccaatagaaattgtgattctctattattaagttatttcaattcgtcatctattgtgaaaataacactgatgaatgatcatggaaatatttccatttattgtgttaaaggccaaataacaactaggaatattgaaggggtaagatttataaaaactatttattgtaattaaactaatatatccgatataacgtttggtcgcaaatgtaaattattttgatcttatactaaatcacatacacacacacacagggtcatattcgaattttttttctttttgtgatactgcatgtatcatgtatgtgatattcctaattacaaaatcaatacacaaattaaattaatacacacaaaaggataatctaaagcatttttttattaatttctggacttcgcatatagaagaacagattttgctatgcggtggcagataagagaaaatatgagctattcaagataattgcttaaacctttcgttcaaacctaactatattactctacaaactaacttagataggtaatacgtacttagcacaaaaccatgggttcatttttttttcttttgttgcaatatttgtagtagaaaatcaaggcatgacacactttgatactttcatggtctatagattccactgtccaatttcataacactgatatttttcacaatctttaagtacttatatatatatgtggatgcatatatatgtttctccttctatatatttgcattaactaatgtaatttctaacaaaagaagaaattaatatgatgttgttaatggactttctgatgctggggtatatatgagacaaggagaggctaggtctatacatctcagacattcatggaggctgcgtcatgatctctacatgcatattacatatttttctaccaccaaatacagaacatttactcacattatcactgtttagttaatgcataatttgagacagaatgcatatttgtggatatgttgcattgtcaagcacaagaggattagaaatattaatttggattctgcattatttaattatttaaatttgtatttgcataatccttgtaatagagaatcacagatttcattaggacattgagtgcaaacacaagatgaatctgccccttattcgccacagtaattgtcaatctactaaaatcttttttttaacgactcgcacaagacggtgcgaagttctattgatagagcaggagaaaaattacaaaattacaaccctggaaggtcgtaaccaggaaaaggaaaaaaagtatatcaccaccacaaaccgacagcgccaacacacaaaaccagaagaaggctagcaccagcccgacgctaatcgtgactgaccgccgctaggccaacaaagaaacacagccgagatcatccaaaaacccaaccctcacaatcaacacaaggtctcgctctatccaaatcttaagagttagggagagagggtgagagaaaagaatgcaacttctctccccccctaggccctccgacgtggccaacttgtagagactaggacaccgccacaagaggatgaaatctagagtgagcttgcaccaattggttggaggatttcggctaggggatgcgtaaacgatgtcaccaaggagagaagcgacgaaaaaaccgtcgccaccgtctgtcaagatcacagagaggaccgagactaggctttcgcccggcatccacacatgagggatgagtcggcacgacaacgccctcacgagggcaatgatgcttcgagcatgccgggctgggttttcacccgccgctcaccacctccgagtccacgactggcgccccaaagctccaccaccgtacaacttctgctgacatgtgggaccactgcaccgataccccccgccggctagccttagtgcgccgcagaccacaccgcacccaccggcagttcctccacctcgcaccttgcccgcttccgtcactgccggtcgcgcctcgtcgcgccatgctggcctcctccgccgctgcccgcgcctcctcgcgccaagccggcctctcgccgccggccgcgcctcctcgcgtcgtgccggcctccgctgccaccggccgcgcctctacgcgccgatctggcctacgagcactcctcctgctactcccacgccagccaaatgcggtcgtctgccacacctccccggctatccacccatggccgtcaatgcctcgatctccaccggccgacgctcccgcctccgcatccgccaccgtcaccagctgccaccgccgccaccaccacggcggctacatcgccatcttccagcagcagcgaaccgccgccgccgtcagccacagcagccgccaccacggctgctgcctcgccgaccgccagcagcatccagccgccgccgtcactgccaccgtcggcagccgccgccagccatgacctccgcgtcgtccagatctgaccagaggcgtcgccaccaccatcaccgccaactactacaccgccagcgccaccaccggctttggcggcaccccactgcctcacatcgtcagccgcacctccgtgcgtggctaggggagccagctccggccgcaccacccactaggtcgtcgccgcccctgacccgtcgccaaacaccgccgccgagcgctccatgtcaccgccacccctgacacgccgccgaaccccccccccccctcccgggcctgccaggtcgccaccgcccgtcgctgagctctccgccgccgggagcatcagatccagccatggggaaccagatccaggctccatggcactggatctggacgccgtcagaccgtcggtcgcttctcctcggtgccggcaccataccctaagctccagtcttgctggtgtcccgatcgtcttgaccgcgagcgagagagagagccccgccgctgctgtccttgcagccgcctagctttgccggcggcggctcgggcggcggtgaggctttggaggggagaagaagggcgggggcggtgcagcttgttcgcctcccgcgtcgccccgggacagagtgaccgggcgtgaatgtttttcctcaaatctactaaattctgaagtcacacatttttttctgggaattctgaagtcaactcatttgacgattgtgatcagaatgtacagtaatattgagtacgcttgtaaacattttatttagtgttgtggcaagggaacatgtaaaccagtagatccattacctatagaaaagtgtacgggagatcgaaacaaataaaaaactactacctagcaaattgtactgtacatatactagagcttgttgatgagaatttcgaaatgaactgttttgggaaaaagaaaacagaaaggactcaattttcgctttagacactaaccaaaacgcccattgagattgacaaagacagctagctcgaacaacgttttgcgttatgtggctagaatatattagctgactaggataattggacggcgcttggggcatgcttcaaaatcataggatagtgacactagtgacttttttcccaagttgttgcagtgatataaagcgctttaattttcttttcaatatacattaagcaaatgagacatatttagtattgaattaactgaaattttgattcttctgcaattttctttttgcatatatagtgactacaattcttttagaagtgttggtactttgtgatacctccttaaatatgtgccacaaaagttttatttatctgaatttaaaatattccgtctttatgaagaaaaaataatgcctcttgtgaatccattccatatcataatatgtaacaaaattgcacaacatttgctatgttcttattgtctaacaaggagcatatattgaagtcatatgaaataagcagtttgaggagacattcctgtagctacaagaaattaaattagcaccctccactgcaatgggtgtaatatattgtcaaggtacttccaatgctaagcatcaacagttgatgctaattaattaaggtgccataggatcaaaggaatccaaacgtgacaaaataaacttatacgtacgtgagatatacgacatgggaaacatggtatgtctggctttaaattcttaaaagcagctgattaaaatcaagagaatcaatagaatctagaaaaaaatagcttaaaaaaatgagggagctttttgttctataactacagattcggtttctcagaatataaaatataactacagattcggtttctaaatgctactaaaactgatttttgcatttggccggccgcgggtccttaacccgaccgcatgcaaaaacaaaaatatcaccaaaaaaatcaaaaaacccaaaatgcccaccgccggcatcagccagatccatgcggcggcgccgccgccatcgcttgccctcgtcctcgtccttatgagactcatctgtgaaaatcgatttttcatacgggtctcttaaggagtcgtatgcgaaaatggaagctgatttcacagccgctgtcacttacggtccatctataatttaagtagtgtattgatatctacagcacacccattagccaaatatgtataatcacagccataaatacaattgcgcatgaggacccattatgtatgtgcacaattccagtgtgaaccttatatctggcttgagcaaagacgactaattaagcatgtttctctaattatatttgtaaggtgaagcaaagccagcagaaattctctaattatacaaagttgaagcaatatttataacaccaaattaattgtattaaatccatcggttaaataattttgtaatatattttttgtgctacaaattaatactactatattttttcataaacaggtcaaattaatttaattaaaagagtttgatttaagataaatttaaaattgcttgcagggagtatcatatgtgtttgattggatctgtgtgaaggtgcggtgcatgataccataccatgagagcgagacggcaatttcaaatcgttctctcttactcactaaatccagaatccagctagctaaggcactgatgacacacaggacatgcatgcatgtgtagcacgccatatatacatgtgtccatgtgcagtgttcgtcgtgtatttaaatatatcttcttaatttgttgttattaccatcttaattacttgttcattagctcaattaatactcgcacacagtaatattacatgtctgttcatgcagtgctagtctcccaggctcccagcagtgcatggtcacataccccacttgagactctacttgtatggaccagcatgcataggaggctagctacacttaggtcattccgaacccaaaacactagacatgattttcataaactccacattatcaagaaactagtattagaaaccactcttccaatgcaaacactactattccatatttaaatttaatgctccttatctcacatgatatcttggatgttgtgtagaaaccatatctcatacaagacatggtttccttctctttcctcatttattcatttgccatatcattttttatttcaggtggcaccttatttaatatttaatgctatggacactatcttaatcattgggttagaaatggccttagtagaagccaggtgtgtggatttcagtaagctaaagcacatgggaagttgcacaatatgcatattatctatgtcttgtggtccattcgattcactagcttaattagcacatatagccttggggatccattgccataaaaagggtcatctctgactgtacgtactgcgagctagaaaagtatcgacgaccaaattaatttgatatgattctaaattaatttggaatgaatttgggcaaaattaaccatcttaatattcagtacaaatctgaacatctagagtactagaggaggcgctgaacctaaatcagctgaagtaatctgttttttattccaagattaaaatctgaatggaattctggaaagtttccgaattcgtttccgtttccaagaaaaaaaatctgaattcatttatgctttcaaaagtttctagaaaaattccaaccaatttttttgtgcttctgaaagtacgtttggaaatcggtaactttccgaaccattttcattcctacgtgtgtcccctcccgtctccacaccacacagcttgcctccataccaccaccatggatcgcgctcctatgacgtaaagtcaaagggactttgtcactgacatatgggtcccacatgtccttgtgggtcccacatatcagtgacaaagtccttctgactttacgtcatagaagactcatcccgccaccataggtgcacatgaggcatccccgttccatgttgcggaccactccccgcttgggttggcgttcaaacaaacactagagattcatgtttgtgtactaatgtctagcattccatccgttcccagatatgatacagcatctgctttttaatatacaacatcattgattttttaacaacgtttaacgattcatcttattcaatttttttttaaatataaaacaaattaaatcatgctagaagaacatttaatgttgaattaagtcacataaataaatgataattacataatttttttcagatgaatagtcaaacgtatctcaaaaaatcaatggtgtcatatattaaaaaacggagggagtaacttccaatatttaggtcctaaattttcttcacctgcattatcattctaacccatcacaacctttcatattttattttccccactacttactcttctctaccaatcacaatgtttcctccatttttttcatctagttattttacacctatatccaatactaaattatactccattcatttcatatatactataagtcatttgattttttccttaatcaaagttatttaagttttacaaagcttataaacaaatatactcaatgcaacacaaacatattatcaaaattatatttaatgttagatttaatgaaactaattagttgttgtagatgttattaatttttttaaaaaattaatttggtcaaacctaaagaactttgacaaaaaaaaatcaaaccacttataatttgaaactgatgtattattttgtgagggccacatgcgtaaaaatactcgcatcctatgatcattctccctagattaacctgaatatcaatggatgacaaactaatcaatcatattatccctccgtttgacaatataagttattatagcatttttcacattcatattgatactaatgaatctatcgtgcaccgaattgtatccgcttagttttccgcaagatatcacgggggattccataaggataacgccttgacgagaccatggcatcctctccacccaggtgtccgccgcacgccacgcccggcgcgagagcgcacacagacacgcccgcccgccaccgtacaaaacggtcgccgtcccagccgaaacc

SEQ ID NO: 74411 - DNA, 2087 bp, Oryza sativa
cagataaaatcattattgtacgtttagtttttcagttgtatttttctaaactagagcatgtacataaagttgtggccatattattttcttgttaattgtcaacggtgcaccgcttaactgatgcttgtattgttaaacatctaatttcttgcttcccaattattattctgcaggatcctgcagaggctgacaagttgctgaaaattcagagggatttggatgaaactaagattattcttgtaagtaactctatcgctcatgaattaatatatcctgattgcaatttataccctatgctggcaatggcatattccttatttcagtgtgcatggattcatgtttctgttttcagatattagtattcagcaaagaacactattggtatcttattttaattttgcttaagctacaagtttgaagtatacaatgagaaattttgatatgcttttcctgttggctgttagaaattagctcgagcaataaaatgtgtggttggtgttttatattattgtgtgcccggtagttatactgcaaattcttgcacgccattcaatttaaataaacagagggaaatcgaaccgtagtaagttctttttgtcctgtggaactgtgtatagttgaatgcgctggaccaggtgttctctatttttctggaagtgtctttttccccacccacgaataactttttaggcttgttttggttttgctctgtttgtggcaaattattcatttgttatctttaatttggataattgcagcacaagaccatcgatagtgtactttctagaggtgaaagattggatagcctagtggagaagagttcagatctaagtgctgcttcacaggtaggtattatgatatggcaagtgacagatcatgggatacagatccactctatgtttctgcttcagtgatttcttttttcagcgaaatgaaacctgtttagttaactctgcacgtaacaattgaactgtaaatcgttggatccctgaagctttatgtcccttctaattgggaaatttgctcctttgccacaaagttgttaggccttctcacttttgccttggaactagtacccagtatccaccaccagctgctggttgtagacaacatctaagaaaatctttcctagatcatgctaaattaacatatataaggaatgaatgaccctttcattcagtgctatctgataatattttctgttgttaatcaatcggttcagttatgatcttttgtgctgatttgtccctccttgttatgcagatgttctacaagcaggccaagaaaaccaactcttgttgtacaatcctgtaatagaaactctggtatagagttctgcagtagcacactatgttggcattttctttgctgcaagtctgcgattaatgtcatagcatcctggtgtccgaggtgttaaacaaagttagcggttaacatatgccacagggctaccctacgtaatttttgtaagtaacacaagtgtggttgccattgagatgatctgtgcctggtactgtgtcaaagctataattagtgatgaaattgtgtactgtcatcttgacccccaacttcattaacgatgcaagaaaattgtataaagacccgaacatgaggatcatcatgcacataaaaaataaatggaacagactaacaaaaatataatagtaaattttataaaacccaaattgggacggatgtaacacaaaaccaacatttacagtcaagtgacaaaaacagaggaaatatttataggtaatgacaggttaaatctccttcctggttcatgtcaacaatcccagagtacagcacatgtcaacaatgctagagtacagcaaagcgagcgcacctagctaggagtactcgacaagaacatggagtactcgacaagaacatggaacacgaagacaatagctaggagtccatggagtactcgacaatagctaggagtactcgaacagagacatggagtactcgacaagaacatggaacatgaacagagaccgtaagactgggtaggagtactcgacaagaaacatggagtactcaacaatagctaggagtactcgacaagaacatggaacacgaca

SEQ ID NO: 74412 - DNA, 829 bp, Oryza sativa
ggttggaaaaataaatatggggctttgtgtactgggatacagattgtgggtttgagtgtctctgttagttgcttcagattttaaggagcccatctagagatgttctccattgcgagctgagttttcctacgaggagaacactctagtaggagtagcttgcattgtggatgccctaatgaaggccttacgcatcctgctttctagaaagtgtaataccagccacctccattgacgcgtgggccccaggagactcctcccttctggccccacccgccatagacccctccaaaacccatcggccaagtcccaacggctccatcggccgcccgcctcgcacgcttcctgtaatcccgttggaggaggaagccagttaccacctcccgtctccctctcttgcggtggtggatttcttgccgacgtttccgtccccctctctcgctctccctctccgcagtccagaatcctctgctccgcccgaatcgccgccgcttcttccgaaccggtggcgcggccgcggagccctaacccctaacgcgtgctgtgacatctccggctgtgacaaggcagtgggggcctccggggacctcattttccgcaagtggaatccgctgctccacccgaatcgcctccgcgtcttccgagtcggtggcgcggccgcgagccctaaacctacggcgtgctgcgacgtcaccggcggtctcgaggcagtcggggttctccgggcggccatgtcgatggactcggtcatctcctcgcgcagcggcgccgactacaggagcttccgccagatcacccgggatcgtgagtgccttcctgccctgcccccacg

SEQ ID NO: 74413 - DNA, 1003 bp, Oryza sativa
gctagctcgctctcgccgcacgtgaagtgccagcgtcggcggcccacggccacgtgaggcgccaccgccgggggcgacaaggtcacgcgcgcgcgcgcgcggcacgtcgccgtccgcacgccgtggcgcgggccgcgcctcccgtctcgtgtcccccgccccgtgcgcggggcgcacgcgcacgcgcacgcgacgacggcgaccgcgtctacagggccctacgggatacggacgcgcgcgccgtcgccgtcgtgatcgcgaacacacgaccccgcgcgcggacgccggccgtcgccaccgcacgtacgctcgtgcgatgacgtcacactgatcgagcactggaggcgtccagttcgtgcgctagccacgtcgccgccagctggatgtgtattttagctgtccttctcctggcatgatttctctcaccgctgtttatacattgatgggggagtttcgtgctaggaatagattcggaccaacttgtagaaaaatataatggagaaaaaggtttactatagatatccacgtcaatacaggtaaacattaataaaaatacgtttttttacacctattaaattatatatctaaactccatccatacacagggccaaaaaaagcacattcagatgtgataaaaaataatcagtgatctctatttgtttttgcagcgattgaagaataaatgtatataagtgttgagtactccctccatcccataataaggcatgattaaacttggcgcagtcttcaaaactaatatttaacttataatttctcatataatataaagttattgcaacaaaattataaccatcttaaagtaaatttaaatgtcaattcaattaattttagcaaataaaatttaatttatattataataattgttgatcaaatgtttttaatgttgaatcttggaatgtgtgcaaggcttatattatgggatagagggaatagtacatatcgaatgtgcagacaccaaattcacactcacatcaatactgag

SEQ ID NO: 74414 - DNA, 26024 bp, Oryza sativa
gggcgatacggtgcgggaggcgatgcggtggggagcgaagggaccgagggcatgctccaaaacgcaatgaggaccactgagatgtaatccaacagccgataattaaatgatgacgtggcttcaccaaatctcagctttgggtcttaattttatagaaagaagggattaggacaatcgatcgaatcattagatccagagaggtgtttttaccattcaactgcaataccaagtttactgaacctacaggtattctttttttttccttttctgttttttcgcctgcgtaatttgggatcattggatgctttgttctaggtgtttgttagttctcgaaggcctgcgtttgtatttgtttgttgttcatatagctcgaatactatatgctaaacccaagaattatttggaagccggcaatagagaacagttcagatctaagcgctgttcctcgtggggctccatctcggtcggtgtctcctcagacataccactgtcaaagaaaggtaaaattcgttgccgctttgaacaaaagctgggagctgagtacgaatcacagcgacagaaaccatatttacagacaatgcaattgcaagcaagcagtgacaggtttatatctaatctccttcttggttcatgcaaattaacaaattctactacagagtgcatcaatcgaggagaggctaggatggtcagctcctccccgacaagaacaagatggagatggtagccacaagcccaatcatggcgatctgagcacgaaccggagcagcagcagcacgccccaccacctgcagcaaggcaaagcaatgcaaaagcaagcatgagctccaaagatcgccggtgaccggtgccagtatggaatggaattcacagtgattggttagctggaactggatttttgtctccggagggaacatcctctcgctctttacgtgtagttcaaaaaaagttattaaaaaattatcaagatagattaatatatgatatattttttcacaaacatacaagttaaaattcgacctatacaattcaaaacaaaaataataaatttgactgtgaattacacgttcacttcacagacaaaattattatttttgtttctacttgtataatttgaatttgagattgcatgttcgtgaagtgacataccacatattaatctatcatactaattttttttaatttttttatgactttgtaagtgacataaaaaaacgagggatattctcttgagggatgatttgagttttctttgttagcttaatttagaggttaattaccttgtcgttgccgtcgcctcggtccgggagcgggagcacggtggaggtgtcggtcatgccggtgggcagcggcaccgtcgggttgctgccgatgaacgggtagccctcgccggcggcggtcggggcgacaggtggcgccgcgacgccgaaggtcggctggagcgggaagccgaagtgcgggggtgcctgcttgggagcgcggccaaaggccggcaggtcgtcggcgccggcgatgggcgccggagcgggagcggagagtggcgggaggccgtggccggcggcggcgctaggcgaggcattgccgccgccgacgtggtggcctcgtcgtgtaggaggatgattcgggtgccactgcgagggaacgtcatattaaaaatgttactactagtactacttttctttcaaatgaaatttggcaagtgtagcatggatttgactgaaaaagaaatgcagttattcaatcttgaatggaatttggcaagtgtagcatgcatccttgctgcaatgtttggtactcctaatttaaactcctggagtatagtaaagcatgcatgcgatttttagggaatgcagctcagctagcagctatagcatgtgagcttcagcagagcgcatgaaagaaagcaagaacttaagaacagaaaagtttcagtttggtctcaagtttcgcgaggtgcaaagcggttgacgcaagtgagtagtgacgctaaaaattgtgaaatgcagaagcaaatggtaccccatttcttgtagctaattaattaagaaacgatgagaaagaatgtgaaaggaagaagatgagcgggttaccgaggaatcagccgcggcggcagctcgagctcggggcagcaaagacggcaagacaaccaagacggcgaggtgaaagtgaaacagcagggtgaggccaccgccatgattcctcctcttctccatctctggctcttgctcctgtgactgtgaccgtgagtctgagtaaataattaaacagctctgtctcttggaggagacgagggtagctgctgatctttaattcttggtcagttgcacttaactagtgagtgatgagtgattcagagtgttgtgcagaatagagagctttgtagccacaggaggccaaggagaggagagggaatggtgatgataatgacgctacagtggctacggacgcagctaccatgcaatctacacactacagtgactctactatcgtgcaaatgtacaaattgcacagtacacaatacagtgagccccaataccaaaagctataccaatagtatagtaaagcaaagctttctctcttcatctctctctctccctctctatgggctgcagcaacgaggccttggaatctctgtgcaagtttctgcttgctttgtttgctttgcttttggagcagggatgagtttacaatctttttttttcagcaatctttttttctggcatctttgccttcgtaggagtatatcattcaggtttgaactcatccggaaggaaatgactggagcactgcactgccaccactcactgcactttcatccagtcatagtgccagactaccagtacatgacatcaattgactgaggatttttacatcaatgcagttttgtgcagtttcaggcaggcagcaaatgcatcttttcttcagttaattaagctcatccatgtctctcctccaacagtctgcatctcgacaagtagaagaaacaaacagttagtaacagcaagagtgctgttttggaagatgagttttgactagttaaagcaccggctcttgttaaattactcataaaggtgtgctaaaggtaagtaatgagatgctaattacggcgggaggttcttttagttttaccggactgcgtgcctgtcctgaactgtctcaacaccgtcaaaccgaatggggagtaacaggcacgtagcactcgcctagttttgtcttccagagaaatggctccacattgcttaggattcgaagtagtcttcttgtttttaatcaaagccgtgatctgcaactttgtaataattgattatatttttttaaaaaaggcagaataaattgtactattatctaaaaatttgagttgccttgcttggatagacattactatttggtgatgtctggattggaatttggaagtggctgtagagcaggtacaatagcaggctataagccagctataaatatattttaaacagataaaggaaaaaagagaaaagcaacaggctacatatctgtaattagctgcagcacggactccaagacgtaatatgtgtataataggtgggaccagatattatattggctatggatgatttggagccagtaattagctatactattaaacttgctcgtataaagaccatcctctgtaagggcccctttgaatcgtaagaataaaaaaacagaggaataggaaaaatataggattctaacaggaatgtaagtgtaaaacaaaggattgcaaaatacaagaaaaacatatgaatgatcgtttgattggatcataagaaaaacacaggaatcggatgagagagatagactcaaaagatttttaccaagaggttggacctcttgctaagttttctccaaaacttacatgcaataaaccattccataggaattttgtaggatttgaaaaacttcaatcctttgaatcaaagggctacatagaaaaatttcctataggatttctatcctatgaaattccttcataatttctttaattcaaaggggccctaattttttttcttcgaaaacagagtcctctataagttagagtagtacaccgttctttatttcagtacattcatttttgaacggaatttcagtacattcatcgatccgatgatacaggatttcatgtacgtacaaacatacatatgcttgatatgcagcacatcttattgaacggagcatacagttactgtataaatatttattcagtagcggcgtacatacatgatatacggggtgtgttgattaatcaaataagttgccgtagtagtagtagctagccgtgctgcggctgcggcatcctggcgcaggggcgtactgctccttcgctttgtgcccctcgtactgatctaacatacatggagtatacatgaacagattcagttaatgtacgtatacacgcacgatccaatcaagatgagacgacataggtcacgttagctcgaatgggatatataatagggtttgttggaaccatgccaccctaattttataaaatttaagatatgtcactcgtatcttaatgacatgtaggacccacatgagtcaatgacatgtgggtcaaggttgcatatcacaaattttgtaaaatttgtgtggcatggttcaaattttccctatataataatgcatggtgtccatagcttagagatgatgaatcagtattgtagacattacctgagctaaattaaggtgttagtacttaaaaaagaactgttcgatattaaataacaggaaaaaaatattttaatagcatcgaaagttcacgattttaaaaatatagcactcaaaggttccgattcattttaataacatcgatagttactctctccgacactttatttaccatatcggtaacatttacttttttgtcgtatctcaatttatgtcatcaagtttcataaaactacactattaattattttaattttgatctatcacacttttaagttctacaaatcttttgagtcgttttatctatcgtatttaaatgttatgtccatgtaactatagtttttaaaattttgatatatacaagtatgtcaaattagtttacggtgtggttttatgaaatattaagagtataatacatgggttatacgtacttatgatcttgtataacttggaacatagtaaataaagttttatgaaatttaatcctaatactgatatccagaagtctatcttcttttttactggaaatcattgaccagaagtcaataacggttgagaaataaccactgtattaatgtattaatggtgggtcaagtataggttactggctaccaaccactagggagagccctttctgaataattgcggccatgcgctcctgctgcttgtgggagtactcctgatcgccggcgccgccctgctgcgaggtcttcttgctgctgctgccatggtcctcgccgtcgttgccgccgtggccgtgcctgccagtttcgtagtactccgccattctctcgtacgtgcagctaattaactctcaggtggtggtggcgaaagtattaatggatatgacgtttggatgatctcgcctttgttaatacagaggaactattaatcctgtaacttttggatggttaattattattatgagctagcttataatttggatttgtatatatatgtacaaagtacaacccagctgcatctaagaaaacagcaatcttaaggaaaagatgcatgacaaaaggttatcatgcagccatcagaatttctggtactaacattttacctcctactatggcagattcttactatccttcaccttagctaacatcgcaagagtcatctatatatgctgacatactgatgtgcagtgcatttatgcatgcatagttcttaagattcttgtgctcgttgttttctcgatctcttttcgtaaaagggtagtatgcgctcggtaataattcaccaattggggcatatcagcacttatttctttttctatgctccactcggtaaaagttattctcaagtcattaatgacagcacaattttcatttcaccttttcttcttttagcagcagaattttacgtcttcagtgttaaagaaaacatccacgtcgtctctaccacacgtccttattatgacacaaattcttcatgctgggtcatatatagtccacacatgtcaacaattttccgtaggtttagaggagttgaacaaaatgaaaaacttggcttaaacaaagtaaatgcataatactactgtttttttaattattaatgatgtagtcataggtgaacctagaaaaaaaatcctagccctacatatgtgaaaagaaacttttgaaagaaaaataactccttattagtatattatgatagacatttgatcaatttatacttctatatcatgatgtgcatttgattaatttatacttctaatcttattatatttacgatatttaagatatagaaattggatcacccatataaaaattctgatacactactggacgtagttgattttttccctaactttgactaacagtatttattcaattacctttttataagtaagttaaaagaagtaccattagatataccatcaaattaaaattgagtatcttaaacatcccaaaatacaaacatttattactataaatctggataatcgtgcatttagattcatattaaaagtcgctatatttatttttttggataaccgtccaaaaaggaaatgatggtgactgtacgaactcatctatttacatttttttttctagctactgctccataggatagtcgtacatattggtttatcattaggaaaacactggtatacgttataaaaagaatcacaattaatttggcgcgaacaattaaaagcacgcgtataattcatcacggcgcggcccagcaaggtcagccagtgtttgtccgtcccaatttctcatattgggccatttccggcgtgcggcgattaggcccgtgagaaccaagactgttggatccgctgttctccatgcggcacaataaaagttcgcctgttacgtacggcccatcgctagatgacggaggcgccgccggcgatggagacgacgaaccatgtataaaaacctttgacttttcgaacaatatttttaaatataattatatgttaagactattctttcataaaataagtcattacaaaatgaataatatttatatactttttaaaaagatgaatggtcaaattatcacgttattaaaggttaatgcgcgtcaaacattgaaaattgttgggagtactatttccgtcttaaaatttaagaatttaggatcagatgagatgtttgaaacgttgatatcttataaaccgatttaagggtctgaccccagacctctcattgggccacgtggcatcgcgtgttgccctctgtcgtgattctcggctggagaaggtgccacgcattcgcacccctccacagccgttagatgagatatcaacggtgaaaaaccatctggcggaccttgatgtaaattgtaagttttgacaggggtttttttcaaaacgtgtgatcttaaccggaagagtctgggttattagagaaaaatccaagggaaaaaaacgcaagaaaaatctccaactcattgtgccgccgccttgcgtcgaaccctcgatccacatcgttggcgcctgcttcgggcgacgaggaggggtggcagcggcttgatctacacggactgctccacctacgggggatggtgaggcaacaccggcggagggagatggaagcccccttgcgcctcctcgatgtgctcgagccggccgcctctccgcttcaggagttcagaggatgcggagggcgagagagtggggcgggggagagaggaagctgagctcgacgatgaggctgatggccagcgacggatggagcagttgagccgcggatttgcccatcatcgccgccatcctgcgccgccagtggtcgttcccactgggccatgtacctgctgctcatgtgctcctgaaggtcgccgtctctgcagccatcctcgcgtactcgcgtggttgtgggattgggaaacgagtggttgtggcttcatgggaaacgctgctctttcctacatgcacagtagtagtaccctggtctgcgtttctcttttttttctttttatttacaactattcacttcaaggctgcattaaaacatacccctataaaaaaatacagtactaccaataaaaaaagacaaatattatatgcccctatattacttaggtagttaggggttgtttagatcaaagagttttgatgcgtcacatcgggtattatatagggtgtcacatggggtgttcggacactaataaaaaaataattattgaatccgtcagtaaaccgcgagacgaatttattaagcctaattaatccgccattagcgaatgtttactgtaacaccacactgttaaatcatggagcaattaggcttaaaatattcatctcgcaagtgtgcatttagttaattttttagcctatatttaatacttcatacaagtgttcaaacgttcgatataacagggtaaaaaattttgggatgggatccaaataaggccttagaactcaaaattaaagctaaaattaaacttacttctaaagttgatttaaaggtatttttaatgtagtttctacttatttgtttttaagtcactaacaatacatatttttattttaaataagccgttttggtttattagaaaatatggacaatcgatgagaacattaatctatgtttgacagtgtgagaaggtgaaaagaaaatctcattttccgcatgtataccacccgaactgataaatgatatttttttcaaaagaaaaatctataggaaatttatttaaaaaccatattaatccattttcaatgtttaaaataattaatcatcattaattatatgctaataacttaattttgtgtatcatatcatcgttcttttttctcatttactcaaacacactttgagtgttaattattttgggataaattttaaacccaaaagagcatttttttttaatggatggagtggattagaatgcaaagtgggctaatagggtatttgtgaaattaattttctcatctatgggttctacagtaaaataaaatggtaaaccgggtgtcacccttcgtccaactttttcacttttgaccgggatacttttacctttgtggcattttataccgtccttagctattttatcgtatacaactatattgtcgtatgtcaaagaaacggtgtatatatagctgagggagtttattgaccaataagaccagaagtattgagatcattcatatgcatgagaagagagtatcaaaggcaacatcatccgatccaaagtgaaaacattgattaaagggtgatcaaaagcgaaacatcggtaataaaagatgacccaagtaaaaaattactccaaaaagaattttctagaaaagttatcttaaaacatattaatccattttttaggtttgaaataattaatatccattaatcatacgctaatggcgtatctcatttagcgtatcttatcattcttctcttttcttcttcacttaaacacatccaaatgagtagttatttggggatggagacagtaaattagaatgtgaagtggcccatatggtatctatgtaattaattttctaatctatggtccccaagggtaaaaagaaatcaagagaaatattaattaataaaataagaggataaggctacgataaggctattgtgcatcgtgaaacactttcattgtgaataactcgaagtgcatgatcttcacaagaatttgatgaaaatttgagctaattaatataaagtctagcaaaatattagcattaattaccctcagcaattatacaaggcatagagagcagcatgtcaaccagcacctttattttcccaaagagctggctcttgtcttattcaagaattgttaattatatcgaagatttggtaaatagtattcacgtgaagagtttacatgattggccaaataaaatattctgcatgctagcacattaatatattctacttattggcccgttatgcggcaaagctgtgtttgttttgagatgttattttgagcttagatttttctttttaccagttttcatttatccaagtgtaatatgtttgttgagaaataaacatttctagaatttttttcccaaatagaaatattccaaaaagaaatatcaccaattattgttgcttggttcattcttattccatctcatatatatatctaagaaatcaaactaattctaaataactatacaacatttatatatcctagaaaaagtacaagtattcatgggatatttttttagtttgtgcgccaaaggcgcaccgattttctagtattgtactagagaaacatcatatctaatactccctccatcccaaaatgtttgacgccgttgactttttttaaaaaaatttgaccgtttgttttattcaaaaaatttaagtaattattaattcttttcctatcatttgatttactgttaactatacttttatgtctatatagttttacacatttcataaaagtttttgaacaagacgaacgctcaaacatatttaaaaaagtcaacggcgtcaaatatttagggatggagggagtacgaggaagcagtttctatcatcacggtagaattcatcgatccgatggccacacgtttacagaaatcacagtacatatatagatgtacgtacacacatacactggtttggaataaggcgcgcggccgcggcggcgaaattgtgggtgagcaacgtatatacgtgtacgtacgtacatccttgctcatcttattgtaccgtatatatacgtacgtagtagccagtatttatttagtggtacgtacgtacgcatggattattaataatttgggggtgattaataattaatcagttgcagtagtagccctgctgctgcggcatcctggcgtagccgtactgctgctccttggcgccgtagctggcctgcttctgctcgcggtgctcgtggtaggcgtagccgccggcgcccaccgccgccaccgccgccacgccctgctcgatcctgtgcctctgcgcgttcgccgggtccttcttcgcctggtgcccctcatactgatcatccaacacatcgtatatattaccgatcgatatatatatattcagctaatttaataagcagttttacaatccttgagaatgtattatgatgtacgtaccaaaagttttaatgtaaacgtgtggtatacatcttaaaaaccataaaattgctctaatttaatataatgctatctctgtttttcaatagatgatgtcgttggttttcatcacaaatttaaccattcattttatttaaaaaattgtgtatttatatttttatttatttattttatcacttaacgtactttaagcatgatttacatcttatatagttatataaaatttttgaataaatgaattgttaaatatgtgtttaaaatttgacggtatcatctataaaaaaaaggagggaatacatcaagaattattcgaagatgagaagatctaagacatacgagagcgaaggcgccgctggcgagggcgccgatctcgccgacgcgctcgcgctgcttgtgctcgcgctcctcccgcttgtagtactcctgctgctggccgccgccgtagccgtagccgccatggccgctctgctgcctcatcaggtactcctgcgagtgcatggagttgttcctcctcccacggtcgatctcgccgccctcgctgtagtagtcgtcggtgtgggactccaccctcatgccaccatgcccgtgcccgtgcccgtgaccgtggccgtgcccgtggccgtgctgcctgccggtggtctcgtagcactcgtccacggtgctggagtagtactccgtcattgttggtcggtttctctcctgcagctagctacttctccgatcaggtggtggtgcaagggaagttctttgctttgcttgctgaatatgtgggggtggatttgggtgctatttatagtgtggcgagtgacagtgacgggtgaagatggacggcttggattaattcacaacgatttgttgatgatcgccgctctgttaataattggcagttacttattttggtactatctccatattttaatgtacgacgccgttaactttttatccaacgtttgaccattcgtcttattcaaaaaatgtatgtaattgtcttttttttattgtgactagattcatcatcaaatgttctttaagcatgatattaatattttcatatttgcacaaaaattttgaataaaacaaatagtcaaacgttgatcgaaaagtcaacggcgtcatacattaaaatacggagggagtatttgttagctagctagctaagccttgcctgcctaattgacaccggcctgatgtaacttaagagcaggtacaatagtaggctataaaccagctgcaaacatattttaagaagacaaataaggagagagaagagcagcgggctacagatttatagccagctgtagcacaaactttaagatacagtgtgtgtatgacaggtgggaccagatattaatagtgtagtatgtaattattgtataaatgagctattagattagttatagatgaattgaagttagtagttggctataaacttgctctaaaggcgccaccacggcaggaatcgctaccaccccttggatgacacgattggatcagtagatgtagaacccagctacgtactctccacttttttttagtaacgtcattgattatataaatgatgtttgatcatttatcttatccaaaatatttatataaatgttatttactgtgaattattttatcatcaaaaagtacatatgttacttttgaaagttttttaagttataactttcaaataaaatataattatactgtaattatattgtaactagaatattaacattataagtcttatataactagtatgcaattgttgcaaaaccatcctggcgcaagtagcattcggatcgcgagtcacgagttcgatatttgccgcacacacagatgaaagcacatgtctttttttttcctactctcctgcaacatgaattttgattcatattcggtggtctaaattttgaaagtttctagtaatacttctaaaattcatggcttgtactttacatatttacactaataataagatagattgttaaacattatgtcaaaattcaacaacatcatctattaaagaacggaaatagtacaaaacaacatttgaaggaaaagatgttcacacaaaggtttcctactactagtactaacattttataccaccttcattggccaatcaatgaagaatccttcacctacattgtaagagtcatacgttgatgatatacatatatagtagtttcttaagattcttgtgcgcgttgttttctctctttttaaaaaagggtatgcgattattcaccagttgggagcatatcagcatttttatcttctttcctcgccgcactcggtaaagttattctctatcgagaaatggcaacaccatttgcatttcatcttgttcttcctctgacaagagaatttcacatcttcagtgttaaaaggaaagcatccacacacgcgtcctgacgacagattcttcatccatgtcctggatgataataatgcacgcatgccgacaattttcagaatgtttaatgaattgaacatatatatgaagaccccggcttaaacaaagtaaacgcacagcatagcaaacagtaatacagtatgatgcctttaattaaggcacggatcaaattaatatgttccaacagagactaaataaacaggaaccgaggctatatgtccaaattaattatatagtgggagcaaataattagataaatggagataattaaaacaagtctttggacaactataatgtttctagctagatacgcatttcattatttttcaactcatcaataaacactttgataagtaagcttaataatcccaattcccaatccctaagtcaattatagacggacaaaacatcgtcctcctaggtcgagcactgtatgaatatttatggcacactacttattctatactcaaccagatagatattcttgtacagatgctggaatccacaatcactcaccacatgacatcgcacaataataatggagcaatataatataatgcagcaggcaaatcacacctttagctatcggaaacgcggcccagtatcacggcccacccaataggcaacagccgaccactacgcggggcccgcgaaggtcgattgtaatgggccatctattcttcgccctgtggggattagtttgggccaatagaccaccacgcggcccgtcatcgggagtgggcccgaagacactcagtccgcgtcgcctcgcatctcccctgcagctagtagctctcagtccttgccgcctgctcgacgaaatgcctcgccgccggcacaccgtctctccttcagcttcctcgtcgacgacgaggaggatgcacatgccactgaagcgcccgtgaaacagccagacgtacgtgaagaaataaactagctggccatatagccttagtcggattgaacactcaaaggttgagttgagcgcaggtatagatcgatcgactaactgatcgacagcgaatgaaaccaaatcttattcttcttcttctggaggaactcaggcaattcagcgattgaattatcctggctttgtgaagaaagccaaagaaattaacagtcttaatccgaaccaaaccatatatacagtatagtataacattcatagtctatattacaataggagaatactccatataaccatcgatcgggtggtacacactgaacacacagtagcatacatacatacactagctaagctagctatctgcctagatgcgtctatgcatccattaacttcttattatatactcactccattctaaaatatacgaatctaaaaaacatcaattcagattcatagtattagattgcgtatgattcaacgttaagttgctatattttaagatggatgatcgaacgaactatcttgtactagtagtggtagtatatgggccgtaggtagctactggtagctggctggtggcctcctcctgctgttggtggtggtgcactgccggcggcgccatactggttcggcggccggatcatcctgtggacgatcttcacctttctggtggtggtcggtttggacataatgccatactttagcatctccttctccctctcgagcttctccacttcgggctcgcgcggccacctgcccttgctgccgtggtacccgccgatgtcgccgtacgccctcctgccgccgccgccgccgccgtgcccgtctctcctcactatgggttcgtcttcgtagtcgtcgttgtcatcgctggtgcgcagccgctcatctctttcaacgacgttctgttcgacgatctccggcacctgcaccttcgtctccaccacggatggcgtccgattgtccttcatccacacagtcatatcatacagatgagatcgatagatgaattttggttgaatttgatcgtgagatcgaattgaattacctaccgacgctacaatttcgtcgtcctcctcctcctccttcattctctctatcatctcaagctgggcgggggtgggccacctggtcttggtgcgggcaagctcgtcctgcatcctcatggcgccgtgaccgtgacccttcctcctgcaatcatcgtagtcggtgcggacgtggatcgcctcgatcgaccttctcatcgatctttctctctcgatcgtgcaccactaacaaggtgtggtgtgctcttcagctttggttgatgtgagtgccggtggaggggactatatatttgtagcgtctcgcgagtgagactaaggtctttttctttcttctaatacagtctcagtttttgttagcacgtattttaaattgtgcatcatgcaaaaactttatatatatatatatatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaggtaattgaaaaagtttcatactcatttgaattgggtatatactcaatttcaacaatggtgcccgggcaccatggagcaccaaacaaatatatatatatatataagttacgcattttaaatggtgcatcacgcgaaaacgtaacatcagataaatccatttcatgagtataaaataattaaaatttaattaatcaaacatcgctggctaaggggagcgcccacaatggaaaagataattttgtttggtgcaatgcaaaagataattttggtaactggctaaggggagtgcctagaccccaaaaaaattgattttatttggtgctagtgctctatgttggtcaatttggcgttgccgtaatgatatagtttttaatcataaaagaatgtctaacatcatgcaggttatcttcatgtgttccaattggcttcactcttgttgtatgatgctttcacaggaacaccaagacactatgcgcaatggtgctacgcgtttggaattggtagccaagaaacttttattccagtttggatggcgcagtacctacagaatttcatgatagaatctacgtgattttaaaaaaactttatcttagtagatcatattatcggtagaagttgggggtttgtcccatctcatcttttttaagttattttctgttcactactgaactttttggttgtgtgcctacaggcagaggccggagatgtaaccattttcattatctaaaaaaaatttaatcaaacatcgatgactctctcgtttcgtgaacctaaacttaatcttcatcttgaagtctaccgaacgggacctaatgataatcacgacaaacggtgaggatttacttcgtcatgatgactggtgtatggttatgtagtacccgtagtggtaggatactaaggaaaagccatacaacatgcaacatggactagtggtttaaggggtaatttggaaccatgccattataattttttaaagtttaagatatgccatcagtatctcaatgacatgtaggaccccatatgagtcaataacatgtaggtcaggatgacatatctcaaattttgcacaattataatggtatggttccaattttccctttaagggaatgcggtgaaagaaaatttattgagaaaatatatttttaaaatatgaagcaaataatacatttcaataatccagtgaataaactgaaaataatggggccttaagattcccgtgcgcattgtcttatttgctttggagaaaagggatgtgcgttaatttgccaattgggaccataccaacctatttttaactgcgccactcagtaaagttattctgtgtttaagaaataacggcatcatttgctttttttttttcatcttgatcttttatcaagagagttttttcatatctccagtaggtaaagaaaatgcgagcatatcaacacgtccttatgacaaacacaggccgacaatcttgaacaactgcttgaacagagtaagggcacagtagcagacgatgttttctttacgtagttctcacgatgatgccttcgcgttccagacagggattgcataactaacaaatagaaaagaagattacaggacgacaatctgaacgcaaaacatcctcctcaaaaacagcaccaaatgcacacttcataattttctccacaaacaacagataaccttgatggagtgtctcttagatgctagaatccacaatcgctcagcactaaaatggagcaaagaagtggtcaagtgagaattatttcattccccaacatgccttaaaatactatatacatgcttcaacttaactaaaggacgacccgtataaaattataaatcgccttttctggatgcaaaccagaattaccacagccaattttaagtaaatagtccgcatttcaaaaggtaaaatgataaggtaatttccctcagaattgataaatacagtaaatggtgcccagaggtacaaagtataatcatcagttagttcacacaattttacaacaacataaaaaaaaaacagaccacagaagatcagcaagctgcatcttaggtgtttgcacccatatcttgtttgctgggatttgaggtaatttaaaaaagacagcatcaattcacggagaatcaattgttcacctatactgttgtccacaagaaaattggtagcttccgctggtacgaataatagtattctgaagtcagtacagagcatccgttaggataacatataaacacaatccagtagggattctttagttaatgcatagttatgtaaaacagtgtctaactttgatactttgattttccataattcatattattgaacacctcatctataagctcattattggcttgatgtcccaaaacaagtaattagattatattacacaagcatatactagctagtttgttatactacacttctatagtatgattactgtggttgtttgcatacagaataagagaaacaagaaaaatcagattcagttcattcagcaaaccatgtaacattcagtctagaatagtcaggaaagaaaatccaaatggcatttactaataccagtagtatctcccaccaatacttatattgttaaagaagcccgttcagtatttcacactacttgtaagttttaagttctaactaggcgaataacatggaaagtggccacaatatgcgatcatagaaaggaataggagctaactaaagttggatgctaacagatctcaattcaccaaggcgcggaaaaaaaatatggtgaaccagcatgacgaatagagaaggtgttttctaaaaaaaacttttgcataactaactgtacttattacaaaactatgttatcgtgatatttcagacctatatttcagagagttcattacaaggtacagaagacaaggtttagtccatgaccttgcccagttatataaataaaaatatcaaataacagtgactcatgtcacttcagtaatgtatctgagatgtagatgcagaaagaactatcgaataccattcatgcataactaacaaataatgaataatgtgcaccaataatactcaaacatgtaaatgcagatgcgatgggtagcaatacaaatgtcagggacaattttctgcccagctcagtgctcaccacacatgctactttgcaacctccaaagcactctcaatctgttggattagttgattagcaggcagcgctccctcctgcattgccaaaacaaaaatgaaaaacagcatagaccacaaaaaaagagataacctcattattgttagcattaacaaatcaattaaaattgagaaaaggtggatcctcaaaacttacaaagcgatgacaaggtttcccattcttgaagataataaaagttggcaatgcttcaatttggtaacgattagcaatgcttgtgtacttctctgtatcaatttttacgacttgaatcttatcgcctaacttttcgcttacttcctgaagtataggaaccatgtattgacatggaccacacctgacaaaaggaagataaataaataaatggagagatacactcaaaatgcgtttatcaatcttcctactaacaagccaagaactgctaagccatcatattatctgaatggtgagtaaccgttatcaatgagcaatcactttgtcagtttggtgttgggagttgccaaagtggtagagagaatacggccagactattattctctcttttttttctcccataaggaagaaatagatttgatctaagattttgattaaaaacaaaaacaacacaacagcaccttgcaagcctacacgatggacaataaacatacacttgtcttctccctttatccatggaaacactaaagattggacaaaaaaaaattgatcccattaataatgtgtttgcattactcaatgtgcagggaattccacattcactttcacaaggtcagtgatgcattcaggtaggaacaggacattacctccatcaaaactaactccttaaggtctaacactgtgagaattggagtacataaatctagtacagagcactgatagtgatataacccatcaagacatttggaacacagtttactcttaccagtagcttaccaagttgcatagaagtcgactagtacaggcttttcagacttctccagtaactcgtcaaacgaagagaacgtctgtttcttcgcttgaacctattcaaataaacatacaaacaatttttagaaacggaatatcaatattatgttaacagtaactatcaaattaattagaaagacatccatgaatataagcacattgaaggattggagaaaatactgatttggattgatgatggttaataaacctatgatgaatatctggttacacagcattacatctaatcatatatagttacattcatgaaagatttccaaccgatatgggtccgcaacaggtgtggttagcaaaaataaaactaagtctaaaaatattcatgacatacagccatcaaatcaagtaactgatgctgcacagtgatatgtgaagaaatgacaaatagtagggacatcaaattgttgactcaattattccacgggcaatagaagtacagaaatggtggctttggcttacactggtcccagaaagactgaactgggaccaacaaatctattggataactcatagccccaaatttcacttcgttgtcatctaaaatcgatccaggccagatcaccacagcaacagctagtacttgatgcagcgaaatcactacgaaatgctgcatcaaagcacggcaaaccaacgagcaacccgaacgaagctgcaacagctagtacttgatgcagcgaaatcactacgaaatgctgcatcaaagcaaggcaaaccaacgagtaacccgaacgaagctcgcggggggctcacccgcagcgtggcgccacggcgggacggcgcggccgctcgccgaagccccgccgccaccaccaccggcgcggcggagcggagcggcgccgccgacgagcgcgcgacgagggccgcggggcggcacggcgtgggcgacgccgccgcggcggtggtggtggaggtgaaggccgccatggaatctcgcgcgcgccttctagggttttgtggctggcttacccttatcccggcgattcgggaggaagaagaccaggtgcgccagcgtggtgcacccggtccaccacgtagatgcgtggactggttttcgtggaccgagtccacggtccacgggccagcagccaccaacctgcctggcccacggcccactacctcctctgcgcaaccgaagcaaggtgacgcatccgatctccgcaccaaactcctcgtggtggtttcgcagctctcctgcgagcgaattctagggtttgggaggaaatccaatccctccaaatccggattcgttttggaagacgttttggaggaggtagcatgagctcggcgcaggatccgttctacatcgtccgggaggagatccaggactcggtaattcttgctctttctctcctttgtccctttctccgcttccagcaaatgcgaaattagttgccgtcgtcctgtatgcatatggatcaaaaccaaaaattcgagcgtttgcgcgcagacataccccttagttgcttgattctgaccgattttgtagattatgccgatcgtcctgtttctgttcagatgctacctgtgatttgggatgtcttttatgtctagcgatgccaccaaaaggattaagagtacagatttgtcggtacactgtaagaaatgtctatccaatttagagtagttccaacgtatgctaggatgacatgttgtgtccaatgggcttgaggaatgggactgggtgacagggcgtgggaaattgacaacagtctggtgttgcatttttaacatttttgatgtaatgatggaagaattgtaattatgttcttgaacagaccttgaacagatttgtgttaagttggtagctgatacacttatattatcactgaattgccatgttacagactccatcactaattggtcctattaagctcataactcatgaccccttaagattaagaactgttggagtagcttttctgtttaactcatagtttcagaaacattctgcaccatcatgctgttcactgtgctattctaccattcctgaatatacatcttccttgcatctctattgttaactccctcacacattcagaaacatatttcatcctcatgcattttactatgctagattttgttatcgctgaagatatagccccttcgtgttattgtgctgcttatttccttcataacttcgaaaacatatcacaccatcaacacacatgcatctatcttattcttctaatactgaggataaagatatttctgtgacagattgataagttgcaaactactttccatcgatgggagaaaacaccgtcaaacacaggagaacatgttcatttgacaaaggagcttcataccagctgtgaaagcattgagtggcaggtgagaaaacagggaatatcagtgctgtcattctttgatgtttttggtacaggaagaagccgctgttgcatttaatatattagagttacttatcggaatatctgttttcttcttcctgcacagttgttctggtataactggtgtttttttatgttggaaggtggatgagttggaaaagacaatcttagttgcatcaagagatccagcgtactatggactggacgaagttgagctttctagacgacggaactggattggttctgctcgtaatcaggtatttcttgatgtttcatcttgtttcgctttttatgttatataaactgctgggtgacttattggaactttacaaattatacttatactacagatttcatgtgccttttcgtttgcgcctatttcattttcataggattatcaattaggtatatcctgatcatgtgtgagcatcttagaaatacaatgactgctaaacatgatatacagtggcgtgggaaaaaaaaagacacgagaataattttgatgttactgtgttctgaactctatgtagccaatgcaagtttcatctacgctggattcctgtttacgggtaaacatatccaggttgctgcagtcaggagatctgttgaaaaggggaagagtaattcaactttctcggcgcaccaagacatgggcacaagcagaagtaaccactacactgcacaagacaatgatgacttcattgcttcagaatcagatagacagcttctacttatgaggtcaattttcattctgctacatttattgcattttgcaattttgcaaatactttagttagaaatatatattgtctgccctgcacatataatatgagcactgcatttatgtttctgttaatggttagctggttgatgcataatcttcgagttacacttggaattgctaagaaggatatatttttggttctagcagtgtaaagttcatatagcctgatgttctgcacttatctgataactgtacttaatttaccttcaggcagcaggatgaggaacttgatgagcttagcgaaagtgttcaaaggattggtggtgtagggctaaccatacacgaagagctgtctggacaggtattgcccttgtcacacggcaaattgatggagatgttgcctaatgagccaaaaaatgttcactacagggccattcagtctcttttttttttttggctgggagtgtagcactctaaaaagaacatgtcagctgaagtaactgggaacgtcttgcttttttacaggaaaggatcttaaacgacctaagcttggagatggaaactacttcaaacagacttgacttcgtgcaggttagttgcttcattataaagcatgacgccgtcgttgtttcttgtattcaagatagtttaaatttccacaagttatttgttgatgtgcactagatgcttatatttatgtttcagctagcaatttttattgctgaatcagttaacaagcctgtaccatgtcatacttatttgctgcattcaagttgtgtagaagttcctggaaattagagtagtgccctgaaattattttcctctcattgcctggtgcagaaaagagtggcgatggtcatgaaaaaggctggcataaaagggcagattatgctgatcctcttccttgtggttctgttcattatacttttcgtgttggtgttcttgacataacgcactagtgttccaagcctcgtgttttgcggctgtacctacctactgtaagctgtggagaacagaaaacaaatacacgagttgctcatatctttcaaatcctacctgattattgctccatctctattatgatctttttatttcatacgccctatttttttctccaacaaaagttggataaacttttaatactcgtggcacgcttttcaaactgctaaacggtatgtttcgtgcggtaactttctatatgaaagttgttctaaaatatcagattaatccatttttcaagtttgtaatattaaaaggtcacatgttattagcaccttgttttccgtgaaacatttaatctttatcttcattttcaggagattcgaaacactaccagtctacctgtgattaatatatctttcacataaataaacaaatgatcatgtcatgcaaaatcatgcgtataccatcacttgccctcatcactgaatttatttcactaagattgcatacaagcaaggccataagttgaaagcatacagctgctaatccactaatccaggctaactagtagtagtcccagagtattattttattatctagaaaacgaagctgtctgcaacctcgaggacggaccacgggaggtcgccggcggcgacggtgccggggtttctggctgagcagttccggcgaacctggccctgcgagccggtgagcacgctgatctgccccatcttcaccatggacacggcgaactggtcgaagaatgccttctcgtcggcggcgaacttttcgacgatgggcttggtggcggcgtcggcgaagaggtcctggtcggaggtgaagagcccctcccggttgacaaggttgacgtagtacatgttgtcgaacacgttgggcgtccggacgtcgttcggcgtccggcggtcggtgcccgccgccgggcaggttcgccggagccggccggcgaaggtggcgttcatggccgggtcccggcgcgggaagaggcggccctcgaaggagctgcagtgcgcgaggcccacggtgtggccgccggagagcgccaccaggtcggtggcgtcgagcttgatcttggccagggcgtccagcagcgccggcacggcggcggtcggcggcggcagcccgctcagcacgtcctgctgcgacgcgaactcggcgctgtctcgccgccccagtggcaccttgtactccggccctcctgactacacgtcaaaaataataatagtaaaagtaaatttcagatactttaattatcataaaactataaattgtgaaatttcataaatattgatttagtaaaaaacttggatatttataactcaggcataacataaatgctaagaatttaaaccctataagctataattttgtgctaattaattattaaatctatagtttttatgataaatttattgttaaatatatatttctaatacattatcttaaatctgtatttttacaataatttgatcaagtatatatagttctataaaatttacttaaaagtattaattatttttgatta

SEQ ID NO: 74415 - DNA, 605 bp, Oryza sativa
cacgcggcacgcacccctcacccgcacgatgcgaatccgacggtccgcgcgtgccgcatcttcgttagcacggagcgacggtggtgtgtgggcgcgacaagttccgcgcgcgacacgtgcgaccgaggcccgcacgtgagggcggcagggacgcgtgcgggccggtccacctgggccccacttgtcagcgaccgtggaaggggaggagcgcggtggactcggttcttggatttccggctcgagtcggaggagaagatggttgggttggaccagtctgtcaggctagcgagaggtctcgcgtcgtcacgacgatttgatggttttggacagcctctgcgtgagagtgaaggggtgtaatggcatcatccggcgacagtatcggcagattagataagcatttgacttgagcttctgtaatttgacctcacttgagtgagtgagttagttaatgagacgtgctcggacgagcggcgatggataaaagcatgggcgtttgtactgcggagccatccaataacagctgctattgcttctgagcccaacaaatcacacgtgatggagccaggttgtacagtggtaagatcttgagtgttgatacgttgatt

SEQ ID NO: 74416 - DNA, 647 bp, Oryza sativa
cacatcaaagataacaaaatcacatatactttcatgaagcaaaactgaataatattattgcatatcaacaatgatggatttactggcggaaatgagacatgatagtatgtatacctgaagaaccatggatctctcatattctacatacagacccttctctttgttgctgaaaaatagaatgaatatcagagaaaaatcattaagatgatagaggctaactcaatcactgaatatttaaaatgaactcacaaaaattgtgttgactttatcaccactgtgtgagcaggtaagttgatcccatgtgccaaagtattcggcgtgcaaagaatttgaatatcacccttcaagaaaagtccctcaacgacactcctatcctttaggcaaagaccaccgttgtgataaccaactgaaaagttgaaataagatatgcatcaccaatcagtgtaatgttaggcaacacatcaaaacatgggaaaccattgtaggttgtgaaggtatcgtggggcgagaacaagattcaacatgacctccatgtacgagacaagcctgcaaatgcttgtcgctacaggttagtgcagcctcctttagatgttcatactgctgcatcgatttcataaatggatttgaatagcctagagaactcgcag

SEQ ID NO: 74417 - DNA, 20719 bp, Oryza sativa
agatgggtttcattttattgtataatttggttaattcatttctcatagttatgcaatggcttagtttttgttatacaaggattccatatattagagacatacggtgtgactcggcaaatttagcgattaatcaaattaacatgtttgtatgatactgcataaaagattatgcaatctaattattttttctacgacttggtcatgtctatattcaaattcgtagaaaaaaattactatattttgatgacacattagtagatattcatagatgacagcagacaagatatttatgcagtgatgcgcgcccataaggcatggaagtttctagacagttggtgtatgagccgtgctatagctaggatggtgcaaaccaagatgtgcatggtcataatacgttggagtcttgttgcgacgtgctagatgggctacggttatcataacgaggtcagatagtagcaatgatatgtctgtgtcctgttgtattttctgtttcatttgttatttaccacggtgaagaacccatttctcaaaacctcctcgaccaagctagcactacccaaaaaagaggtaagcaatgccggttggaaaactctctaccagtcttcccaaccggtactcaataagcggcacaacagtattaactcactactactacgtcaacgatttattcgtatagtcaaaatcaattttgcagcgggtgggtggttcacctacacccaggtgtctgtgaaagtatcaaaattttgtatacgggtagggcattcacatatgggcacttaagccatccaactgctaaaaaaaaaaaaaaaaaaaaaaaaaaaatttcaaaaccctagaatgtatcaccgatgcgacgcctggatcgactatcgtcgtcatcgtgcctggatccactatcgtcgctgctgctgccaccgtcatcgtcattggagaggcggcgaggtcagcacgggagggggaggaggtgctggatccggcactactgttgccgccgtcgacgggattcgcatggttgcaagccaccgccaccacccgagctctcgcttgagactgccgcccttgcccgctggacccaccatcgccgctctcatccgagaccgccgttgccgggggtggcactactacaaaatcgattttacctaacgagaacccctctaagttgtaggcagaccataattgccctcacatgcaaagatcgctcccctgaggacgcttcaaggaccgcatgcagaaatcaattttcgcgggcgggcatcttaacatgcctaactgcgaaatagacatatttttgcgggcaggcctgttaagaggcccacctaccactagccctccaggtcgagctcctccttaaaatgcataagtcctttcctcatcctcgtcctctactatcctctcctccacttcctttcttcttcaccttatctccctcacctcagcctcctctatctctctctcggcagaagctcggcgtcgacgacagtgcgatgtagaggtgagttcagcagtgaggcacatgttaatgttggtgacaggggtgaccatcggcctcgatggatctaccgttactggtgataggagggtcagatatgcctccactagcctcagatgagcagcaggcctccctagcttctccatttccatcatcgatctagcggatgcggcctcaagaggtgcggatccactgccgttgaactcgggaggggctggcctccctcgcctctccttctccatcgtccatccggcggcggcggcctcaagagggccagatccaccaccggcgcccttgggagcttcatatgcatccagtcaagctggggacggtgggagcagaggcaacgagttcggttgcgatggcgacaatgacgatggcaagtaggacgtcgctgagcagcaaagaccagtccatccactccagcgagggaagcagagaagcgtgctttagtctgtggtgacgttgatagtgacaccgacgacagcagtatggttgggttggctagggtttctagattttgatattttcggaatttttttgccaaattttgttttttgcaaaattcattttcgcatgcggttcagctaggcgcctcgaaaattactaatcttcatagacatctacgagtgggtgagcgctttgcttgcctgcaaaaatgtgttttgactatttggaaaaagggtatatgtagtagtgtggggagaggagagggagagatgccggacttgagtggaggggagacttgaagtgggggagagagagagagaggggaggggagaaaaaagagtgccaagagagaggggtatttttttgatgagggtggacctgttaagacacccggatgcgaaaattgattttcgtaagctgtccttgaacgatccgagggggagcgatttttgcatacggtgataattatagtctgcctacaacctaaaagcggtctcatctgaaaaattgattcggtagtagtgagtaaatcggcacatatgtgatttctgtgagaaaaggtaaattttatagaattatatctaagttactgttggtatttcttaacgacattactagaaatattcattctcagcaatggcgccagaaattgtcctggtatatttatggttacagaagtaatccgcaagcgcacggatataccattgtagcattttacccggaagtattccacggtattgtatttttaatcccaagggaagataataagagtggactatgctaatacactttatacatatgttacttgtaattgtcaaagcctaagcaggggttaattttcatataggggtagaatgacacgaagcaaagctaatcaaatcctcataataaagtaattctaactaagtggaagaagaattagaaagcattcaattcctatacttctagtatacactcaaatcctagtttacatctgctagtatacaatcgtgtggccaataccccctaacagtgccctcctggtacttcgagagaccaccccgggttgctgagttccttacgacaacctatcatgaccgtccaaccggggctaaatacggaggagtaccctccccagaaatttgtcttaggaatatgtactaacgtggaggaatacctgtactgagcaaacacgatttgagtagattgaacctatcttgttcgcttcagcagggtcttgtttggcccaagccaatgacggttactaccgacctcccaatgacggttgtaccggttttggtgcccccaaccgtcattctcaagctataataggacctcccctccttcattttaacacacaccaagaaggattcaagaagaaaaagttctcttagtttactcactttgctctagtgctagtaggattagaattagaatagtcttccttagttcttcgagtctccggagaattcgggtatggcccttgtaagactttatccagtaataaaatattcttctttatatagttttggtccttgttggtatttcttaacgacattactagaaatatgaattcccagcaatgacgccagaaatggtcctagtatatatatggttatagaaggaatcggcaagcgcacggatataccattgtagcatttcacctgggagtattccaaggtatcgtatttatttaatgccaagggaacattgtaagagagaactatgctaataatgtatatatgctacttgtatgatcagagtctaagcaggggttgatatattcataacggtagagtgacacgaagcaaagaactcatatctctcattaaacaatcctacactatgtggaagaagaaatagaaaagcaatcaattcctatacttctatacactcaatcttagtttacatctgctagtatacaactatgtagccaataccccctaacagtgccctcctggtgtttcgagagaccaccccgggttgccgagttccttacgacaacctatcatgaccgtccaaccggggctaaatacggagtagtaccctccccaggaatttctcttaggaatatgtactaacgtggaggaatacctgcattgagctgtcaccatcagaggcccacctctactatcccgcagcatatatccctaattaatgatatttaataatctaagtaccgtgcttacattactaaatactactctacacccgtgcacatgacatagaaactgataaatcagacattaaacccgcaccattgcacctctctggatggctacccacaaaatcggtacaacacagatataaggtaagaacagtactcagactaaacaaagtaccgaagatatataaagaagaatatttcattaaaattgaaagtattacagaaaagaatacaagagctgctagagccataccgaaactctttcgaagactccgaggactccgaatactattctattctactccacttagcactaaaatactaatactaaagtatgaagaggaatttgagctaacttgagtgtgttgagagagtgaatgagctcctccttttatagggccggtatgacggttgtaccaatgcgaattgtgcattttaccctcacaaccgtcattaagagtgcatccggatcgtacacgtggagggccaggctgattgggcaccgccagttcggccgaaacctgggctagcccaacaggcctccagcttcggtacagtctttgacaggtgggtcctattgacggttttgtagttaaggcggtttccaggacggttacacctggcttctgagccctctcatccataagcttgcttaggagtgaggttttctccactttctctttattttatttgataaattcctgcaacatattgttctccaagtataagtggaactatattatttgaaaacaaatatgcattgtaagcatagctaattctccattattttagttatattgacggtcaaaatttgtctgtaacgactgtcaacagttacacaaaatcatagggattttggtgcacgacacaaatccacatcattaaccaattttcacgaaaccacatcattaaccaattttacatactcctcaaaattttaaaatgatttagttacatccatgtaaaatttctatgatggattaaaaaaactcataaatttatcaatttaagatgtaattgtagaactcaaaaggatagatcaaagtaaaatgatcaatagtttggttttgtgcaacttagatcacagtacctagggttaagtgagatttacttttaaaagaacacattaagccagtgttggtatttcttaatgtcacagataaaatctgcaagtgcacggaagataccgatgcagcacttcaactggcagtattccaaggtatctatttccatagggaacgtgtgtgttcagttcctcttcaggttcatccaaggacacaaagaaaatgtaggcaaagggtagagatgatttcctagtgagaaacggtgtctacagaaagctcagtttaatcctaatgcgatacttcaggcactggccagctcgctactcccaaatgtcactctactacatacccgtacatggaggactttagtgtacttgagggctatcaccacctctacaccgatctcaaacctactgtgggatacgaaggaatcaccggaaattaattacccagatactgcgtctattcaattaataactactttagtgctagctaaattctaaagcgatcacaataaattaatggactttagtgaacaatgatcccgcatgctaattagaaaataaccaagaattattcacatgaagtaaatcttaattactcaggaagataattctattaaaccagagtaattaacaatgtacaaaaagtaagaggagattaccgacaactccagaactcgtccgatttcttctaccatactctccctattctatgtgtaaaataaatcatacaaagagcctcttataattcagctcaagctacatcttggtgtgagttggaatgaaggatgaggagtggtatttattggtggaggtgccttcggagtgtggagaccctccatggaatcatatgagcatcttcactctcctcaagccaagcgtctatttggatgacagttggagagccgaaaacggtagaaacccacattggggagcggttgctaccgaactcaacttgggcctgggctagtggcctctgtcagggttgggctgaaccctggccggctccgttggccccgtttttcctcctgagcactaatattgggtacctcattctattggtacggtggttgggcccatttggaggtgtttaattgggtttttggtccgaaactccataagtttgaatatgagtttgattctcctccttcatgtatatttcttctcaacttaggtagtttgtcacctacatctaaatatacaccaacactcgtggaaattattagaaatatatcctaccactattttggatattttatactttcagatattttatactttcagttttatgtaggtattgacggcgagaatttggtatttaacagccgtcaacagccagttcactgcttcgtgccggaatttcaattgttcatccacaaattaacacatcacagattcaatttctatcaagcctaaaattttactaaaattagaagaattatcatctttgcatggctgatctaaacttaaaaatttatcagtcatgaagcgaggcttttggttgttcccctgacgcgccctgaactaagctccctttcttttgcgatccatctggttgcgctgatcctcctgacaaatcaacttgtcaaatagcttctcaaaatcagtataatctccatagatgacctggttggttagttcatcattaagaccaaacataaacttctcttgcctcacggcatcggtgcgcacatcaacaggagagtagcgtgtgaggcgatgtttgtagatccttaagtgtcaaatccgactgccaattcctgcaagaaagaaaattaaagaatataaaattgaatactaaacttagaggtagtggatattactaactagttccacaagtcttggtgaatatttgtatgcatgtgaattatggaggaaaaccgtctgacatgcgatgaaatatactaatcagacgtgaatacacagattggatggcccaaaaatcagagtaaaaccaacatatttaaggccatccaccgtacaccatcatgaagacccactaggcagtgacccaggtgcaaggtggcacgaggcggctcgactaggtttggccgaactagggatggctgttgatatttcttaacaacattactaggaacttagtcccaagcaatgttgtcagaaatattaaacggtaatcgtatgggttaaagaaataattccgcaagcacatggatataccgctatagcatttcacccggaagtacgtccaagatatcgtatttatttaatcccaagggaagatatggtaggatagtaatatgctataaattcttatcatacttatgtagatcaaagtcttatgcagggattaatcaattgaggataaggatagatttgacacataaaaggttcagtttagaatactctcactaaattataagtctaggctaaatagagaagaaattagaacaacatcatttatgcacttctagtatatagtcatttagtatacacttactattgtacaactctgtggctaataactccctaactatgccccccctggtatatcgagaaaccgccccatattgtcgggttccttacgacaatccgtcatggctatccaaccggttaaagatacggaggagtacccacagcaagaacctctcttagccctacctacgcacgtggaggaatacccatactgagctgtcaccatcagcggcctacctctacagatccgtggcatatagcaccacttaatgatatctaataatctaagcaccacgcttacaatactaaatattactctacatctctacagatgacatagagcaactatataaatagacacttagacaatactattgcatatctctggtaagctaactacatatttaatacgagacaagtatgagctaaagttcgtactcgaataattatgcaagtatagtaaaggaccaaaactagataaagaaaagtatttcattatcggataaagtcttacaagagagggaacagatactagatccatacccgaaatctccggaagacttgaagaactagagaagactattataattctaatttctactagcactggagcaaagtaagtaaactagagagcttcttcacctgaatcattcatggtgtgtgttgaaatggaggaggtgaggaccttttatagctgatcaatgacggttaggagcgacaataccggtcacaaccactatagaaaagtcagtagtaccgtaatagccggttgtggctgggccgggacatgccggggtcagcagaacctagaggtccgccgacccctggccagcccccctggctgtggacttcctcttgggccctgacattttactccttggcccagtggcatggtggttgggcccatttgaagatgttctaatgagtttgtggatccatccatccatgtctgccacatgttgggctctgattggttgaacggtgaatttccatcatttctccatttatgaagtaatctactgtattcaaatactttgccaagtacaagtggacttggattatttctaagtaaatatgcatccaagcattgctagttctccattatttccggaagtattaacggtcgaaattggtctataatgactgtcaacaatggctgccctcgtgctcagcttccatgtggtgacagttatcactatcccgaagtcggtggcacaaggctcaacgcaagaaactgccatccaatgacggctggaggacatgtggaggtttgagaggagttggaggagaatatttccatagcatctccactctctcaagtcgtatccacattataagtagcccctctactcctcacttcaaatttgcaccaacaagcagactacaacttcacttatatacataggcattgctctttaagggtaggaatagaatggggaagctcggaaaggagtgcaccaaatttcagacatctctccggggttccggagaagtgccggatatgttggcattcttctaggggagttctggaggagtgccggagtcctgaagatgccggtactccctccgatcttgtacctcgatggatgcttcttttataagtaagtatttgtgatctcctttggtatttaattttatttagttttatcactctgcttaggtagactaccttaatcttctctgtgacgttgggattaggatagtaatcaatagcacagacacgatgtctaggctagagattacctttgtttgatgtgtgctccacgggttgtagaggtagttaacaggtggtgacagtattcgggtacatcatagagccatagccagagtctccttggcagaccaggggtaagccgatgcttgaagcaattgatagagttttatcttaacttgattaagataattaacccataggaatcctctctattcttggcctaccatatagttatttcccttggaagaatctcgttcttagattatacacatacgttgcctgtggatactatatcctggaatactcttggggtgaaggctacgactgtatttgtgcgcttgcggattattctgtcgtcgtaataaataataataggcggttgaactcgtgtaggtactctatagctatcttgtttccctaatgaagcgcatggaactccctcttattttgtgctacagtcccatcgggaacctatgccttcctgaagctacggcaaaattccgcccaagtgacatatgtcacagctgagcgggtgaccatgtagttgtcccaccaagcagaagcgggaccttgaagtttgtacgtggcaaagacaaccttctcctagtcgttccaccggaggaggttcatcttcttctcaatggcatgaagccagtcattggcttccattgggttgatggtgctggagaaagtgggtggcctgacatggagaaactaaagtagtttggactaatgtggtggtggtggaccaaactgctgattcagctgctgcagtgcctgatggtgcatcatctgctattgcatatattggtgttgtttttgcatctgctgcatatcattgtatgatatgcgtctaattggccaacacctgagcgattgttgaattctctagcggtggaggtggaccattgctagttgcaccactggtattggctcctccagtctattcctcactgctgctaccatcacctgttgcatggtcgccattccttgtgttcaccatctgaatggggatggacagaaaaagggggaaaggaaagaatatagactgctaaaaaacctaagctttattacattataatttaagtgcaattgtctaatctgaattaaaacaactacaaagaaaacaattcaactcctaattaaggtagtcataccgcaaccactgttgacggtcgttgtcgatcagtttcgaccatcaatattaccaaattaagagagaactagtgatgcttgcaatgcatatgtttgttagaataataatattccactagtattaggtatattaatcctttgtagagaatgacactaaagtggaggagaatcggcatcaacatagacgataaatcaatcggacaatgtcgagaaccagacttatgtatgaatgggaaaagaactcagaattgacacgatgaattaggccaaaattcacaagtctacgaagtgaagcaatagaggatccccaggcgaagatgggctggtttgggccagcccatggttcggccgaaccagggagttcggccgaacccccatctccactgttgaggccagggtttggcatggacgtccaagattgcaccccaatgacggttggagggtacttcggacaattcctcttccacaaccgtcataaccacctctagataaaggcttcactctcttaacttcaacacacacctcaagcaatagctctctcatttctcttaagtttagtttagtagtacctagctggtggaatagaaatagaataggagtcaggattccgtaagccttcggaagagttcgggtatggctctagtagcttttctcttctcttttgtatgctttgtacttttattagaatactcttctatatatatttatggtattgaaatattctccgagtatatgagtacctactttatattatgttcttattatactaaatatacggctagcttatctaggagatgctttggtgcggatatagtgtttgcttatgcaattactctaggtcatgacgatgatattagagtggtcatgacgatgatattagagtagtatcgggtagtttagacgtggtgtctagattacgggatatcattatttggggttatatattgcggatgagaggtgggccgctgatggcgacagctcaatacgggtattcctccgcgcctatatataatcctaagttaatttcctggggagggtattcctccgtatttagccccggttgtatggtcatgacgggctgtcgtaaggaactcggcagtcaggggtgccttcttgaagtaccaggagggcatcggataaagggtattagctagtatatcagttaactagaatgtatgtatactatatatattagacgtataggaatagatttcctttctcttttctttccacttagcttagatgatatattatgaggatgagtagttaatgcttgtgtgtcactctaccctttgattatcttaacccctgcttaaaatatgattatcacaagtaatatataaattattagttgagttctctctacatgatcttcccacgggataaaataaatacgataccattggaatactctaaggtgaaatgctacaatggtatatccatgcgcttgcggatgaactctgtaaccataatataccagaaatatttctgcgccattgttgggaattatatttcttgtaatgccgttaagaaataccaacaagcaattctggcgccgttggcggggaagattcataatagagattacttgaactaatactttatatttacctctgtataatcatttcctttgcaggctaaccttggttgttttcactttttgttgtgaaaacagagtagtgcatgactggtttcaacttgccggaaaactttaaagaaaatccaaaagctttcttccggagcgttaggccgcgagtcgttgctccgcagaaaactctactgacaaagaaaccagccgtaccagcgccactgaccttcaagacaatagcctgcaagactcttcacgagttcagtactccctctgctgataatgtggccatcgggccgcaagtcaacataggagatgtggatttcgatttgaagtccagcctcatcacgatggcgtaggctagcccgttctgtgccaagcctaatgaggatgccaatgctcatatgcaacagttcctagagatttgtagcacgtacattatcaagggcgtcagtcccgatgccgtcaggctgcggctgtttccgttctcccttctcgagagagcgaagcagtggttctatgccaaccgtgctgctgtcaacacctgggacaaatgctttacggcattcctctcgaaattcttcccgatgggcaaaaccaatgctcttgtggaaggatttccagtttccagcatacaagggacgagtctattccggaagcatgggaacgactgcaggagtatgtggccgcctgtcttcatcatgggatggacgactggctgatcctgcagaatttttacaatggactcaccccaaagtcccgcgatcacctggacgcggcagctagaggagccttcttctctaaaacagttcaaggagccgttgaattaatagagaagatggtctccaatatgggttggagcgaggaacgactccagacccgtcagcgaggcatgtaaaccttcaaggagacggaattacttgctgccaagctgtacctcctcatgaaacgcttggacgaccacgagaaaaggccacaaggcaccgtcaaggccttggactctcacatcacgtgtgaggtctgtggcggcacggatcattctgggaacgactgtccggaaacctgtgaggaggcgatgtacatgggcaacaacaccgggtaccgtccacaaggaggtcaggggtggaaccaaccacgcccatattatcaatgaggtaaaaacaacggtaacttctctaaccagccctccttgaaggatcttgtttttgcgcaagatgaaaccaccgatgcactaagcaaaaagcttgctgctaccgataagatcctagagaacataaaattcaaattagatggctttgcctacgcatttcaaaactagatgagctttaataagatgaaagaaacccagttagctcagttagcatccttagtccctgcaactgaaactgggaggattcttgggcaacccgactcctccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaaagaccgtgccgcaggagtactgcgacacgcggttgctgctgtttccccaacggattaggaaaccgtcagtagacgagcagtttgctcgttttgttgaagtaatccaaaagattcacatcaacatgccattgttggacgctatgcaaatgccgacatacacccgttatctcaaggacatactcaacaacaagagaccgctcccaacaacggaggtggtgaagctgacagaacaatgcagcaacgtcgtactccacaagctcccggagaagaagaaagatccgaggtgtcccatgatcacctgctcgattagggcacaacaattcgaccaggccttgtgcgatcttggagctagcgtcagcgtcatgccaaaagccgtcttcgacaagcttaacttcatggtgttgtcaccgacaccgatgcgcctccaactggctgactcgttagtccgttacccggcaaaatattcatgtggtcgaagtggagccacccaagacggacagcctggtgaaattcatgcaaaacttcctggagaaggaaacaacaatgcctaggaaccgctattggaggacgtcggtaaaatcacctgtaccggccaagaagttagagcagccggctcagaagaagccatcttccgcaccaaaatcaaagaaggtgtggaaggaaaagccgaaaacgcccgctccatcacctccagagacgggtagaaaatccgtgaactaaaccgaaaggaggtacggtcttgcacgtcggactttaaatgacgcgaccttcgccaacaggtaaattggtatgtatccgcatatttgctttcaacaatttgaatttttgcatcatcacatatttgaatttcatatttgcatttaggatttttgaattttgaggaaattcttcaaatgaatttttcaaagcaaacaaaaaataaaattttcaacaaaaattgactgtgccacgacaacactgaccgttggaatccaacggccgaaagtggggccggttgggcccaccaggggttcggccgaaccggccaggcaacggtcggctgcctcactttttgaggcaacagctagtgggccccacaggtcagttttgaccgttgtgggtgcactacttaagccaaccgaccgggagaagggacttcaccccatttcaacacattttcatcccctctccaaagtttgctatcaagttcattcaagctttgatagtttccctcaaattcaaaatagtttagttgcatatataaaagttgctttggtgaaactaaccggcgggtgaaactcttatcattcctaacccccgccgagtttgcatatgcaattactctatgttatgacgatgatattatagtagtatctggtagtttaggcgtggtgtctagattacgggatatcattatttggggttatatattgcggatgagaggtgggccgctgatggtgacagctcattacgggtattcctccacaccggtatataatcctaagttaattccctggggagggtatttctccgtatttagccctggttgtatggtcatgacgggctgtcgtaaggaactcgacagtctggggtggcttctcgaagtaccaggagggcatcggatagagggtattagctagtatatcggttaaccagaatgtatgtataccatgtatattagaagtatagaaatagattatatttctcttttctgtccacttagcttagataatatattatgagaatgagtagctaaaacttgtgtgtcactctacccttgtattatcttaaccactgcttagaatatgattatcacaagtaatatataaattatttgtcaagttctctacatgatcttcccatgggataaaataaatacgatacccttggaatactctcggttgaaatgctacaatggtatatccgtgcgcttgcgaatgaactctgtaaccataatatactagaagtattactgcgcaattgctgggaattatatttatagtaatgttaagaaataccaacaacgggcagcgacatgcaaccaccggcgatgggtgctggcgatgcacgagcaatggcgggaggtgcggggcatggtggcgcacgcgggatgctgcggctcatgtagaaacaaaaggggagaggggaaagaggaagtcctgtccagggaaacagcggtgaccagcgcagagcgcgggacgatggcaacgttatgccaaggagcagacgggctacggcgagccgtagaggaggagatgagaagggtcaagaagaagatcacttgcaattgaagaagagtgggttccggcgacggggagcgatgaccgaacggtggccgaggggcagacaggctcgacggtggtggcgacgcagctaggtggtgaccctagcgctgtctagtggacaactggaggagagcgatgagtagtggagctctctcgatccggagtttgaatctcttcattctcgacggacggctgctcaggaaccttttcatcaatcgagctagcagaagtggatggttgagcgagtggcttcatcgttagaggttcctctatcttggacactgatgccttcgactggttttcattggtttgcgtcatgaaggaagtattttctagaatgcgatccaacattattcttccttctgacggtgttttgtgcatgaacgatcctccagtggttatgtgcagatagaatgcagactccttatccaaacccgtatggaaatgttgcataagcacatactcgagtaaggacagggttggtacggactgcactaaattagtgaatctggaccaggctgcactgattgattcgttttcgatctgcttgaaactgagaatttctactcgtagggcagtaatacgggtaactgggaaaaaggcaagacagaatctgtctcgcaacttttcccaactaccgtttacacatccaacggtagaggtgtaccattgctttgctctctcttgaagagagaacgggaacaatttcgaccgcccagtttcttgtttcatgccacgaatcttaaggcatgagcagacttgttcaaagtctcgcagatgattgtagggattttctagatcaaagccagaaaaaggattttccctaaccatactgattagttgtgtaaatgggctccaataaaggaggtggctcatagaattcgccccgaggagcagacagctcaaaaagaggttgctccatggtcgagaagagtgacaggaatacttctctagtatagcaggagcgaaggtagaaataaaaaaaataaaaaggatatgaggatgaactaggttcagaaatgatcagcaaccgttccccggcaacggcgtcagaaatgcttgttggtatttaatacggtcacagataaaatccgcaagcgcacggatataccgatgtagcactttccctacggagtattccaagggtatcgaatccaagggaacgtgtgtggtcaaatctttcttcggttcatccaaggacaccaagcaaatgataggctaggatagagaggatttactagtgagaaacagtgtctagggaaagcttaactttaatcctaatgcaatacttcaggcactggcaacccgctgtttccagatgtcgctctactacgtacccggacagggaggacttaagtgatctcgagggctgtcatcacctctacacccacctcaaacgttctgtgggacatgcagcaattactggataacaattacctaaacaccacatctaagcaattactatctactttagtgtttataactcaccaaagcaatcactatattttagttgattacagtgaacaataatcttgtatgctatttaggaactaaccaagagataattctcacaagataaatctaaatttctcaggaagaatattatattgaattcagagtaataaacagaataaaagaaataggagaagattaccgacaactctggaattcttccgacttcttctactctactttcttcctattctagtatcaatatagtacaatagagcctcttataattcagctcaagcttggagtgtgtgagtgaagtgaagaggtgatgtccttttatagggcagtaatgacggttgtgagaaggggaaatgtccgaactgccccgcaaccgtcattggagagcatttggagcgtccacgccaaaccccagcttggatggttgagattgtggctcggccgaaccccctggttcggccgaacctgggctgggcccaactggcctagctcttggcccatcttctcccctggacctcctctatccatttctcggagttttgggttgatttactggtatttggatcaagttcacaacccctccttgtatagatacatgattctcctcactgtagtctgattttcctcccaacatcggcgtttatcgtctgcatacaaatatataccaacacttgtggaatatatgagagtaagcacctatcactctgttggatgttttattatctgaactttatgcagatgttggcggtatagaattgacatttaacagccgccaacaaggtgatcgatagatgcctactccttattgtcgaccagtcggttgtagaccagttacgtagcagtccccgcgatttgaggtacgactacaactggtcatcgatcagcggcgtaatgattctcccactacgtctgcaatttgttgagtacaactacacactcggtcttcgccttgtgtggtagtcacctcatcaacccatgtcgttcaaattatgtaagtgtttgtatgtgcaatatttgtccgttgatccccttttcttatatcgccctatcttgaagtcgatcctatcattcctttacactattgtcatatgcaaattcaatttattttcaattttcaaattcatattatatcatgttacccttgagcgttcactcgggggctatttgtatctaacaatctattatgtgttttgatttcaggaaagtcagacttcaagactttgtcgcagactctacaactactcgattactcgagaacggttgctggagtttgacaaggattacggaataaagcgatggtgtacctgccgagacgaaatttcttgacttcaatccaaattcttgattacggcaagataaagaattaagtcgtatactccgcaccttctcggtcatccgagaatgtcaagcgagcacggcaattgttattccaaggtcttcggtcgagaacatcaactcattcatttgcattgaagtcaggagctactgttagggttatggataccacatatccaatagtaatcgactaagctcggaagggcccaccatatatcaaatcatatatggaatcatacctcgtatataaaagaagttctagataaggaaggacgagtagagttctatatggaaacaataaggactactcgaatcgtatccatacttgtctccctagttctacttggacaaggggacatctatgggtataaatacacaaccccctatgaggagggaagacaaaaaacagagacaccagtcagaataaacaccaacacacggcgccaaacatcgatattggagatagcctagatggactcaatatggtgcctgcggaggccgacaagaggaatctagtgctatataggatctcgacgagttcgtactcgaggaggaagactaccctatcgtcgactacgtgttggtgatccatgccgccaagttgacgacagctagataggttatcccaattattgtactttgtgtgattcaaatgaataaagagcaacatcggcttcgaccaactggagtagggtcgttaccttcgtgtgaaagggcccgaacctacataaaaatccttatctctatttcttttacctcgacctcgcatataccctggtaccaacgatccccataccatgcaaataccttagttgtgacccaaaacgtcgacagctactttatataaatctgtgatccgttagatcattggtttctcttctttggaacccacctaatgataactatcatgtgttccctttctatgggcaattaggattgctttatatatatatccgggtgaatcatagacccaaaagtgcacacgggtgaatttattcggcctcagtgcatcggcaaaactagccatattaaaatcacattgcctataataaggtttttggattcatatattgatttaatttatttcataaataaatcatgacattacatatgtaaactagcataatcatatcatacaatctttggaagatcggttgcacaacaggaatgactcgcggtatcgggcattgacgacaacaagcaacacccgagagaagaggaagaagagccattgtggaggaacagcaaccagtcacgcaaagcgcttgcaaaaacattattgtcatcttctcctggtgcaggacgtcgaaggcgaaggttctggagagttgctctctcgattgccggtgcacgccagcgagcgggatggagtagactacaagtgacggtgcaatactgaggaggaggcaaaccctatattgattttgtgtgtgttacgtggaggtggcggcgcctgcataatcttcactccgctcctcgcaccagattattcactgtgtttctaaaaacaaaaccgaattttgtgcagcaaaacaaaattacaaaagaatactgtatctgtgcaaaagtgagggaccaattttgacgaaccattcgacacgcatgtcaccacgtatgcgccgcgcttgtgtattcccgttgttctctccacctcacacggtggcggccccagggttttaaacttgtgtattagaaatggggagaggaaaattttttgttcatacacctaaaaacctaataactagcttgtatagtatcacacactaataattatataatatatagcgtatataacataaaattgagtattagttcacacattgatagaattgatcatcatgtgaaattgtttaacatatagaaatactaataataaacatatcaaagtgccaacatatggaatagaaaaatgatagaaaatgataaattgggaagaaatcttactacagttctacaaactaggcaaaaacaattctacaaactaagcaagcaagcaagtacactaaatcaatcaattgcagttttcaatcataagggtaccgagctcgaa

SEQ ID NO: 74418 - DNA, 1547 bp, Oryza sativa
gtacccacttatagttttacatatttcacaaaattttttgaataagacgaacggtcaaatatatgctaaaaagttaacggtgtcaaacattttgaaacggagggagtatatacatcttcatctcatcaccaattaatcaaccactaccctttgttgttgcgcctttgtttgatcatctcctgtctccaaatgctttaatttaatgcatgaccaaagctaaataaagcttccatatgactgatggcctgcagtgcatgcaggcgatcgatatgcccaggctttttgattcatcaacacacacacagtacacgtacacgtacacgtacgttgaatatatatcaaaggcgatatggaatcaacaccacgatgattagcggtgatagatcctgatatgatcctatatgatactgtccgtgcgtgcgtaccctgcacttacctgagatttgcatcagcaaaactactgatctcatgcataaagctaaaaaagcttttcaacaatatttttcagtcgtgcatgcacagcagctagcacagagatcagctaatcaacgatcaatcttgaatatatacatacttctttaaatatatatagaaggaatacgccatataaaatttaattaggagagctacactggtggagaaatcatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggccccccccgggatctttagtcccggttggtaacaccaatcgggactaaagatcttaactttagtcccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttg

SEQ ID NO: 74419 - DNA, 1586 bp, Oryza sativa
  unsure (1)..(1586): unsure at all n locations
ccatcgctcgagcctggtccggcgaaaggggaaggcggcgcgcccgctcggtcgtcaggcgtcggccgaggtgaaggtggctcggcgtccagccgcccacgccggcacgccccacatgcggacaggccacagtgtcgcgcggcccgtcccttgagtcaacgagccggcgacaccgacgcactgcgcctgctcggccgacagccgctgcgggtgcaatggtgcgcccagccggcggctgcccctgcctggcttgctgccccgcggtcgccggctcgccgccgccgcacgccgcgccagccgccggcttgccgcaacgcacgccgcgcctgccgagtgccgctgcaacgcacgccgccgcctggctccttgcaaatttagggtttgggattggggattttgggagctgcctgggaggggatttttgtttcgaaatgggctcagttgcggcccaagtagaatgcgggccaagtgaaaagggggaaggagtagaaaatttagacccaacacagcagaaatggtaaaacaaggtccaaatgagtagtttaactctttttctttaactttttgcatacatataagaactatatagtatatattctttttgcatacatataaactttttgcatacatataagaactatatagtatatataccaattttttttccaaaaatcttgagtatacatatgaataccgctgaatcatagctagacccgcctctgacctcacatgcctcaagtggctaggagagtatcatcccttataaggagatcttccactcctagaataggtaaggtggtactaaaatccccatgcttactatcccatgagacgaacgttagtgattttttaaagaattaatatttgaataggctaagtcccacctatcaacaagctagggtcacataacaggtttattagattgggttcgaatatatgctagaaagtgcgcaacatatttttttcgattatcagttattaataatttattttttctcttttttttcaggacagaaactgaaagctagcttaggagcctagaggagtggtacccatacgagcgtggtaccaccaataaatctgtggtcagatatataatattaggcaaaatctaatccgcgtgcgctctccgttttgccttatcgcgcaacacgctcatcggccgtccgattccacaagtgctggtgcgtccgtacatagcctggtgattcacggacgtggcatcatctagagggatccaaattggaagccatgtgatgctctacactacgccggctttaaaaataattntctcttaaactaatcatccgatctacgatccgattacaccgttgtgttcgtaagaattgaatctttataacaagatctcacatgattatattttgatgaaaaaatagaaattatttntataatatatctaaaatacttttagatttcactagattacttctcagacacataaaagtatattcaataaagcctaaaagtaatttacatatattatagaagtaacttagaaaaaaagaaagtaccttatcatgacattaaaagtaaatcagttacggaggtaaaaacatgagtctatg

SEQ ID NO: 74420 - DNA, 4351 bp, Oryza sativa
actgtaagactctaaatttatacgtttaccgcgacgacagagtcgcgggcggcgagagcgaggatgtcggagcaggagacgacggaggcgccgcacgccttctcaaggcggtcgcggatgtcgttgacggccttgaacgctgacgggcgcagcgtgaggttgggcggcgcctgccgctcgccggggccggtggcggagccgtcgagcagcacggaggcgtcgcagccctgcacgaagcagtcgtggaagtggagccggagcaggccggcggcgaggccgatgtccttgcggacggcgtccctgacgaacttcctcacgacggactccgccttggggcagctcttcctgtagaagtcgaacgacaggccactcaccaccggcggctgccgcgtcgcgtcggcgttgccgtcgccggcagccgccggagcgcacaggcaagcgacggcagctaccagcattaccagcgtcgtcgcagaagccatttcctcccgtaattgtatttctactgctctaagtgtaagctcgtactgaacatacgcagctgtaggcttcaatttataggggagtatattttgatatctccataggatttcctctcgttgtttgcatgttactagaaaaattttgagaagatgtattaacatatgatatatgttcaaattcaatttttacatctcacagtcaaaaaacaaatttgactgtgagtatatgttcactggctgtaatttaattttttttacgagatgtagaatttgaactagtatatttgtagagtgatatattatatattaatatatcttctctatagtttttaattttttttcatgatcatttaagtgacatgtaaataacgagggaatatttatggatggatcaaaatagtttcataattgatagggattttgtttttggacatttaaaatattattaatcaaacttgtcatgcatgcatgttgacgtaggtgaatgcaggatgctttgtgagatgcaagatatgggcgagaagagaacaaccgatcctatctccctacgtcctgggtgtcggtgtactgttgattttatcggtttctccaggagttgggagtgcagggtagcgctcttggccaaacacgtcgaccactctgctgttcctgcccataccgtgtacacgtttgctataaacgcagcaaactaagaacctcggtggcatgatctgaaagtgctaagaattaagtgaaaaatcttgaagatgatgtgaattgaatggcatattctgaaaattctcatctactttagcatcatatgatcgagtaggttgtacgtgttcgttcagatatatcgaataatctgagtgtcatgcatggtgcacaaattgaagtgtggttttagccactttcattgaccaagcagtgaggcattagtccgacaacaatcttgttggttcacatatcactgtgcatagaaacaattctaatccctcaaggggatatcttcttgttctttgcatatcacttaaatggttataaaaaaattgagaatgtatattaacatgtgatataacactccacgaacatgcaagttcaaattcaacttctacatctcgtaacaaaaaaacaaattaaactacagctagttaacgtatatttaaagtcaaatctgtttttttgcgagatatagaagttgaatttttatttgcatgtttatggagtgatatatcacatgttaatatatctttctaatttttttaattttctttataaccatttgagtgacatgcaaataactcgagggaatcaaaatcctcttccgcctgtgcagcacaagagcgtacacgtactgagtcgtggcggatgagagaggttgcacctggcgctatgttgcagatcagccactagcaactactgtaccagtccagccacactagtagtcaccgtgcccatcattcatccggccggccggtctgtcccctgatacactgccgttgcattgtttgtgtgcattacagagtttttaagatggattaaacgttaaaaggatgagtagttaatagtctcattttacgtgtttgtaataaaagatacataccagatttcagtttatttgactttatttgaaaagatgtaaggctacaagaatacacgcacgcatgtacgtactggcaaattaatggaagcaacaaacttttgctgatcaagaaactagggagaggatttggtgatcctttatcactcgagtggacatgtacactcgttttatccacttcctagctagagatataatccaaggaaggtgcatgcatgtcctgttttctttatcgatctgggtttgctatcaaggaaattattttcctcctcaatttctctagaggattcctttccaaactcaaacaagatcagtatggatattcgaaacgcaccatgaccgaatcgaataactgacttaccctgcaactttttttatttttacagaattgacttgcactgcttgcaatccgcacagacaagagaaacaagaggcatcgaatcgaatcaaattatcgaagcaaatacagtaatatattatggccgatgtacaaagcggcggcggcggcggcatcaccgtcaccgccgtggcggagcgggacggcgagagcggctacggcgcggcggtgttcttcgcctgcctacccggcgcgctgatcgccattggcgtcctcatggtgctctactaccgctcccaccatggccatggagcgctggccgtcttcctcctcgtgctgtccgtcttcgtcttcctatccgtgtgcttctgttgcataggtctcgtgcaactcgccatccacggcagccttcccctggaagaagacagggttgctgctgctgttgatcatccattagacgccgtctgatgatttaattttgatttgattttaaattcagtattcatctgaattgtgattccgatcgagctcaaacatgaacatgattatcttgaattcaaatctttattgaaacgaatttcagattgggttatttgagggctaagttttttgtttgataggataagttcctaatttaaaaagactgcatatatctggttggatgtagaggccaggtaaaaaaatatccttataaaaaatgattagccacccacattgtttgttagattgcttagtttctacttaaggttaagtttggcttactatacgcaaaatcaatagccaaggttctcctatactaggtgatttcttgaattgtaatggttgatttccaaatcaccaaagttgcatggatccaataaatcctatatatttggggagtagattctgatccctcgaggggatatcccctcgtacaccttttttctttcaaatttgatataaatagttgtgaaaatttctgaaaaaaaaacaatgtagaggttgaatttgtctttttatatctcgacgtgtgaatcacatttggacttaagattttgtggagctgtatagatatgttatatgaatattgtcaaaattttccagaatttttcataaccgttttgatgtttttaagcaaacgaggggatatcctctcgagggatttaaatagttttcatatattcaactttatttgcaaataaaaaataagctacaaaatacacgcaagtgtacatactcatgacatttggaagcaacaaaatatttatcaaggaaataagcttaattaaactagccatccttgttagcaccctacagcaccaagctctcggcggcctcagcgacggtctccacgacggaccaagcacggtcgccggcggcggcggcgttggacaccgaacagcgcttgcggatctgcccctgcgagccggtgagcacctcgatcatgcccatcttgacgacggagtagacgtactggtcgaagaaggccgactggtcgacggcgaacttggtgacgatcggcttggtggttgcgttgaagaagaggccctggtcggaggtgaagaggccctggcggttttgcaggtcgacgtagtacttgttgtcgaaggtgttgggcgtccggatgtcgttgacggtggtgtcgttggtgttcagcaccgggcaggtgaccttgaggtggccggcgaaccacttgtccatggtggggtcgacttgagggaagaggcgcttgtcgaaggaagtgcagtgcgcgatgccgacggtgtgcgcgccggagagggcgacgaggtcgtgggcgtcgagcttgagcttgcccagcgcttcgaggagcgtggtgacgttggagtccggcgacgggagcgcgctcaggacggcgtcctcagacgcgaaactggagccgtcgtggcggccgaggggaacatcgtaccacgggccaccggcgaggaggacggagtcgcgggcggcgagggtgac

SEQ ID NO: 74421 - DNA, 3453 bp, Oryza sativa
gggttagtgacaaggcatttggcgatttattgaaactcgtcaagaacattcttccggggggaaacaaattgcacgagacaacgtacgaggctaagaaatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcttgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaagaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttccagaaggtcatcgatccggatagattagaagcccttcagaatgaagtggtgcaatgtctcgtcagttttgagttgatatttccaccttcatttttcaatataatgacgcatctgctttgtcaccttgtaaaagagatccgtattctcgggcctatgtacctacacaacatgtttcctttcgagaggtacatgggcgttctgaagaagtatgttcgtaaccgttctcgtccagaggcaagcatcgccaagggttatggaacagaggaggtcatcgaattttgcgtagaatttatcgaagaccttcgcccaatcggggtacctgaatcacgccatgaagggagactacgggaaaagggaactctcggaaggaaagcaataatgacggtagacaacaatttattccgtaaagcccatttcactgttctgcaacactcttcattggtagctccttatatcgaggagcacttggctctagttcgcgccaggaacatcggtaagtccgatgcatggattacacggcatcacattgatactttccccgcgtggtacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggagggtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacacacatatcttaattagagtttttatgatgaactactgta

SEQ ID NO: 74422 - DNA, 8611 bp, Oryza sativa
gttcctggtctggaggttatatttgttcaactggggttggttgttcaaatgtggctgggcctatgcaacatgggtatgttgtatgctgtttgtttaatattgattaattattcaactgttttactattctcttaaatatttgttaaatgctgttttctgcaaatgaactatactatgccatcctttgttatcctgtgcacttgcatatttgctgtgtggcttgttgagtatgttatatgctcattcttgcaatattcattcatcagaagaggagtacttcagtgaaggtgatgatctggaggattaggcttgttctcggtcaagttgcctgtggagtggagtcgccatagccgttccgtcgtttgttttagttttatctttccactgcgtagaatgtttttctttgagaggaactatccacctctgtaataatttattatttgcgagtattaaatagttatttatttgtactctattatgaatattgtcattgtgtgcctcggttgattcctggacgagggtttaacatacatgtaagcgtttggaattttggatagaaattccgggcgtgacatatttccattgatctatttcacctttgggcattaatgtgtaataattgactaagttttttcggttaatagtaattacacaactcatgctctaaatccatatataaatcatctgagctccgttttaacccattcaagttgtaatgaattcgctaaaatgtctagaatccattaaaattggtttattttgttgtttcagtagactttttgcatgtattgttgtatgctttgtttgtcgtttagaatccggcagttccaacactccgattttctacgaagtggtcaccgaggttcctatggctcaagagcaaggcaagtcatacatacaacattgatcttgttgaagctattttataaaatccccgcttttctattaaattgtattattttataatgccatgtgggatggatgcctgtcgtactcaacgttttgttaccttgtgccattgataacttggtatataaatgactagatgattggtttaagaatgctgaggtcaattaatttacaatggggttcactttaaattagtccttaattacattatgatgatgtaccaccatggtaatggtttaattaactaaaatatgctttaatggtgggttgtgggtgcatggtgttgcaagtcgtacccatagcaattaaggaccggttcttgcgaatccctgaagatatacacgtacttaccacatgctagcatgggctccaggctgaatctagagtgtatcttaacctcgtcaatatatcatggcaagggtagaggagatggtgcagttcggacctagctctggtctctgttgttttcggatttacctaggcatgagtggggactacccgctgcctgtttaggagtgggggtaaaacctgaggtgggtatgcttggttagggagagttatgcaaaggattttgtcatgatttccccctttgcagtgccgtggtggtacttcgaggcatggtaacatgtgtggaatcgtgtcttgtgggtaaagttgtatacctctgatcaaagtaaaactattcgaatagccgtgcctgcagttatcgggtggacaactagctcaccgtgattagtatctgttaacgaccaaatttggtaaatcataaattggatttggagtcaaaaccgaagccgatttggaaggagtttgtttctcaggaacatagtacgcataggctacgggttgcatcggttactgtctgcattggctgatactgaatcggacaaggagaagccaatgtagccgattttagtaagatgattctagaatcattgtcgggatcggttgaggtgtttaacaagtattgccatgtatggattaagtccaaagaaggcaattgaatctattaattaggatattctggtagtttccttagagatattatcggtaagagtccgattaagggacttgttcgtatttttgagttgtaatagagatagaatcgtgtccagcaaggacatatcatgtatgttgggtacaaatatgatctgagaccttgtaaatagatgacgaacagttcaataacactttcggcgcatcaccatgtcgcgaccgagaaaattgccttttcccgaacgctagtgtattaatccccgtcccaggaaaagacggggtacaccaaacaaacatggtacaaaaggcacatctttattatatcaataatatttacattattacaaaggcacttcaggcctgacaataaaaaataaacagcagcggactagcgggcctacggctccatcttcacaggcgctcaactggggtataagccaggactccacctaagacttcttctccaaagcttctcttactgaagggggggaatgattgagcaagaatgagtacaaccacagtactcagcaagtcccaccgggagatgcatgattaatgcgagggagtacaaggggtaataatataggggttaagttttgcagtaaacagcatttaaaagtcacttagttgcccaaagctattttgtaaacacgatcctagagctatacaatattattaatcaaggccgtggacccacacgaacctgccttaacccaaggcctacgatgattcagaccgaactggcaacccgaccctgggtcccagctcatcccaagccaacccaggccaaccattccacattttagttgttaagcaggttttaagaattaaaacactaacttgggtacattgctaggcttgcccataaccgagggcgcggctattcgaatagattatactctgatcagaggtgtacatctttacccacaagacacatcttcctcacatgtaaccacgtgccacatacccccacggcatacggacggaagacatgatatagtttctaacccatcctagccatagacaagagtaccgacccaaccccacctacggccggaacctccgggacaggtaggcaggactgagcccctagcaacagacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgcttttcaacagaggcccgaagaccggtccttatgtggccgaggtgctactagcaaaaccatgcaccccgagcccagcctaaaatcattttgagggttttgaatagagggggagatgtgcgtccaattccacaataatccaaccattccatagtgtccaagtgatatgaatattcccaaagtctagagttataaaaccacctaatgttgcctaaataattagcgaagcatctacctaaattcatactagtggaaccatgaaaagagtacccactagttggggtttggtttattctagggtgaacaaggtaataataacaatagcaataataataaggtcataacaaaggtaaataggcatggctaaataaaacagtgataacatgggaatttaaataaagcgataatgcattaatttaaatcaaaataatttcacaaagtgggatccaatatgttcaaagatgatgtgacttgccttgctcagagagaatggcctgctgaaccttcggcgacgaccgcgaaccacgcttcgagaacctccggaacgacagaagctacgcgaagcacaccagcaaagctaaaccctataaagaagcaataacaatacataaaaagaaagcacagggttctttaggttataacaaacattaggagacttgaacgggtcgattcagagttcgtatgaccaagatatgatcatccgaagtttaatgctgttatatagagatttgcggattattataattaggtttttcaactataaaacatgtgtaagcgctagcctggaaaagacaggaaggctgcgctgttgacatgcggaccccacatgtcaacctaaaggactgcggtagaccgagtacacagagacggtccacgggtcgacggaagcggaccccgtgtgtcaaccgaggcgagtggccgacaaacggactccactagacaccacgcgggctgcacatgtggaaacaacgcggctaccgagcgggcacactaacacggacactacacggtcaccacccgcacacgtgaacgactaccgacaccggtacacaggtaccagggtcaacaaccgcacaacgggtacggggcgacaccgaaaggacgaggacagggcagcaagaggagagatccttaccaccacgcgacgaggcgtgggaacgacaacgacgaacgggcgcggcggagacggccgggaacgtcggagacgaacggcgaggggacgacttcggcggcgatccttggacgaagttgcgacgcggccggcacgaggcttgacgacgcggagccgaggacaaagacgatgacggggctgcagcggctcacttgacggaacgcggacgacgaacgcgaacggcttgacggagggacgaacgccacgacgatgaggacgacgagaggaggacgacgacgacgacgactggggccggcgaggaggcgacgagggcagccggtagcggctgcacggagacgaggacggcgcggaacacgccgttacgatgatgacgagggaggcggcgccgcgagacgacgagccggcgaggaggagcggccgaccgaagggacgtcggcgacgacgaggatggagaggaggcgatgccgcggacgacgtcaccggctcgccgctgcgatgccggaggtggtggtggcgcggccgacggcgcacgggtggaggaagggccgaccggggaaattccggcgaggtggatggagaggccggcgcggcacgacggtgttccggcgaaaccgaggagtggctggggaaggagacgatgccacggtatcgaaggagacggcggcgtcgatcggcataccagcgacgaacaggagccggccggagacagcacagtggcgccaacaccactggttgccggcgggggcacgccttcgggggtctccgcgggaaacggagggcaggccgggaaaggggaggcgactgcgacaccgagggaggcgacggcacgggcgaccggcgcgcgggcgaggcggaaggggcgactggagatggccagcggcacgggagagagaggaggacggtggggagaggtggtgcggccacgggagagcgcgggagggggctaaaacgatagaacgcaaagagtgggttccattttataggggaggagagggagccagccacgggagaggcagggaacggcggcggaatttgtggccggcggcaatggaaggtggccggggttggcgcgtccgttcccggcgattgggggcacgattcaagggggaaattagggggaattgatgaggaatcaatgaggattaaaaccccctaatcaatttggaaatagccggcttgaatggggcggatttggaggaggaacggcgctaggttttgcacgggagagagaagaggccgagcgggaggaggaagacgcgcctggcaggcgggtcccacgcggggcacgcggtcagcgcgcgtgcggcgcgcgtgaggggggggccggctcgggaggctgggtggggcggcttgggccgggaggcggcccaggcgggaggggaggaaaagggagctgggccgaggggaaggggaggcccaagagaaggagggagagaaggagagggagagaaagagaggactttggccgcaggccgagagagagagggggaggactttgggccagacttggcccaaagggaggaaggaggatttatttttagtttttattttcagtaaactttgttaattgttgttgttgcttaataaatattttcggtgctctgaaaattcaagtaaaatttgagggctccttttagaccaaggagaatttaacaaaaatctccggactacattcgaatttttcttgtatgtattttagtgtttaccaatttcttttcgaattttaattaattctattattccttttagagaatgatttttaattttgggatgaatttatcaggacgtgacacgccacccttttctattttcattatttcgacgagttcttgcttttgagttggactgcatcggtttcgttctccgacgaaaaggtaaagcttgttatggtagcttgcgttctcgggattagtgcttacatctctatgacactctaatcctgtttatgtaaatcgtcgaattatcatatatgctatataatctagatcgatattgctatctaacctcatcggctagcctctattgtcgaaaactgccgatagggttagatactgacttcgaattagattatatagtatatctatcatcatgaaaagtttgtcatcagcttgtttagatcttatgtttctctctgtgcttaatgctgcattagttaagtttgatttattaagtaatatttagaaccataatatctagcttgtttgatgattgctaatttaaatagcatcggagtttcagccgatcttacctgatttagttatcttgttccttatatgttacttgatatgctaaatctgtcctttatattgagatctaacttcgatgaaatatattaagcctattatcagtctgttaggttatcctgatgttagattgattcctgtttagtatatttcatctatattaatatcttagtataaagtagtatcggagtaatagccgatacatgttagatttgctttatcggctatgctatgaatatatataatttttaatttaaagtaattttagacataagtgatttatactgtctcggcatgctgtccgatctatagcaatcacttggtttaaacatatttcgatgtatagattatatattattgatatctacaaccaatcaggtagatctaactatttccatgatttatatttcatttgacgatcttatacatgttgcatcgacttaatattgaacgatacgtcatcggctatcgttgatatatttaaatttgcttctctttgtctattgttagttgtaggatcaaccaactggcacgccttgaacccgaaagcaaatctttggacctgcactagagtaaagcaaatctctcaggccagtgtgtgtttttcgcatcgacagtctcatactaaataatatgacttaatgaactagtgtagttcaggtggtttggttgggccggttgcaacgtggtttagcgttgggcagtgatatttaatattgcttaactatatctactattttattgtattcaaactatgttttataaatgctacttttatgcaaatatcctatagcctttcatttgtgaatatcttgcaccatacctttccattggtatgacttgttgagtacagtggttggtactcagtcttactttatttttctccaatcccagagacaaagaattattcaaatggagaatattttgaggattaggcttgatctggatattgaggatgcctgtggatttggaagaagctacgtttttgttgagaagatcttcgttttgagttttcttttattttattccgctgcatttgtaagacttatttattacttttgtaagatgtggatctgtgtatcagtttgtcatttgtgtactctggttggtcctggacatagatttttctacacattctgcttgaaattcgggttagcgaatttctgggcgtgacaagagggcacttcaaatcctagcctttccactccttttataggctcaagggtggttgaaaccctaactcagccgaaatctgagccgttcattgatccttaccttttaaggaaacatcggagatttcacctatccttttataggcttaagggtggccactgaaaccctaactcaaccgaaatctgagccgttcgttgatccttacctcttaaggaaatatctgagatttcagccacgtagttggccacagatccaatctcccacagagaatccacaccgatccacgcgcactcttccgtgcagcccaattcgcagctgccacgtatcctggcttctccgcgcgctcgtcagccctggcccacctaacagtgagacaaagcggcgacctccccgtgctcgttccatctgtggcaccgcaatctagagtgacttcctccgcgccaatcacgagcctgtattttatatatacaaactttacatgaataaattcgataagaatttaatttataaaatttcaaaaccaacacaaattgcttatatggtcagcaaggcccatgtgcatggattctcccctcccttgtatttggcatggtcaaaaaggcaaagaagatgggctatgcccgaaatggaaacaaggcaaaaaatggaaattttgaccaatcactggtggagaaaccatctttggtcggtcggccgaaatccacaatagttccgaatccatttaaaaccgggactaaagatgatctttagtcccggttagtggctacaacgggcatatgagatctttagtcccggttggtaacaccaactgggattaaagatcatctttagttccggttgtagagatgtcagacgttgtcagggcccccgggatctttagtc

SEQ ID NO: 74423 - DNA, 8792 bp, Oryza sativa
ctcctccatgcttagcctatgcggtgaataaaacatttcgtaacaatctgtggagtcaatctggtcatagttttttttatgattgatttcatgggtgttttgcccctatgttagcacttattctcttatgtgcataagttgctttgtgcattgcaaattggctgttcattttaagtaatttgtcgatgaataatgtaatgcatcctccaaggtgtcgctcctaactgtgttgacatacaggcttcctgatccagctgcaagaaaatttctctgtttcgaggattcaataggcttgcagacggagcaccagaagccagattctactagcactggtgcaaaacagaacagctcaagtgatgataactcaagctcaacagatggcccacccgtcctaactattttggctggtatcattgtgttccttctagtcttgtgggttatcggatcgctcttcacctggattgctggtttggtctttggcgctgcaaaatcttagaagttcaaattttaggataattctgcacctttttagttgtacatacttcggtccaattgtatgccaatcttggataaattgcacttgatggtttcattcttaagtgttgaacaactgcttcatggtgttgtaccattgtttccagctgtgccttgggtattgccttttcatatgtcatttcgaggtggaaacagtggtttggttctgttcttttgtatgaatccctgagagtggaatttatagtaaaaaatttaacatacgggtctcctgaaaatgcaggcttgtgtgtttcattcatcagtctctgataaacattcgcattccccctaacagtgtacacgcacctaatcgaactgaaactccatacaagttgccttttgagcttgttgtatcagtgcattgtgatcttataatgctttgctatggacagtacaatcataccgttctctgactgctgaataggagtatatgccatgccatgatgtcttggcattcagttcagtctgctcccctcccaggcatcagtgcgactgtgaacgtgtgatgagtggtgactgttgaggttgaggccccccctgtatcatcatgcctgtcatgctatgacctcatatgaaggtgaactcaactcctgcaacgcaatcccggtgtagtaccaaactgcttttcgttaatgctcatatcagtacagcattactacgccattgctacggtcatcatcaatcaccatggatctgaatcctaacggcctgaaatcctgaatccacatcattctatagtccctgtcagatttcctgcccgttcttgctcacgggagaaaataaatccccccccccccccccccaccaccacagcaccactactacgaccgacacgagccacagagtcagaaaggcgtctccctcccgggaccagcctgcgccgcaccagatcagcgaccgaccgcgccagcgtcgcgcgcgcgcgcggcacgtgagatcctcacccgcgctccccaacggctatattccccatcaacctcctcttcttcttcgcctcgtctcgtcttccccttaaatcccgcgcttaaatccccctcgcctcccccatctcccgctcctcccattcaccaacggattcactgtgtcaaacctccgatctctgcaatggcagcaacggcgcagggcggcggcggggcggtgtccgtgcagcacgtggcgagggcgtcgtcggacgagctcctgcgcaagttcgccgacccggacgcgcacgccaagcagatcacgccgccgcggcgcagcctcgcgctgcggcggaagcggtcgtccaggagggtggcgtcggggctctccgcgagggatttggagtcgggggcggagctcgcggcgcccaagcggaggcggagcatcggcgggtccaccgagtggaaggccgggctgctgctgccgacgaccaccacggcctccgcccgcaagggatccgccgcgagccactcccaccggggcggggccgcgcgcctcgatgacgccgccgggatcggcctcctcctcgccgcgttggagcgggtaagctaagctctcaactctccaatgcctcgtttccaactctccaatgctgaattggtttcactctgcgcgatgctcagacatggaggaagacggtggcgggggcgtcgaagatgttcgtggagaggcaccgcaccaaccacgtgctgctcatcagcgacatggtctgagctctgaactctaaactgaagcctctgccatgacaggtggccgagctgtgactgattcttctctcgtcatcgagctctcctgctcgggttggttaattggtttccttcgaattgaattcgtttatgactgatcgattctacagtttagctagaataaaatggcagaaaagaacaacacaaaattgaactagctgtgtagttcaggtagagtaggttctttgactcctgcctctgtgtttgcttttattcactcgttgtttctttatactcggttgaatcatcgtctcggcgaccacgttgtaaattcaagtttgcaatatcaataccagtgctgttcttctcagagaaaattcagatattgtgttattgtgtgtttaggcaattaggcctttggttttttagtggattataggcctccatattgactgggctaaagacctgaatactgatgggccttgtgggtggctttcgctacacacaatctgaattcctgaatgaggtagaagaacttaaaaattccaagatccaaactttccacagatgcagttcaatggtttatactccacttggctttagattatgcaccatataaaggtttctttactagtatcagtccatgtctacccagaagcctaccttgttttctctagtagctccacatacgctttcaccacctgattaaacattactacctccgaattaaaggtacatcagatatgatcaaatgatcaatcattgatcctttcttttcttatcttctccttttcatttctgatatctcctctgcactcagcaaacccccttcgctaagaaaacaaagctgaagacgatttagtctcaagtccaccttttctaagtctctgaatatggtgtgggggtctctctttgcactgaacctgatttctcaattcttagttagcacttgggcaggctcagtcaggtgacccgttccttggcaagatcgtgacacatctgattgaagaatctgaatcgcctaaagaaaaagtaacgctatagtactgatagcatcatcatcactgaattaattactggtagcatcaccatgtctgtcctcattctaccagtctacgatacgaacaacgaacaactattaaaccacttgtcaagttggaaacttggaatgaagtgtactgctctgaaaattacaattggctcactctgctgattccaccgaggcgtgaaggttaatccagacacaaagcaggaagcagccatttcgtcaggtttgagtgtttgaccaatagaaggcagatacttgtgccgcctcatggacgtccgggacacgggacaccgaattacttgggtctctgatgctgtgatgcagcacactcgccggctgttcgtagtaggatcagacaggtgactgaagaagatgagctgcttttttcgtagctttcaagccgagctaatctgttcccccatcctgccaccggaaatggcagcagattggtggggaggccctttccgtagtagagggtccgacgcgcatcgcagccgtcgcctcctcctcctccatcctcatctcttatcttttagcaaaggaagacgccactttggaaggaaaagaaggaaaagctgcaccggtggagtcaaccagaactatctatccgtggtgcttttctcctttgtgaagggtgaatttgttcgtgtgctactgtgtctgggttaagattttattctaatgtgatcctgtagagtattttcaagataagaggacattttggaacttgcataatcatgaatcaataaatggctcgaattgtcagtaagaaaagagaattaattttcaaaatggtagaactagattgacgaaattttctacaagtaactcgttaaccgggctagtgtaaacaagtttaggtgcatgtgttgcattgctggtagtaaaggtattaacatgtttcagtgtatgacacttcatttttgtaagtggtggtgattgtgaatatagggtagatgttgtcagggaaacagaagatcatctcaaccatattcaaatgctttttagcttttggtcaatcagccattccactacccttcgcatatgatggttagtttgtagccatgtgtatagtactgaaaaaaaagtcacattcagcatctgattttgtaggacaaaatggtaggccatacataccgaacccccgcagcacagtgaccaggatgtctctcttgaccaaaatttctttggcatttttctatagaaaatgataaagagcgagtacatatgcgataaacaaagtgcacggccttgtagaacaacgaacctgagctgttcattcgtgcagactactttccccccttttttaccttctgaactgatatttacagatgctgtaaattatggtatctgttctgaacttttgatagcagcatgttagtactaacttcgtattaccgtaaaaaaaaggatagtagggtttttttttaagtatgtgagcgatgcggctctgaattctgaaacgctctcggctaaagaggaacagatcccattccacaacggaagatggggagcaggaatggactcgagatgcgctgctgaaacatacagcatatttattctatatttgtctgcacaaggatggaatacggaggaacaagatgcacattcttcggccggctgaagtgacctgactgcgaacctaccggtggttgatctcagaagaaatgtcagcgtgagattatagccaaaattctttgaagcatcacaagacaggaagatcttggggtccattacatctttgcgataaggtttgcccaaaaaatagaggaggggtttgcctcttaacatcagatccatgatctgaagagagaccattccaagaaacgttcagtagctgggcctgatcatctatgtctggtgagacactgatgcagcagggcaagaaaaaaatcctggtgcgatttctgcagagcgggtcgccgtctggcaattatatcggcacctttctcggcagctcgttcgccaacgacacttgcgcgtaatgaagtgtgcagagacttcgtttcgtcatttgctccccctcggacggttggacaccaagcattcgccatttcactttcggttggtgtcgtcttcaccgatcgatcgattatttctctgtctctctctcgagaagacacggtaggctgcacacggcacctaacacaggcaatcgatcgccctagctttgctatcctatactgcaagaactaggacgacacttgcaaagttgcttcttcctctttgtttttttttctctctcaaagttgcaaacggaagaagaaaatgagaagactggtgcaggacaccgtaccgtaactgcaggctgatccgtataaatatagttacatgcacactccagccgtttcaaaataaataaggcccctttgattcaaaggaaaatcatagaaattttagaggattttatttctatagaaattttttctacaaagccttttgaatcaaaggaatgaatcctatggaatcctatgaaattcctatgtaatgcctctttccatacaagttttggagaaattttaggccccctttgattcaaaggaaattcataggaattttagaggatttcattcctatagtaatttttcctacaaagccctttgaatcaaaggaatgagccctatgaaatcctattgagggcccctttgaatcaaaggaattatataggaatttcataggattcaaatcctataggaaatttccctattttgccctttaattcaaaggattgaagctttccaaatcctatgaaattcctacggaatggcacattgcatgtggattttggaggaaatttagcaagagctccaacctcttggaaaatttcctttaagtctatctctctcatccgattcctgcgttttttctgcgctccaatcaaacgaccattcctgtgtttttcctgtgttttgcaatcctctgttttacacttcaattcctgtcagaatcctgtgtttttcctattcctccgttttttcatccatgtgattcaaaggggccctaattctaatatgtaagtgacataaaaatattcatcctaaataaacatattcatgttcatatgcaaagtaacgtattcatctagattcctatactggaatgtatcatgttctatattagtgttttattttgggaggaaggatgtacctatatatctgcagaacgacagtgcacgtacgtgcgatgcatagacgtacctcagtaggagtacgtactaggagtagattggaaaagaagcgaagcaagacgtggcttgcttggagatgacgcggatctctccgccttttgatgagcgcgcctccgccgccgcaaccgccggactcgcgcacggccgcacccactagtccacgccttcttccacttccgtcttcccagtggcacgtccccgtaataatccccagtttccggcccaactacgtcaaaaacagtttccagcttctcctcttccactgtctctccttcccaaatcctcctccctccctccttcccactcaaaaaaaaaaaaaaaaacccgcatcctctcctcctctccaactccaatccccaccacctcgcgtcacgccgatcacctcctcctccccttccggtggatccccgcggcggtttcgacaagtcccgcgtcgccgtccggtgtggagcgccgtcgcggccggtggcctgtaaggtgcggtgttgttgctggtgagaggttactgggttttgccgcgagcgaggtgcgtagccgctcgcctgcgtttcgcgcgctgggtcttatcactttggaggcttctagaaggttctagccttctccgagttatcgcgccgattgctcgcccattgtccttttgggcgaggaactaatgaaatcctccttttgatcaccttcttacagaaggtttctggagttttctggaaactgcgctgtgatgcccccgcgactgcgagaaagtgtctccaagtttgtgacacaggcgtgattctgcttgtaggctggggttttgcattttggagccgcggtggtctcggcggaaggtaatcgtctccacctctgcttccacctcgttgttctagaaggttctagtagcatagcacttcatgttttgacttgtgtggggacgaacgctgtttaaaagtatcttactgtctcttgtgcggttaggttcctaagctctgcatgttcgtattctgaactttctgaaattttggaaattccaggcatgggctaggcccccagcacggtttccaggtgattgattggtggatagaattgttgcctgagagcagcaaggtagtgctaacatctctgccttctagaagctcctaccactttctagattcgtctcgatactcaacttaccttcagttcgtgtgcgcaggtttgggcgtggtgactggaagcaatcacgatgacgtcattgtcacgaactctatcccggggagggccaatgcagccaccggggcagcggcgcatcctcagaacgcagacagcggtaaacctgggcgagcaaatctttgacagtgaggtggtgccatcatcgcttgttgagatcgcgcccatcctccgtgttgccaatgaggtcgaggcgtccaatccccgggttgcatacctctgtaagctaccccaacctgctcctcccagtgatttcgctgttgtgagattgcacatgaatcaacacctccagctatcttctgcatttccactatacaaagaccatattttggcatactgctaactggactgtcacaatgtcacctagtgtgaaagcttgctaatgttttgttttaaaaatttgaatgcacaaacgaacatctctcttgcctaattgcgccttggtgatggaaatgctttatgctatcattatcttagacttctttcttggataagaattttggggggacccctatctcgacacttccacaatacgtacaaagaagttagctacagaaaaacactggcgtcttggtgatccacttacaaacattgttcactcattgcttattaccataaaaaaagaatactaatcttattctgcttcacaatgtgtttgatcacattaatttgtatgtctgtaataatggataggtcgattctatgcatttgaaaaggctcacaggttagatccaacttcaagtggccggggtgtccggcaattcaagacggctcttttgcaacggcttgaaagggtatgcatttcaagtacttctagctctagtcagttgtttgcatccatttttgttttatcctacaactgtcctgtgatggcgccattgactgcttgcctctgcttatatcctttcctctacctttttcctttacacatagccccttagccagtgctatgtttcaacatttttatgcatgctaataattgcaacatttacatgatcgtgtaaatgaatctttcattgtgctcattaagagttatatcttatatcatcataggaggttagtcttagcttctaaaaaaatatgtagttaattttgtccagaaaatgttgaaagattttaggtgaccacccaatgcctcgtatgaattaaaaacccaaccatgtcacagggatatatatctcaaattctcaatagc

SEQ ID NO: 74424 - DNA, 63780 bp, Oryza sativa
ctgcctagggcaaatccccgcgccgacgccgccgtatctcgccgtcgtctagagctagtcgtcctcgccgccgcctccgcctcctccgctgccgccgcatctctggggtgagagccgccgccgccagatctccattcatgcatctcgatctctccgatctcgatctctctccgtcgcgccgcccgccacgagacgccgcgccacgacgacgacgcgccacgccgccgccttcgacgccgcgcaacgccgccgccgcatgccaacgccacgccgccgccgccatcgccacgccgccgccgccttcgccgccgcgcgcgcaatgccgccgccgccacgccacgccgccgcgccaaccgccgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgagagcgagaacgaacacgtcaacgtacgttgccgcgacaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaacgagcgaacgaacgaggacgaacgttaacgtgaaatgcaatatatatatatatatatatatatatatatatatatatatatatatatatatatatatatatatatatatatatatatatatatatatatatatgtatatatatatatatatatatatatgtatatatgtatatatatatatatgtatatatatatatatatatgtatatatatatatatatatgtatatatgtatatatgtatatatatatatgtatatatgtatatatgtatatgtatatatatgtatatatgtatatatatatatgtatatatatatatatatatgtatatatatatatgtatgtatatatatatatatgtatatatatatatatgtatatatatatatatatgtatatatatatatatatgtatatatatatgtgtatatatatgtatatatatgtatatatatgtatatatatatgtatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactagggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttaatcttagcttgtaatattatttgagttttaatataagattattttatttgtaattagatttagtatataattatttactagctagggttgtataatatacgtcacctagacttagcttatatcacgattcgtaattagacttagcacgtaaggttgtgtagggttctaatgtacgacatttacacttagcatacatgacttagattgttaaaacataaatgtctcatgacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtacctcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacctagctgatggctcactggtcttcggctatcagatacaagaggttgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggaggggatcctctagagtcgaatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccatggaggagacggtgagacgcatctacgagacacatgccatgccattattctatggcgcaggcggtacatcatcctccatgggcgacaagcggcgtctcgtgcaccatctcctccggctccgccatctcctcctcaggatcctgcaccgtctcctcctcatgctccgccagcaccgtctccaccgcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccctagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactatggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacactcatatagtttattcgcatgagggataacctgaccacacacaaggaatttatcgcggcggttcaagaacaactcatgggattcatcaacgaagaaatccttgatcccaagggtgaattctactacgacgaaaacacaattcaccggtccttagcttctgagctagcagcgagtactactacgtcgaaatcgtagctagctaggacatataatggattataattaatacatgactacatatgtttctatatgcatgtgtacacattttctataatgtaaatatattttgttcatatatatatctatatacatatgcatttgcataacatatatatatatgtataaatacatatatattatgaatgtatatacatataatataatataatatatatatatacatatatatatgtatgcatatatatgtattgaaacatatatatgcatggtttatatatatatatatatatatatatatatatatatatatatatatatatatacccatgcaccaacaggggcatgcaaaaaaaaaaggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgctagtaagctagtaacacttgcatctatcgacggttgagaaatgtacgtgcgtacgtatggctttatgatcggagctacatatgcctaacgataaaccgtacaaaactttaaaaataaaaaagaaatgctttataaataaaacctctctactacaaaagaaagccaccttaaatcaattaaaaagttccaaaacttaaagtttggcaatgatcgatcatccctgggattacaatcgagctgcggatcatgcaaccacaagaaaatttacagcggatcagtgcaaccacaagcgaaactactatattcattctaaaatgttgctacttagaatgagatgtgtcaatattttacgacggagaaagtacggatcagtgcaaccacataggaaactaccatattcattctaaaatgttactacttaggatgaggatgtgtcaatattttaagacggagaaaataatagtactccctctgtcccactgtcccagaatataatgcctcctccaacaaggatgagtcagctagctcataaatctccacatcagcttttgtatgatgtggaagagagagaaaataaggagagagaatgcactatctcttcttcaagagctaagctcctaaagaaaatgtaagagaaattatggaacccaaagcattttaaacaatgtgctatgagacaatctattggagaggtagactttttgctatctcttgtatgaggtggacaagcatgagctagtgcactagctcaatcatgaaggaggcctaaggagttttagagttggacacggttattaagaaagtaggtagaagtgaatgatggagagttgtggttggatgagtagtggaggtaggtggaaaaaatgaatgatggagggttgtgattggttgggaagataatattggtggagaagttgttatattttgggacaaatactaagggctaaaatttgttatattttaggacggagagagtatcaaacaagatttattaatggacatgaccacataaaaaaactaagatcgcgagctactggactagtcctagtagagcatgaatagcagactataaccgactataaatatattttaaagagataaaaaaaagagagaagagcggcgggctttagatttgtagccagctgcagtacggactccaaaacataatatgtgtatgacaggtgggatcggatattaatagtgtagtaagcagctattgtatgaattggctataagtgatttggagttaatagttgggtatactgttaaacttgctcgtagtagtgtggagtagagtgtgagtgtgtaactgcagctagctaaggtagcagtcattatcttaaaaaaaaaagctaaggtagcagtagcacgcgcgggcgcgggcaagaggacgcattgatggacgacggcgagaatgcattggcgcgcgcggcagtggcattgacgccggccggaccacgcaatccgcgacacgatctttgcatcatttaactccacaccccccacaacccggccgcctcgacgtcgcgccgtgtcgtgtgcttgaaaagaaaaatgaatacacccgaccgtcctgtgtacgtacccccaaccgcatcgccacgtgcgcacgctcatacgtgggccacacatgcatgtactccctccaaaaattcacggtaacatcgttaatttctagagctggatatattcatagtcccataaattatactccctacttccctaaatatttgataccattgacttttttaaatatgtttgaccgttcgtcttattcaaaaacttttgtgaaatatgtaaaactatatgtatacataaaaatatatttaacaataaatcaaattataggaaaagaattaataattacttaaattttatgaataagacgaacggtcaaacattttaaaaaaaagctaatgacgttaaatattttgaaatgggggagtatatttttgattagacggtaggccagaggctgcttttaattgaaagccaaacggcctagttcagctggggataccagcgtacatgaaggacaaacttcacacgaggaggaacaagtgctcaacgagcaacccaacactaacacataggaaacacctccaaaaaaactaaacagagcgatcacaaaagggttcagcgcaaacacagtggccaagattcacatagctctaacagctacagctctaaggggaaccagcaaactaaacacaaaaattaacccactcccactcttggggtcctcagggtcgatcaacaccatcagcttcatcctttccaccagcgcttccatcttgattccttcctcaggtcgtcatagcttcctccactgcaaaagattagaggtaatttaaaaaggtatagtcagtacgtggggagtaaaccagttttcctctgaagatcatattatttctggttatccagagattccaacaaacagcagccaataaactcaaagtaactctaatagaaaattggttagtgtcacccttgcaaagaaaaaaaaactcctcaaaattcctagggatggtattcctatttaaagtgtccctgcaaatgcaccatatcagtcccataaatcaatggattataattttgtaaaccattataatttaacctacaaattttaaatccagcgaggatctataatatagagttgtgtaggagtaccaaacaagacctaaattagtttcattaaatttatctgtgatctagtgttggaagtgctattatgttttttctataaaattcaataaattaaacttgaaaaggtttgattagaaaaagtataaaaaagtatcttgcaatatggaattgaggtggtagaacagtgaggttgtgtactagtataagattatttcgcaaattttgtttttcaacttttttgaatttagagaaataataaaattcgataaaaaattattcaggcctaaatttcggcaattaatttctaaaatttcagattctccggtgccctcagcatatttttgcatacccaaatactttctccgtctctaaatataagatattttggttggatgtgacatacctagtacaacgaatttggacagagaatatgtcacatcgaaccaaaatcccttatatttagggacagagggagtacttagtaaaccctagtatccatgatccatctgtagtccatgcatcgctgacatgtgggccacgcagttgctaagctaagctacaaacagtgaggctgtgtacctgctcggctgcaataacttgggatcctgccaagtttaattccagttgatactgtttctgcaatccacaaagcgtatgatggtgattacattaatgtgttactacgactttcaacttacgacgacgacgacgatatgatgcgtctttttttggtcctcgtcgccggcaatcatggtcgcacagtaattaacacagtggtgtgtagtggctaaaagctgcatatgtcatgtcatctctctgaaaaaggctggctgttattatgatcttagcagctataatagctctgactgattaatgatccgtaaaaacataatgatccaagcagctacgagacgcgtgaaccggttaaagaatgttcggttctttgtcttgttgactggtaatctcagtccaaatatttccggtgcagagaggagagttaattactatagtactaattaatagtagtagtaatagtagattgtttttgcttggaccagctatataattactatagtactaattaatagtagtagtaatagtagattgtttttgcttggaccagctatatagccgaccaggcatgcatatgcagtgatgcaccgaattaacctgggtgatctattggggaaacgccaagaggaactctctgcattcacagataatacagattgttctaatgctgtacgtgtgccttaattttgttttggcatgtcatgtcttaaaatgcagaggtcgtgtttggtatctttgatacagtctctaattcgcatatttcgtaattttatttcgcatatggtggccttccatcgtttaccccgtggtttataagctatagcaaaattttaaattttaaaatgtttttgggcttttgtatcgtagtttaccgaagaggctgttctgtggaagaaagctgggctcctcccggattagggtggctgtcttcttggttgctaaactgatgacgcgagatataggccctatgttttaatcctgttctttgttcttctgtttgttgttgttatttaaaactcctccaattcttaatacaaatgatgtgcaatcgttttgcgtatcctcaaaaatagtttagtatttagtgttcgttttcaaatcgcaaaagaaagtttcttcaataaattattttgtagttgctataagctgtaggacaaacgatgaatgccattttttttgcccctcgactgcatgaactaaaacatgacttgcattttggatcagaggtggtatgatactttttgtagcgtttttatgctatgtgcatcaatgttgtatgatttagatggtacagtagccaagggtactaccattgtatgcctacattacaagtttttcaaattgcctgccaagcttttgtttccatgattggaaaagtttacctttctctttgctgtttgtttctgaatcgcatccatcatccatggatttcactgtgactgagggttgcggaattaagttgtgtacattttgggctataggctttttaattagtcccctgtcccctgcctgggtgaagatgctgtgcttggattttaaatgacatggtagtagtagtacgagtacatagtacgtagtattcatctgtaggctagccaactctcctggtgaaagctttttttatgaagttgtgagtagtagctgtaactgcatgcatagacaacgagtttaactgcagtacagtaacattggcttccaactcgcaatgctgtattgttgttgctgcgtgtaacagtgctctgggatctgcacatttctgggccattattgtgaatctcttgcaatgaagcaaaactgtgtcattatactgttccaatatagtagcagtacagatttacaaggacactggtttggagtgaggctccatgcttttttctgcacacatggtagaggtcagtaaattacctgtaaaaaaaaatctgtaacagccttctgatctataaagaatccaggccaatccaaaaggcaggaaaacaaatctcacttgtgcttgatagtgcaaatagagtatttatgtaactcgacttgtttggtactgtaccagttaatgagcaggttaaccataaaacatactactgtttccattagaatctcacttgtacatggtagtataaatttcttattaatttttgtcacataaaaaataccgctgtttccattagaatttctgaatgccatacatgtgtgattggttgggctaaccatatcacaatttaatcaatgtcgtcagttagcccttccaaaagtaactgaaaagattgtttgtacaattgcacatctcaaaattgctttcttttcctgtaaatggacgcttaatgacaaatcgatcgtgtataacttccatcaaaagacgaatctatgaaatttcaaaatgggaaagtccctgttaaccggatatgctcaagggtgcgctttagaccatactgaagaacagctcggttgccagctctaaaaccatcgccataggccattgaggtatctgactcaatttggtgcttgaaaaaatcaccaagctttcgctcaaactgagatcttcccccctttttcgatgatgtggatgctgatgaggatgaagacgttgaagcaccattactgcctgatcctgcaatgatctctgactcaatccacatgtgagcaagaacttggcatatgccctcttctacgtctggactaagtgtgcgatatcctgcaagtagatatgcattatagcatgaaatgtccatatacattttttaagtaaatgagagagtgatgacagtggcaagctaatgtaaactcttcctcatacagaataggactgaagtactgaatcatgcgctgcaatatggattctctctttttctctattattcagcaccttccttagataacagatttgctaatatcattactattagttttgatttcatattcagcggtggacagcatgtggtgatgtgactagcttgtattttgtactgagatttacaagattaatagtagtgttgattgttttgtcattgccaatatacttattattagtggcatataacggaggattgccaacaatttacatggtaactccccaagttcacccactcatggacttgtacaatcttgaaagcaagatgaccaagtttctagcgaagaatatagttttagttgctatattcttggttcaggtactcagtcatatgctaaatggcaaattggcagtctcaccacaatgcaaaaaaatcctggccctatcaggcaatcaccctcaccagaatagctagtcattataagtgagaagtaaaccacacagttttctgtaggaatcttgaaccatgatcttttttagtctttaccacaaccaaagaccgtgaaagttcaatgctctagattaccaatgtgttgtacttgtacacccaataagagtagaacaattagtacactaaaaagagtagaacaattccattgatgtatgggcagtttacattgatttgtagcaactcaattgcttttactaacctgtttgtctttgaacaaacatgtgctatttaattgaaaataaaaggtccttttcctcttctctgacttctcgtgtgttattttattatgatgtttgtccaagaatgaaaatgagaattaaaaattacctttaagtcgcaaccacgcatgcatcatctcatgagctaaaattgaacctgtcaacaatctgcaagaacaataacacattaaaataccgacaatgtacttcatgaggtcccaatacagaagaaccaaatgataacacaacaaataatttgcatattgtactgcagaagctacagtgacaaggcacaagagtaatatcttttcccattaactctgtagagtcagcatgcagtccagaatatcttcagtgaatccataacattttttagaagaatgtattctccaacacagaaagaaatattatttcaaatcagttataaattcgaatattcctcctagtttttgttgatattaaaagagtagcaacaaggtaacaatggcattatgaaacagatagtaagtggttcaccttgggagaccataaagaatgagaattgcagtcacttcacatcgacgagtcaacctatatggctccgttatcatttccataactttatttccagccattcttggtctcctcaatatctaaaatattaaaaataaatgctggaactcagtcagaagtcagaacacagcagaccaatacaattgaaatagaatttaaattatgaaaagatccattcatctcatgctcagaatagttctcaccgtgctgacagtttgctcttctgataagcataaacctcttgtttctggaagatggtggtgaccctggtttccacaggaaacaaaatatttactaacattagtatagtgaaaaacaggagaatcatggattgtccagctttggtcaacatacagtcttctctccttccatggcttcatttaaagcctgtctttctacaagaagcaagggaacttgttgttccactttcatatttaggccttcataaaattcctgtatttcaagataaagaggttggcactcgctcgtatccataactgcagaatcaaggcactccaggcagagtttgcgaccatcgtccagcaatacatatcttgattcccttggctgataagagcacaagccattttttgatgaactgatcaaaattttgcaacagcaacatatctgaccaagtatgctgaatcagatttataaattcaaacatggtaattgaacgtacctccattctttcacaactacagcatcttggagtaccgtccacctcatgtgatggacagtatttttgtaaccagaaaggatgtgctctatattcaatcaggccattcatatttgtaggaatctgaataagaaggaactgtaagatggcgcatttaaaaaaacaaaaagaaattgtcggctgttacttaacacatgttaacaactttcacatgtcaattatttgctgccccatgactagtgcttttcaaatgcaaacatggccaatcagctatccacatgattcaaggctttcacaattgtaatagaaaatgagaaaaggtgaatatgcatgttaatcatatatcagcaacagtaaacattgcaatcatgatggcatgtggagtagtttcctcatttaacaacagcacggtatatcagttcagaggaagctttgatagtactaggtatgaaaatatagaacaaaacgatccgtcttatgcaaacagataagagcaaactaatgaagcgactcttacaaattgcttgcagacatcacattttgggtgaaagcgctccttgtagcatgttttatggtatggatggtttcccgacatggagaactgcatagtcatatattggttgactataagcatagaaacattactcttgcagacatggataactgcttaataagtaaacaaaggagttacctcatagtcatatattggttgattacaagcatgacagcgaaaacattctggatgccaaacagctcccatgcaactaaggaaacgcccatgaccaatctcactgtgacatccggcacaagtcctgaggaaataagcgtatatattaagaaacagtaagagtaaaagcaactcgcagcatcccattctcgcttaccaattaccatccccaagtatcagtgcagctctttcttgcattttaacttttgggtaacaaaatatacactaatcacttttttgctttatgacactgtaaagaacatatcctgggtgcttctggtgaaggtataatggaaccctgcagattttgcaggacttcaaaacatgcatgcaatagtgcaaccataggccacagtcactgcaagtttaatcaatgaacccaaaagggggtgatttcttctatggttgacacctacataccataaggggtaatctcctgtgcttgctgtggctgtggtgcagctgacagctgcaccaaatctcagatttagcagtgtctgtggctacaacagctagcacgacctataacctagatagtttgaaccttcttcacaggggtaaaagaaatatttacaaaaatttaatttggcaaaactgaggtccacagttttcaaactcgcaaaagagctgctcagctgtacaccttagctctacagaattgtatcaaacaaaactagggagattgcctttgacctctttagttcatatgcaaactcacactgaaaatctggtacataagttttttaaatcaagatacacccactaaaatatatctgtgaaccccttacacaaaaatgtgatatccagggaatgaattgttaaagtcagcacgccgcggggcaatacaaaaacaaacaaaagtggtgttttaaaaaacagtagcacgtagtctgtatggttcaggacttaatttattatactgctttatggtgaatactcgtatcagtagttatgtggcacttcaacatcaatgaacccaaaatagcatgtccacataaagtatctactacaaagtatctagttatactaaagtaagaaaaatgaaaatgaacctgaatccagaagaaaacataaatggcagtggttgatacatattgccaccattggcgttgccattttcacgagcacgaggaggcgattcaacattcaaactttcctggatagctcttgcaagttgttcatcctcctccaaatgcatgtccttttctagatgagtgaaagaaaatgaaacaaaaagtattgcatgttaaatgcatggattcatcgatcatagacacagaataccatgatgtagaattgcttgataggtagctccaaacagcattttatataatacttccagatgcacttttattacttgggtacagttctaatccaaacatttggtacagaagtatatacaaaatgtccacactatgattttcgatttttacatctagaaccagagaactcgcaccaaacatttcaccaacacataacaaaaaatagccacaattcaacatgtatatttctcatgaaagaataacacatatataaatttctttttctcacaatggatctgtttatgctttgccgttgagtattaacatactattctatattgtgactcaaaagaaaaataatgttggcctagtccttgtataaatgtgaaactaaaaaaagatcaaccaagttcagaaacagagagtgtgaagaaacttatcctaaacatggactccatatgaacatactgtatcatcggcaatgaactagctccaaaaattttctgataggtgtggaaataagcacaaggggctctcttaaaagttaaaacgctaagcactttgacagatgtcatcgaataaaaatgatatgaaggaacagctgctggaagtaaagaagcggacaaatgtcagcctttttggacagtaagtactcaaacagcagaagtactagtattagttaccatactaacctattgcctttgcctttctttgttcctcctctaatagagagagtgatatagcacgagcgatatcttcattgtcaaattctgacgggacatcctaaattgaatttgaaaatagatcagctacatagtcaaaagatgtagattcccattctttttaagcactaaataacagatactactacaatggcatataagctcattatatttggaagcaatttgtgtcatcctgaacctagaggcatatgcacaaaaaatcagtggtatagtttttgttaatacttaattcacattgaccaatcaccaaatcacctgaaactcaaccaacaaaaccacataacagtattacagataagaaaaattatgtttatatgacctactaagcaagatagcaatgtgaagcgatgatgtatttttcagcaggggaaattgcatttgtgcacctccaaattcggagattagaatagtacagatttacaccaacagaactggtaatagcgttatgctctgcatacaaaggaagacataaaacacacagaattgttctccctaaccagggtaaaaaatttcttgttttgtacaagagcgtcaagatatagttacattttacactgtaagtggcgtacatacaccatgctgatgagcatgagaagtttgcaagagttgcaattgtgagtacatgaggtgcaagactggttgggcctgttgcctcaacttacaacaatctacatcgtcaatgacaagttgacggagatcagtagccaacaatagcaagtcgagttgaccaaatgtggactctagtgggtacaccatctaaacacgggaaccacatttcccatcaaaaccaacagtttgcagttttctatgtccatatcagtaatggcaaaacttttgtgtatggatgtagccaacactttcaagagggataatgatctatccgcaactgttaataataaaaatattttagaatatggttggaaagttagaacatgatggtagtttttttttcccacatctattggtatttcttttatggcgcagaatcgcagtacattgtttatagtttaatggacaaacagtcaaagaccaaaattttgattgtgaacatgccgcaatggcatatgttatagaacaaagggagaaacaaagtgagatttaatactctatacgagggtgcaatccaagctttttggagcacatttcaaatgcatctcctttggctatcctagttttataagaatgcacttttgccctaacacgaagataaccgtagaacaattaatgagctcttactcctgagaggtaaatgtataacacagaagaacttaccgtcacaactgcggaattagagggtccattccatatcgtctcctccgcgggtttgctgtggtattgcccttccgagattttgtgggttgaacctctaaaaaatttggtcaaccaacccatagagctccaaatggcaatgttggaagggacacttttatctgcaatcaatccaagatgttaggataccacaatataacacaagaaaaatttcaagcaagggatcaacaccagagaatcataactagttaccaaagttagccaagttagcagatcgattgcaggtccagccgtttgagtaccctcctcctcactcaggcccctaaaccagaaacctcctaacctcacaggaatggttaacaggatagatcggagatcaagcgatgattctcacagaccccccactgggttttctatcgctagcagcgtcgcattagaacgtaagcctggaatggctcaaaaaaaaatgcaggttctccggcatcaggcggggattacgagcggcggcaagatcgagagggggggcacacgctccgcgtctctatcgtggggaaggggacgaaatgccaatgcccaccaccaccaccaccaccaccacccgcgtcggtgctaaaattgcgcggagaaaacgaagggtggggctccgatcacctgatcaccgcgtcacccgcgcccctcccgcggacgggaccgccggcgatccgccaccggcctttgctcgaccaccaccagcagcagcagcagcaccgaaaacccgacaacgaaacgaaggcaagctacgaccgacgacgtccgacgtcgcccgccgcgacggaggagggggcacgctcgatccccacctccggcgtcgtacgcccgccgtgcccgtacgcgcgcgcgctcgggcggcggcggcgagcgggcttggcgtggggtggtggattcggggtggggttgtgcgggatttgggaatctgtctcgcctcctcgctgctgctttgccttgctttttgtggcacggcaggaggaggcaggtgacccgctcccccgtaacaccgcggggaagttggggggttaatccatctgtttgcagcttggtaaccgtgtaataaactaataacactgccttaaaaaaacgaaaattttaaaatgggttggagcatccatggttgatagaggagaaaatggtgagaaaacatgtattcgagaggatttgaacttaaggtcaatgcattagatccggtttagatgggattaaaagtaattttaagtctctatcgcatcggatgtttgggcactaattataaatattaaacgtagactattaataaaacccacctataataagtttttggatctaaataccatcttactctaagtagctgtcctatcaccgagctacgcgccggtgcattactccctctaacttgacgctagatctgtttgttcctgtaagcgaatacgaccgtctaattgtgaattagatgaaagtttacaagttatcgaataattatctgaacagatataaataaaatagcgtaactacatatttaaaatcaaaatacccacttcacaagaaaggactagacagcctatacatccttaaagttgtcatttgtttcttttcccttccagaaagtcaaatatgcagttttgcacggaacctattcgcttatatcggattggttatatttgtttttggctctggttgcgtttttttcagggttttccggaggaacccgacgacggacggacggaccaccgccgtcaccgcgtgagacgacgaagagggacacgaaaccggcgccgggaggcgagcgagagctcacgcggagaagcaagcgacgaggagtcgtgttgacgccggcagagcgtacaggagacttggtggtagtagttgagcgctacgtttggactttgaacctaggcatggcgctgtttgattgtcaccagtttgaattttccatgtgcaatcttccaacgaccatttttttttcctaatatgtagtggtgtagagacgagtttctgaaggaaatttgacccactttggctgtttactgaaattaaaggcagttctcatgtaagcatgacagaaaaccttggtgttagaatttagtgagcaaagaacatgattacatagggaggtgctggtgcaggcaaaccatcagcgaatttacattgcattacttcactccacggacattttgacagtgcgttttgtacttctctgtattgcgaaattcggatcatactagtatcacatttacattcatgtacggagtacttagtttcggtaccagtttgtggaagtcatatgtgctcacgtggttgcttgtacaagactaattcctgctcaagctccgtcctggcatcacccaccgtcacccagacctcggagattttctcaacggcgccttcaaagagatcaacaatggtgaacgcccgcgatgtcggaaccatcagtcctgttaatccttcgagcccagtcttttcgcttgtggagattgcaggctgcctgcttgattgcgcatgattcactctaggcacaacggcgccgttcagatatatagtccggttagctccaaaggcaatcatcttccgaaggcctctcccgtaggcgaggctcttgtgcatgtgaccgaacacgaccagcggtatcgaaactccggtttctctttgcagatcagatatggcttgctccagatctgcggaggttcttgtctaagatggcgtattaagcaactgtacaagtggaagtatcatcgatggaatatcagacctggatcaccatgatcaccaccaccagcaacccaatcccgcccacaaatatcctccattcttgagcctagacctgtgtaaccataatttaatgtaggcatgttacagcatatgtgtgcaagtgcaagtatatgtagtttgctagtttaaacgttcagacacctgttggcccattgtgtgccagtaatatgacagcatgctcctttggtgcatttgtagcagcatcatatatcctctttgcactttcagccatatcattgacaccatacctacataataatcgtaggatcaaataaacaatggtagacaagtttccaattatgaacaagagtaagagttcaccaagtaaaaaaaggtagcagtattgtgtctgtcttatgcactttgttttacgaggtggactaaccatccctgactacaccaccaaaataataatttactatagcttcacacttcttattacagtgtgctatgtttattttatcattaccaatatatactgcgctgatcgacaagaatcaggtcaaagcataatcacctactccaccaatatccttaccactgtagctcgatttcactgcatgttactacacagcagaagtagtatgcaataagaaaccaacccggtgaagcaactaagaatgacagctatcaacaatatatatcatcaaactctaaaatattcactacctaatacagtagtgctacagatgagaacgaagtataagttggtaactctactgtttattgtgccattcacccatcatttcacgagttcacatacatcgtttgcttcttaattcaatatgaaaagaagggaaggtaaaaatgacttgtagaccaaaatgacaaggatataccaaactagtatctttaggaaaagtatgctgcaactcatttctcttatgccttacctaaattactgcatgtttcacatgaaccttgtaactattttttggatactgtggatcattaggtctattttacataaatctattataaatagcagtagtattttttcagtagagccctcttctactgtttcatgaaaaagaaaggacaactaaggactccttagtaaggagaagtatataccaaagaaaactgataaacatgtgtatctattggttagcatgtctcttaccaaccattttgacagaagctttggtctaaatatcctattacccccgcaggaaaatggtcgtccaccaacaacactcagctttattgttggaaaatccaaacatttgtacccaacatgctgctcaccaaggctgaaattggcaacaaaaaataacaacagaaaattacttgccgcaaggtctgcaaaaatagtaccagagtctggtgaagacaagttataacccagaatcatcctgaattgccacagcttattaaaaatcatggaataatcaggccaaaatttcctgagaatcacattttttccagcaattactagcacagttttaaacaactcacttcttcttggatttaagtgcagtatcagcttcttttatttctttcaaaaaaaaaagagatgcaaatcatgaaatgacctagcaacaatgctaaaaatcaaagtaatacctgtttagtgctctggtgcaactgaaacaactttaaataatgcaagttttccttcaaaataacaacaattgtgcaactcatataacccattcattggcatttcttacaatagaaattcatcaaatgctagtgttaatcataacactgttgtattaaacataaaagcatattcacattaaaggaggaacatcttacctctctagctgaagctggacacgatctaccttcctgaatgccaaccaaggatacattcatcatttcatcaaatatcagtgcatttatgttgaacactatccttgttggatgaaagaattattcttacttctctgaaaactgatacgtgtgccaacagtcatgattcccaagaatagctgctttggggagctgaagatctgaaatgcttttaacaagttgaacattctcgttgccataatcacctgccataaatggaggacagcaaacaggagatgtaaggaataagcatttaagtgtaacttcacaaagtaacgagtatattatgtagtacagatataatagggcaaagggcgcacctgtaaaaagtaccaaatctggctgcattcacacggagagaaagttagatcttctgggaataagaaacataatgttatagaaaataaatgtagtacggatatttttctatcaaactccagtgtcattttggcagctggactgtacatcagtacatgttgatggcaggcatacaaaaaggcgtagaacatgaataaagaaaaggacagactgcacttcagatgatcttacatcataaaactagagacatgctacaataatcagatgtgaataacttaatgcaatacacagatacaattgactgaatttatctggatttgcaatacctggagaaaatgtagggcttttgagtcttcctcaagggtccaatcattatgctgcaatgttcagcacatcacaacagccaattagtgcattgttctcatcaagaggatattataatcccttgagccataattgatgttataaccaagtcaagcatgcaaataaagtaaaagccatcatattcctcttagtacaagaagtaaagcacatctcgacaggaaagcgagctaagagatttcaaacccacaagatcaacaaagcatggtatcaaaacacactatcctagtgactggttcaagccacaatatgttgtcactccgctaaaatctcactccctgcatcttctctccaagaagacattttacagttttggcttttcacattgtagttcacaaaaaaaaactatctctgcatttgtcccttcagatggaagtcaaagctttatccctcatgaacctcttcgcaccaccaaattcacctccatccaaactactactactacaatcaaacgccaccttaaacgcaaacccccacacagccacagtgatgaatcacactcatcatgcactcctctcacagcatctcaagatcggagctaaactgagctaagaaagtcaacaagtatagatgcctcagtttttttcttctttttttattttttttttgggggggggggggggggcgggaattggtagaatgcttccgtccccaaagccatctccctctcactccgaatcccctatgctacgccacacgaaacccaccgagaatcgcaaggccacaccagcacccatgtctggcctatcccccatcccaggcacgccgcaaaaaaaagacggaggaagagggcaaggagggggttaccacgtcgccgacgaccgcgacgcggacccggccgcgtccgacgccggcgctggccatgctcctgcggctgggcctgggcggcggcgaggaaagaggaggaggaagaggattcgcggaggcgcgcgcgacggcggcggcggcggcgaaggagacagcggctgctcccgctgccggccacgacggagtgggaggggaggagcgagaccgtagcagtgcgggcctcaccatttctttcttccccccttcttttttttcttttctttttccctctcgaaatggtggcgtgtgctgccgtgccggtcagttgtcccgtgacacctggcgcctgacgtcccgccgcagcggttgggtggcgaggttgtaggatcgaatcatattaagtaagccaattagaaggggtgaatagttgatatactcaaaaacccaaacttttagcggaaataaaagttaccctcaaatttgatgtagatcggtctgaccgaggttgatccgccggtctgaccgagctcatgtcgccggtctgaccggtgttgatccgagctcatgtcgccggtctgaccgcctgaagattgcctgccgcgtgtgaagtcgccgccggtctgaccgcctctcctccgtcggtctgaccgccgcctgtcaccggtctgaccgccggtatgtcgctggttagaccgccgaaacccgatgaaacacaaatcgaagaactctcaaagtagatgacaactttattacttctctctgtgtttacaaagtgcatcaacagcactccttacaaaaatctcgactaaactcaaaaccctaactaaactagcaactcaattgctctcaaaaacgataccgggaagcctcacgctccccctctatttatacatgaggtaggcagcctaaagccacgaaccaagctcatactaagagtcctagacaccttaggaaaccctctagtacaagacacaaactttacataatcaattgtaccaaatttggactccttccaaattcgactccgcatcccatacgcacacaataccccatcgtatgccatatggaatcttcaccaaccacgtgcatcaactctagccttagtatcccgcatgatatctgaccaccacggacatcgtcttaccaccaagccgactcccggtccatcaccgcaaatactctcccgaggcatcgagtcacctacacatgaaataaacaaagaaaccatattccgagaccaagctatccccaacttgactcattgttagcaaacaacagtattatatacgtatagtatccatctagaagccataaccatgaaacaatcacagatatccaaagaaacaacccgaaaccgaaactgacacagcgtcggccggtcagatcgcgggccggccgatctgatcgctcgatcaccaccggtctgaccgacatacaccacccggtcggaccggtcacataaaataacagtgaatccgattatcacctgaaaattgattatctccaaaaccacttcgacgataatctccaaatatcaaaaccaataatcacagatgccaattgttcatcacagaataagaatcaaaacacactttgatcttacagaggtgcccaacacgcctcccttttgagcttcgcagtctaactataagaactttgcgaactactccctccgttacacctccgttacaaaatatagaagcatatcatccgctactacgttcttacgtagtatttcgaatattttacgacggagggagtacagagtgcaattttatataaataaggttgtgtttacgatgataaagatgatatgtgttatgagaacttctatcacaaaaataatggagtaaattacatcgttggtacatgaacttgtcaagtgggtgcaatctagtgcacaaacttgtaaaatactcgttttggtgcatgaacttgtctggcatgtgcggaggaagacaaaaagatattacgtggctaatcttattatttaggggctcaataagatctatgtaaacatatatctaagaaagtttattattagacatacacatcttcaataataatagaatggataagagatcgtataaaaagattaaaacagagcaatgatataagagtgagaatatatatgaaattcatcatttccatgatgaaggataaagtaggaccaaatatataaatattgcatgtcttatgtatactcgctacacgtcacatctaatcaacatcagcttcgtaaaattaacattgtcaagctattttggtcatcgttcgcacgaagtagacaagtttgtgtatcgaaacgaacatttcacaagtttatatactaagttgcacccacctagcaagtttgatagcaagtttatgtgctatcagtgcaatttactcaaaataatggtaagactatttaagtgtgttatcaatattacatatttgtgactattttagtctggtgcactgatgttcatatgatgttttatatgagatgaagacctatgatataatagagtggactacagtaagtcctaggctagattcaccccattttcaaaaccggctataaccgtgtttttaccgggtacaataaaggcatgcacacaacaacccatcaattttaaataaacttataataatttaaattttggataaatttatatggtttctcacgttttgctgtgatattgtcgccgagatgtggttggctgcaaaagtttcaaacatccctatatcaccatggatcatatagtaaaaatacgtggtttagttttgttttgacacaatatactagacacgatataaaagtgagatataacttgaatgtatcaatgtgcttgtaactgatatgcacaggtgcatgagggaacctcaaattagccaacacgtacatttgcaatttgcaaaggacaaaggaccgctcaatgtgatagccaaattaacatgataaacagagatagcaggttcaccttcgcttctcttgagttgtccaggacaagatgttgtcataattgctactccctccgtattttaatgtataacgccgttgactttttaaccaacggttgaccattcgtcttattcaatttttttatgcaaatacaaaaatacttatgtcatgcttaaagaacatttgatgataaatcaagtcacaaaaaaataaatgataattacataaatttgtttgaataagatgaaaggtcaaacatttgttaaacagtcaatggcgtcatacattaaaatacggagggagtactaactcccgcgtcctttctagttaaaattgtttactgaaattctattggtacaatgaaaaacatatatacatacacatgtcacattggacttgagaattgaagccccagaaaagagtagcaatggagctcctaattattttcttacaaaagaaatacacaccacaaccacctctaatgcctccttggaacctaggaatttggttctatatgaatattgaaccaatttctatgaaaatcattacattttaatttaaaattaatgcatttagaagagacttacatttttgggacactactcaaatagatatattttatctcatatacaattaaaattataagttgacaaaatagttaatatgtttcaatggttggccataatactcgctcgcaattgtccaaataaataaagccctcatgaaatagaggattgatttagtagtacttctagcaaaactataagttctatcaacatcatgtgtatctctaaataaggcatgtccatgcaaagcttgcatgcaactattaaatctagccatttgtttctaagtcaagcaacctcctcaatatctcagagaccacatgagaaaatgacaagaagttctctccgtctatttgttttcctaacacaatatgcatggtcaattaggcaacgtagctcttatatcgtttttagcatgaaaacatgccaaattttctatacccataactatttcatgattttcttacattcataatcattatatatcgccagtacattaggcccagcaagatgaataatgccatctaattttccacggctcgatgactgccacgtgtccagttcctccgaagcagccatcctcagccgtttgattcgcgtataaatagccacgggcacccgagcccaccgcctatttcaccacccgcttcccctcccaccctcccccatttgttccaccaccagctggacggcgagacgaagcggaggcgagggcggaggcggagcacccctcgcggcctctcgctttaaggttcgtgctctctctctctctctcctccgccgaatcccccaggcgctaacgctggaccaaatgcaggaggaaaccctagaggaagcgagttggtggaggcggcgggggaggcgcgatgacggggccgcggggtggcggcggggaggacccgccgcggacgtcgtcgggcgcggcggcgtcggcctcggcgtcatccggcgtgccgaacgagccgctgaccccgacgtcgatgctcatgtcggggcagcaggccgggctgaaccggcgcgggtcgaggagcgcggcgatggcgacgttctccatggaggtgttcgacaacgaggtggtgccgtccacgttgagcagcatcgccccgatcctccgcgtcgccgccgagatcgagcccgagcgaccccgcgtcgcctacctctgtatgttcggatgttccacgctggaaccatttttgtgtgcctgtttttttgggggggatttttggtgattttaaggcctagattggtgcattttggtgtttaggggagttggaatgaggcaagcagctcgaaatatttttttcatggcgtttgatggatgtggcgaagcctgtgaagtagcgtgtgcctgggtggttttgtgcttgcaattctgtcgcaacgattgcgttcagattcatccggcgtgtgtttctccgcgcatatcctggctttgcggagttagatttcgaatttgacccccacttttttttttctggaatctatttttggataaggttcgctcacgaatgcatgacatgttcatctcagaacacccttgttttgtttcgtttgattttttttttgtttcaagggtgtttgtttggttcgaatcatagggtagcttaacttgttcgatcggtttgctttggaattgtatcaaccagctcgagtgggtgattcggatgtcacgcttattactgctacttactgtaagaattagagggattttctagctttttctgggtttattttgatctgttccggaccttctggtctgaatataggtcggttttacgcgtttgagaaggcgcaccggctggatcagaactccgtcggccgtggcgtccggcagtttaagacggctctgctccaacggctggagaaggtgacacacatttcccccttcatatttttcgcatgatttggcagcttagcgtacgttgtgtttcatctgttagttctgttcagtatggttcagttcgcgcatgttagcttgctattttgcctttcccgaactttggcctgcgtgatttggctagtgtgaaattaatgttatcttaacttctcatcatttatataagagctttgtttggtaataagtctagttaatgcaagtaatataaaaaatagcttaacttagttgtcaaaatgatcatataaaacaaataggcaaaacatacacaattgaagtcatgcatggtacgtttttacccaattttgcttgtatacggcattatgtatttgatgttatatacgaaaaactaagcttattggaattctaattcagtagaaactaggtcaggtgataataataacagctggtgatcaaattgggatgaattagcttaatctcactaacacattggagatgagatgaaacaagcatgcaaaatgaattcattgaacaacctgctacacaaagcacaattttccagaaccagaatgacgtgtgatgctgttttttcttttgtttcagatgagatgttttatgttctaattaacttctggtaattgagcatgaccaaattttatttattatgcttgtaatcctttttcagtaatgcgacgaaccgtttggagtaccctcttttttttttaaaaaaaaaaaatctgatatattgtcgatcatgattttgagtcgatacatcaatttcacatggtattattttccatttgcactgatcatgtattcattatcttgatttccacccaaattatttgagttcagggcttgtttggttggcagtcataagttgccacaaagcttagtcgtgcaacaacttttaagtctaatgtttggtccattgctataaatcttcacttggaatcttatgcaacccgcaggataacagtcccagtctcgcgaaacgcgtgaagaagaccgatgcccgcgaaattgagagcttctaccagcagtactacgagaactacgtccgtgccctcgacaaaggggaacaagccgacaggtaattccttaactgtgctccaggtctataatgaatccactccctttcttgacatatccagtcccatgccaatgtcacctgcagggctcaacttggtaaggcctaccagacagccggagttctcttcgaggttctctgcgctgtcaacaagaatgagaaggtcgaggaagttaatccggaggttcgtattcaacatctactcaaattacggtcgttctttgtcaacgaaaatctaggtcttctcaaatgcaatgagcttctctaattcccaatgtgcagattgttcgcctgcaccgggatgtgcaagagaagaaagacatctacacgccattcaatatccttcctcttgatgccgccagtgcatctcagtccatcatgcagatggaggaggtatgtacaattcacaataacggtatctgaaaaacaatggaaccgtgtactggttcagtgaatgaaactggcgtgctaactggtttggaaccttaacagatcaaagcagcagttgcagcgctgcggaacacgcggggcttgacctggccttccacatttgagccagaaagacagaaggggggtgatcttgatttgctggattggttgagagctatgtttggctttcaggtttgctagttattccacacgagtcaatttcagtcaattctattcctaagttaacaccagcttatcttcttgtgtgcagagggacagcgtgagaaatcaaagggagcatttaattctcctccttgctaatgtgcacataagacttgagccaaagccagagccacttagcaaggcatgttcctttgccactttttactttgctgatttgactatatggatatcaatgtggataatgaagtaagaagcctgggatcagtatgtattcattgtctgactttattcattctagtaaacaaaagcctcagcctttgatcaaaacaattttgtttcttttataatgatttagtatattcaatcagctgggatttggagtaacctcttgcaaaatttgtgccgacaatattgccttctatcacattccaaaagttatcactgtaaaattcaattgattgaactgattaggtgcatgtctttcaaatgtgcagctaaataatgctaaatacatccttcatttcctgtgccacattccttcttttgtttcctctataattgactggagcttttctttcaaccctgaaacagcttgatgatcgtgctgttgatgaggtgatggctaagctattcagcaattacaggaagtggtgcaactttttgtcacgaaagcatagtttgaggtacaaaaaatcccttacctttgttttctaaatagaactgttattattctcttattgtacattgtgttgatgatttcacaactgcagaagtcctcaaggtgcacaaccacaggaaattcaacaacgaaatattttgtttctaggtctttatcttctcatttggggtgaagcagcaaacatccggtttatgccagagtgcctttgctacatctttcacaatgtaagtcacacctttttgggtaaaaaaaaagtaaggtacacctttttaacatattaagtatcaaagcttaatgctattaacattatcatgtatataattagatggcatatgagttgaatgggctgcttgctggaaatgttagtattgtgacgggtgaaaatatcaggccatcttatggtggggatgaagaagctttcttgaagaaagtagtcacacctatctatcgtgtcataaaaaaggtatttgatccatcagaaatcatgcaaaatggaaaaaaaaaaggtttcttcaatactaatgattgtggcggtttgcaggaatcaggaaaaagcaaacacggaaaaacaccacactcagcgtggtgcaattacgatgatctaaacgagtacttctggtctgtttacaatcttatcttttgtacacattgccaacatttttcattttctataattcctaacctatttcattcaggacaactgattgtttctcgttgggttggccaatgcgggatgatggtgattttttcaaatctgtgcatgattcaaggcctgtaacaacggtagaaattttatccatctgtcaatatctcttggcatgtttgattgggattgacaaaacattatttataggctggaagctcatcacaaaagggttctactaaaagcacagggaagatgaattttgttgaaacaagaacattttggcacatcttccgtagttttgacagaatgtggaccttctatctgttggctctgcaggtactaactgaaatttttatatgattttttcatctaagttattgtttcacagtcttgagcagcaatcttctaatgattaaattgaacaggcaatgctgatttttgcttggagcgattatacactatctcaaattcttcagaaggaccttttatattctctatcaagtatatttgtcacagcagcatttctacagttcctccaaagtatggtccacatctcagctgcttgcctttttttattgcatgaatttgtcccctgaaacagctacgctttaatacgtcaggtgacattgccttcttggtttgtgtatgtcactggatcttgctaatgttgccacaggcattggaatattagcttctttattgtgtctttgtacttgttttgttttgatacatatggatttttaggcagaaaatgtgcactagttttgttttgttcacaatgctaagtgagcatctgttgctgaaactagtacctttccgatgtgcacattgcatagagagagcttctctctctctctctctgaagacacttgtcgggttcaaaaccggtccacctgaattatattcttaaaaaataatcaagtactggctaggcaaaactgtgaacttggcaaagtattaccaagggggaggaggagagtgctgctcttccaataggcaaaccttgcttgttcatctccttcttcagttgacccttttactaaccaaattttatgccttctatacttttttgaaactttatcagttctttttcatttctattaaggcaacctttctatttagatcagtcatgtactatgttcttgagatggtgttgagttggcagctcctattagaaaatgtaactgatcttttatttaattgatggcaggcattttagactttgttctgaacttccctggtcatcataaatgcaagttccttgatgccatgagaaacattctgaagataatagctagtgctgcgtgggctgtgatccttccatttttctacattagcaccgcatctaaagtcaatttaccaattaaagatctggataaatggtttcaatatgttaaaggagttccacctctatatatcctagctgtggcagtgtacctgatacctaatatcctaagtgcagcactcttcctgttaccatgtttccggaggtggatagaaaactcagattggcgtattgttaggttgcttctgtggtggtctcaggtattcacagcagacttctttttcaattttcttttctgttctgttaaatgttcatttcgaaatttctactatgagaaaatagtttctttacctaatctattgtttggtactagtaggatggaacataattttgagggattggatttgaacacagaatctcatatgttcttccctgtatatagtagctctggaattcctcaagttgatgaatccgtaaactttcatctctaaatactaagtatcaactctgtattctatctatccacgaatctcatgctgaggcatacattatacttctcatttgtttgaaaaagcatgatcttggcagtttcatagctcttcaaagcttatgcagatcgatgatcatattctctaatctctaacaaaagttcatcaactgaacattatattctgtgtttgcaagagctatataactgaataataaagatatgtatgtgtcatgaaagtaaatggaagcaaaattccagaggtgctactggaaataggaaaaaagttgggaagtaactaaatgtagtgaagacaataggtgtattttggtatgccaacttataaatatgcccaagcaatgtgcctttaagtaaaataaatggatgtctttcctggatataacaacaatgaacatttttttttttgctcctgctttctagtatctacattactctatgtcatgtggtttcttttctattagctacactaattgtataaataactgcagaaacgaatttatgttggccgtgggatgcatgaaagcagtgtttcactttttaagtaagttagtttttttaattgtttgcttttttatccatgaaaaaaaaactcattctcttgtattcaactcaaaaggtatacactattttggatcttgctgctatgctccaagtttgcattcagttattttgtccaggtaaattttacacttggatattttggaaagatgatttgacaagatggctctgatgctcatactaatttacagataaaacctctgatcaagccaacaaaggacataatgaatgttcataatattcattatgagtggcatgaattctttccaaatggtaatcaatgtttatttttggggagtgttattatgtatttttccaaactgataatagctgttgtcttttcagcatcatataatgttggtgctgtcatgtcgctctgggctcctgtactcttggtatgagcttatccaacttccatattagctgaccacagtgagcagtggggtcttattatttttccggggtcatattattcatttccttttcttttgaactcatgtactaagtcataaatgttcacttgcaatgccttcaattcttgtaggtctatttaatggatacacagatatggtatgccatcttctctacaatatctggtggtgtgtctggagcacttggaagacttggagaagtaataatgaatcttgaacttttacctgtaactagttgttttactttaggaagtcatgaacattagtatgtattagaggcctagatcaccacatggatgggtaaggggcatgcttctgcattaagcactcacataaaccaataggatcttaactctacaagtcttaagtgctatagaagaaaatagtattgcattcttttttatgaaaaagacctaccatagtccaaacattttataaatagagaatagcttttagcctgaaaatgccaaaaaagttctgttggaagagtaacaactaaatgtggaagttgattaatgattagtttttatttctcaaggagaacagagtacatttatttgagtatatcttagactttgaacttcgctctttttcatgttaaggcgttaagctcatgactcaagggctctgttgccctatgttaggtgacaactctcttctattcaaactatattaacgaaataagtttgttactgtccttggttccttgaggaggtacccaataagtacatggtattgttggtacctcccctctccataagatgggaggtactgggtacctcatgaggtaaaaaaaaacatggtatttcttattaaatagaagcatggtaaaagagcctacctaaggaccatagaaaagctccaactcctttttaaccttgcctattcttatttaattgtgttataatagttaatccgtatatgtaattgaagctgaatgcagcgctgacctagtttcttattgacttgcaattcttctatgaatcagatacgaacattaggaatgctgagatcacgatttcattctttgcctggggccttcaatacatttttggtgccgtcagataaaagacgaaacaggcgcttttcactctcaaagcgcttcgctgaggtcccaaataatagtaacaacattttttttcatgatggatcttctaaaccctcaaatatttatactacaaaattgattgcacaggtttctcccagcaagagaactgaggctgctaagtttgctcagttgtggaatgaagtgatatgtagtttccgggaagaagatcttataagtgataagtgaggcccctggctcatgtttaggaggaaacatgttatcatttgctcatagcaatgcgtttaatgaacttctgctattcagggaaatggacttactggtggttccttattcgtcagaccccagtcttaaactgatgcagtggccactcttcttgcttgctagcaaggtttggcagaataaaattaaagcttctcttttctcctccttacgttctgtgttcaattgcatgatcgcaatttattttgtgggaaactctgcagatacctatagctttagacatggcagcacaatttcgaccaagagattccgatctttggaaacgtatatgcgcagacgagtatatgaaatgtgctgtactggaatgctacgagtcattcaagcttgttcttaatttactcgtaattggagaaaatgagaaaaggtacattcctatatttttgctcttcccaccattcttgtttctacagtagaaaaggctaatgtgagttgagtaaagaaagaaagcccctagttctttttctgaagtttccttcctttttttcccccattttagtgtcaacataatcttggaaacaactgcttcgatacaaaacagtgaaattagagtatgcccatttttttttcttaaagatatcattaccattatttattactaggttttggtttctatggaactttggtactttggacattaactatttgctctttgcttcaaagctttcaataaagttgggtaactcctttggtcagtaaacagtttcattcttattcttacaaagccaaaattcctttggtcagaaaaatatcagctttatattgatgtgcatgcgagctatcattataatacactgtaagaatagagactggccaattgcatatggcttcacaccatgctatgtccaattagaggacctggatgtccaaattgaactaagaagatgcccaagcatcacagctataaatggagagggataccgtgacagctcataatttgtaaatgtgcaatggctattacgtaggcatttgtgcattcatctttcatgctagctttttttgtttaatttatttttgtttatgcatgttaccttaaaagcatgtatatcttggtattttgcttcaccattctttccccagaatatgttttgcttcacttgtttgttcattgactgctacaggattattggtattatcataaaagaaattgaagctaacatcgcaaagaacacattccttgccaattttagaatgagcgcactgccagtcctgtgcaagaaatttgtggagcttgtatctgccctggtaatacaatgtttactacttctactgaattgtaatactgtatgagaaatgcagtgttgttttgttcagtccttagaacatgtcatttgtcatgtattgaaatattctaagattattttactcacatccacagaaagaaagggatgcctccaaatttgacaatgtagtattgctgcttcaagacatgttagaagtaataacaagagatatgatggtcaatgaaatcaggtgacactttttgtactcaataaaactgactttctttctcatggcaaactggtgagtaatctcttatactacgattcgttcacagagagctagctgagtttggtcatgggaacaaggattctgtaccaagaaggcaactttttgcgggtactggtacaaagcctgcaatcgtctttccacccccaatttcagcacagtgggatgagcaggtcatatcatcaatatcttgtttgtcttttataactaggaaggtgcactaacttcacttgtgtccagatcaagcgtctgtacctccttttgaccgtgaaagaatcagcgatggacgtgcctacaaatcttgaagcccgtcggaggatagcatttttcactaattctttattcatggacatgccacgtgcacctagagtacgcaaaatgctgtcattcaggttagtctcatatatcaacctgctaatggtactgctgtgtttctgcttttatttccatctaaaatgaactctgcagtatttctgtcacgtttcacacatagcacactgcatagagattgtatgtagcatttctagaaaatagaatattgaaaacacgtgttaaaactaaattaacagaacacatggaaaatttggcagcaactaactgatgtttcttccactgtactcctactaaaatatttaatactttaaaaataatcttgtaaagtaaaatttgggtcgagttttggtgtgatcccacctcttaccactgtagttccgtgagtatttggccaactgtcctcgaactgaattcctagtgtgtgctcaccaggaagggggaaataggcattaataccatgcaggaatttgccatgaatgttaggtttttttagctgaagccgttgatgatgcctgacatgaatcaaaattgtgttcattgtttatttaaagctgagttgatcctcaggttcatttcttaaactttatgctattattcgatgtattaattatactgtgcccaacaaataatgcgagcagctactgacctgatgccataattctgttaggctgctttcaatacttggaatttcaacaagcactgcttgcctttgttctgattcatgtcaggcagtccagttaatttgattcactgtgatcttactatgagtctatgagagtagctactctttaatccgatgaaatgatatttataaagttcattgtattcgtccttattatagcatgttttcttgatgataacactactgcaaatcattctaatttgtgaaatatgaaatgtacaaaacgaagtggttgaccatcctgatgcagaccttgtaagccctgtacaacaccaccaggcacatcaacaatgtcgaatctagaaaaagacactgaatttgccacaaatataagccttctatgcttaaatttagcaatgtgtttttacaattttcaacaatgattgtgcattagataattgcatatcacctactgtcctttgcagcgttatgactccatactacagtgaggaaactgtatattcaaggaatgacctcgatctggaaaatgaagatggtgtctcaattatattctacctgcaaaagatttttccaggtctccactcatgttttatttttctttgcacttctaaatatggatacagtcaccaggattctgtcctttactcttcgctattcttgttatagatgaatggaataattttttggaaagaattggttgccaaagagagagtgaagtttggggaaatgaagaaaatgtcctacaacttcgtcattgggcttctcttagagggcagacactctgtagaacaggtgaatcaaactggctgttttatcttacaaaataaggatgattttgttgattccttgttaaatgcttttcttgctgtgaatagttagaggcatgatgtactacaagagagccttgaagcttcaagcttttcttgacatggcttctgagtctggtgagcttcttctctccaagctgagcattccctttctttttgtgccttcataaatatttttgatcttatgccctgtcttgcatgtagagatattggaaggatataaagcagttgcagatccagcagaggaggagaagaaaagccaaagatctctgtcatctcaacttgaggctatagcagacatgaagtttacatatgttgcaacttgccaaatatacggcaatcagaaacaatctggtgatcgacgtgcaaccgatatcttaaacttgatggtgaagtgagtcattttgatgatctattctaaactaataagatatagtaacattttgccatactacaagatacaccatatctatcccctggagcaaaaatgttttcttcttggatttttggagattatatcccttggtttacatttattttggttgatggcatttaactgacaaatacatgatttctaggaaaatattatgcactctgcttgttctattaagaataaatattattttcttttatgagcaaagtaatttcaatctgaacttgaaactgtagttatcctggtttgcgcgtggcatacattgacgaagttgaagagagagacggtgaaaaggtgcagaaggtcttctattcagttttggtaaaagctcttgacaatcatgatcaggtaatcatttccacaaagttgaattaccttgatggcattttgatatgatgtacatctcgatagagcttatttacttttgtatactgtgaaggaaatataccgcataaaattgccaggaccagcaaaattaggtgaaggtaaaccagaaaaccagaatcatgcaattgtctttacacggggtgaagctctccaaacaattgatatgaaccaggtgaattgaacggttgttctaaaaaactgaagagctatgctgccactcaagatatatctaatctgttgcattcttaattatttttaggacaattatttggaggaagctttaaaaatgcggaatttactggaggagtttcacgagaaccatggtgtgcgccagccaacaattcttggtgtgcgtgagcacattttcactggaaggtctggttggatgctttgcagttgttactgaatttacttctaaaaaaatacatatcagtgcctaacatctaatattcttgcattgtagtgtgtcctctctcgcgtggtttatgtcaaaccaggaaacaagctttgtgacaattggacagagagtactagctaatccattgaagtaagtcagcatcggtttattatgtcctgatgagatgaagcggaatccattaatattatgtggaacaatgggattgcggcatgttggaattagcatctgtagcaactgactcaaagtcaaataagttatagatgatttttttggtattatttcaaccgttgaaatgcatatggatatgtgtctgagattaagtaaataagttgtcaaagattaaatcaaccaagtgctatttgtcatcttggccattaagaaaaacatgaagacggtttatagcgtgacacaaaagcaaagggaatcaagtcttatagtcttgatgttgcatatttgacactttattttctgttcagggtacgttttcactacgggcatcctgatgtatttgatagaatttttcacattacacgaggtggcattagcaaggcttcctgtggtataaatttaagtgaagacatttttgctggtatgtgattctccatgtatttctgacttccccatttgtgctgtcggataccataggcttacacttctgttccaggtttcaactcaacactgagacgtggaaatgtcacccaccatgaatacattcaagttggcaaaggacgagatgttggtcttaatcaaatttctctctttgaagctaaagtggcatgtggtaatggagagcaaacactcagcagagacatctatcgcttgggtcaccgctttgactttttccggatgctgtcgtgctactttaccactgttggattttatatcagttcaatggtaagttggtaacttacattgacctagtagagtgaacacaggacaccttcatgcattacattcgttatgatctgctaccatcctttttattctcgtaaggttattgtcttaattttgtgcagatggttgtcataattgtctatgtcttcttgtatggaagactttacctagcattaagtggactcgagttagcaattatgaagcaagcacgaatgagaggtaacactgctcttcaggcggctatggggtctcaatctattgtgcagctaggtcttttgatggccttacccatgtttatggagattggactagaaaggggttttagaagtgccctaggggatttcatcattatgcagcttcagctctgctctgttttcttcactttctcccttggcacaaaatcacattactttggccgcacaattctgcatggtggtgccaaatataaagcgaccggcagaggctttgtagttcgccatgtaaaattccctgaaaactatagaatgtactccagaagccattttgtcaaaggacttgagctcatgttattgctagtggtttatcagatgtatggtgatgtggctacagattcgactgcatatatacttctgacatcatcaatgtggttcctggtaatcacttggctgtttgcaccattcctcttcaacccatcagggtttgagtggcaaaaaatagttgatgactgggatgactggagcaagtggattagcagccgtggtggtattggtgtgcctgctaataaagcttgggagtcctggtgggaagaggagcaggaacatttgcagtctacaggttttttcggccgcttatctgaaatcatcttgtctctccggttcttcatcttccaatatggtatcatgtatcatctgaatatctcagctggaaacaaaagcatctctgtgagtcctctgttttatttcttcaagatattttacataccttttgtcgtttagtagcatgcttacaaatacaaatctatgacttccctctcaaaaatctgattttgtgatttcaggtttatggtctgtcgtggctggtaatcgttgctgtggtgatggtcctgaaggtatctcattttctttctagtgatcaaaacaagaatggaaaaatacatgacagttgatatttcacacatagttaaactttctttcccctttatgtttctgaccagtaacttttctgcaggtggtatccatgggaagaaagaaattcagtgcagacttccagctgatgttccggcttcttaagctgttcttgttcattggatccattggaactctggccattcttttcacccttttgcatctaacagtcggtgacatattcgccagcttccttgcctttgcaccgacaggatgggccattcttcaggtacttcctcaaccatcaacattgcacttttaaatagtgtcgtcgagtacccccactgccacctgctaggtccagtaccaatccatataatttcagaaatgaatacaaggcattaaccatagctgtccactccccttgtccacttgggatgctacagttattattattattattattattattattattattattattattattattattattattattattattattattattgatgaaatagagaagcagtgctcccccctttcaatttctagaaacacgacgggctacggagttcagaaaacaaccagaaaacagaaattcgaacatccagcaaaagctcacaaacaatgccatcccatcacctgtggaaccttcacccaaactaccagctaaactaacagagctacagaaatccaaagtttttcatccatccatgcctcctgcaaatacagcctcagcagaaactttgtctccaaaacatgtaccaggacatcaacagattgaacaaaagaggatcagcttcctatcttccatttcatcactcattccttttcttctgtttcttagagcttccctcgccaggttcttctattccagtctgccagctcctatcctccagccatgctttgagttgtagatgtcatttgctacctgctttagcagatggagaccccattatagatttcttgtatttgccaccgacctctgcaaaattgcccacgaggagatccgagagctgatataatgaattagctcaattgggtgtgataatgattcattcttgaaacaggctttgttcctagtcttcaaaattgcccacaatacagctgcacttctgatcgctatccttctctgtaagtttctgtcatatttatttagccaagcacccagtaaatgatgtgttttacatccttcaggatgtagaggccaggttttatttaatccattatctaaaaaaaagtaaatgatgtgtgtcatggataacccccagatcagaagtgctagctgtatcatattccagggcaggtcaggagtaaattttttcttccccttccaccctcttttcagcaagttatatttggttaaaaggctattcttcagaatcagccatataaatattctaattttcaaaggcaccttgaattcccagagatttttgtatgggaagttcaaatgttatagtagtattgcaaagctctatgaaagaatcttgccgggaccgccaaagttctatgaaaggatctaaaagagaagccctatttactctcaattttccacactaacacgtctttctcattattcagagtacttgtctggcattggcagtcattctgcaacttgtgtcatgatctaactgtaacatgtcttaggcgaatatgtatctatcacctggcggcttaaacttatccagtacatatcgcctaactgtttgtgtcatcgtgagaaaaacaattcaccgacttccaatctgttttgtcacagatatctcaagccagcaagccggtggtgaaggccttcgggctatggggatccgtcaaggccctctcgaggggatacgagtacctgatggggatcctcatcttcgtccccgtcgccgtgctggcgtggttccccttcgtctccgagttccagacgaggctgctcttcaaccaggccttcagccgaggcctccagatctcccgcatcttggcaggcgggaagaagcagagctgagcccgcacaaagtccaccaagtgaccgtacataagcatgcacaggtttaggcgaacagcatcacaagaggttaggtccaggattgatcgttgtacagtggagaagtttgttcaggaggcgtcgtacagctgctgacttgctgacccttcagaagttccgttacttttgtacacacagggcgatgatttttttttctttttaggcattttcgagttattacatctccataccatattattcttacgtctgttacataggctgttgctgagtattgtatagatagatgttgtatgcccacaaacaggtgcatcaaagcattttcgttgatttaaatgcaaaagatgagattgtttattctctacgtcaaaagaatatacaccatgtcacctgagacaatgctgttacttatatccatattttgaaatagaacatgtctcccttttctcagctactaattattattgttatccacgcctttggtatccaagagtactccaccagacgaaagtgtgggcattgtatgatactccactcttttttttttgagaactatgatagtctactcacggtgatagtattacattactagtctacaccatagatgatatatttaaatggagatcaagatcactcacctcaccgaaatccgaattcccaaacaggggatgagtcatccattccaggggaagcaaacatcaattgctaatttgcaatcaatacagaaccggtaactaactaatgcacctttcagcttgtccaggacatctccaaggcttttgacttggtcagatgggactacctacttgcgctcctccaaaatagaggttgcccgtaaaaatgacgcgaatggataaccggattgctgtccacttccacctcaaagatcaccctgaacggaatccgggtcgaaacaatcagacacgggaagggtttgcgacagggtgaccccctatcccccctcctcttcatcttagctatagaccccctccagcgccttttagacaaggttaccgacatatgagttctaagtaagctgcggggcagagttgtgcgcttctgcacatttatgaatgctgatgatgcggccgtcttcattaatccgatcaaagaggatgtgagcgccttcgccgatctgctaagtcgttttggaaaggtatcaagattatgcacgaacctacaaaaattgcaagtggcgccgatcatatgtgataacataacctggacctcgatgacattctacatggcacgcctacaactagggcaagcttcccgatgaagtatctggggttgcctctgtccactggtcgtctgcgcaaagtaggccttcaacctctctacgacaaatcgatgagtcgagtagctagctggcaaggaagacacattggcctggaggggcgataaaccctggttaaatcggtgttcacttcacaacctgtttttcttctaacgggactgaaagcatcaaaagagtccctagaggtcatcgacaagcaaaggaggaaattcctatgggcatgcggtgaagctctgacggggggcaagtgcgggcaagtgcaaaataaattggacacggacctgcctccctacagcctcaggaggactgggcatcctgaacttggagaaatttgcaagggctttacgtctgcgatggctttggaatgagtggagatcaccggaaaaaacatgggtgggatcgggaacgccctgtgacgacacggataggttactctttgcagcagcaacaaccataacaataggggatggagcgaaagcaagcttttgggattcggcttggctggaatggagaatactaaaggatgtagctcccctgatctatgcggcctccaagaaaaagaatagcacgctacaacaggcctcagctacagaccaatggctgctcgacctggacctgcccgcagcctcaggctggacaacggagctggtcagttagctaatcaatgtctagagtgcggtgcacaatgtgcaattcacagagaacgaagaggacaagataatgtggaagctcactagccacggtgaatttactgtgacatcggcctacaaggcgcagctcctaggtactacagccaccaacttcaacatcctaatatggaagccgtgggcaccacacaagtgcaagacctttgcctggttgatcatccataatagagtttggacctctgacaaactggcaaccaggggttggcagaacagctctttctgtcccttatgcagacacacccaagaaacagctctccaccttctcgcagaatgaagatacaccaggaaaatctgggcggcgttatctgaatggactgggtgtggtcaactgaatcctggccaatggcaaccagcttcatcggtgttagagtggtgggaggccaccgctaacttgaacgaagccccaaagaaagcactccgcacgctaacactcctggtcaactgggaaatatggaaaaagagaaactgcagaattttccaatacaaagagctatctaccggaagtctgttggctaaaattaaggaggaggccaaaacatagtcttgggcgggggcgaggcatcttggtagctggcttgaattttaattttagcttatttggaccgaaggtcttgagccttgattttcttacttgtaaagtttactcctctattcaataaaattggcagcttgccgatttgttcttttttttagcttgtccaggtatcatggctaatgatcgcctaatggctcactgtgaattaactacacacgtgatgacttggcaagtggctagattgctctcaggtcagccgctgtgcgtgaactgaagtgtttttggtttagtaagcaagggggcgaccggatgctgttctgcccaataatgatgtttgtttgggatttgctttagttgttgatccatctgtggctttaatccaacaaccatgttattgttccttgtagtgaactcgttttgttcttaacaaatttcccatgtaattcttcatctactaaacttccttccatcttaactttccagcatgttaggactcctttgaaaagcatcattgaaaaaaatagagaaataagaaaaacgtagataatgtaagtgtagaacagattattaccaaacataaaaaaaaagaaggaatgattgtttaagtagatcatagaaaagacatatgaatcggatgagagagactcaggaggtctcttttataaaaggttggagctattattaactttccttcaaatctctttagagaaaattatgatagataggaatcaatcttttgttttaaagttcttaaaattttttcttctgtaaaattttctaccaatcaaaacgccttatacaaaaatttcctccttccaacaagccaacgatatactagtataaatgaagcgacccgcacatctggaaaacattttccacatacactagcttcatatatacggaaagttcagattcacgtgtcccgaactggacctaggatttttttaggttgcggcgcggaattattacacgttccaaaaatccaaataaagcgcgcacaaaattaaaaataaaaatgtggagacagccagagccgctcgtctcgtctcgtctcgtccggccagccagccaagccaggctgcgccgcgagacaaatccagcagtagcgtagcgcttactggaaaaaaacacacacacacacacacgggcatcgcgaggacgccgcgcggcgcgggtgcggggcgcgacaacgacgcgcgcgacgtgcgtgcgtgcgcccgcccgctcgcccacccacggcgcgccgcgcgaatggcgcccttctcctcctcctcctcgccctcgccggcgctggcaccggcctcctcctcctccaccgcctccacgccccgggccccaaggcagcagctgcctcgcggcgcgtcgtcgtcgtcgtcgtcgtccccggtgtacctcaacgtgtacgacgtcacccccgccaacggctacgcgcgctggctcggcctcggcgtctaccactccggcgtccaaggcatgtacgctctgctttcctcgccttcgatcctggttcgccaccgacggcgctgacacgccggtgtgctatgtctgtggtgtgctgcagttcatggggtggagtacgcgtacggggcgcacgacggggcggggagcgggatcttcgaggtggcgccgaggaggtgcccggggtacgccttccgggaggcgatcctggtggggacgacggagctgacgcgcgccgaggtgcgcgcggtcatggcggacctcgccgcggacttccccggcgacgcctacaacctcgtctcccgcaactgcaaccacttctgcgacgccgcgtgccgccgcctcgtccgcgcccgcatcccgcgctgggtcaaccgcctcgccaagatcggggtcgtcttcacctgcgtcatcccgggcaacggcgccgcggtgcggcgcaagggggaccccccggccaccgccaccgcccccggcgggaaggccagcatccgcagccgctccgctcgccagggcgcggacgccgccgcgccgccgcggcccaagacgttcttccgctccctctccgtcggcggcggcggcggcggcggcggcggcaagaacgtgacgccgcggccgctctcgacctcgccgtcgccgacaccgcccgctcccccggcgtttaccaccgccacgtaaccgcgccattcctttactttttacagtttcatctcatctttttgtactcggtaaaaaaaacctttgtgcataaacttaagattaaaattaatccgagatttgctagtgccagtgccctctggttggttaattaggctcttattaataattagctcgagcgttcatctaatctcagtcagtttgccggattagtgaagtgaattttggcttttactacgagcacaattttacgtcgaaatcaacgacgtgcattgttagggcgagtgatgcaataggaatatattcctcttcttttctttggatttaaccaccggcctacgatgcagacaccgaaagttgcgaatgctgatgctgagaaagaatatatgagttaccaacaaaaagaaaaggagagaaagaatatgtgctttgctaattcattcatgggtatatctatcttatcatctctagggtttaaacttcaaagtaactttttttatagaaaagaacggtgtgaaatccgtatatttcttaaaactctatttgtctgatgtcttcttatttttctaattgtgtactctctctattctattttaagtgtagttgtgatttttcgtatccaacattcgaccgttcgtcttatttaaaaaaattatattttttaaaaaaaagccaatcacaatgtactattcatgttttatcagaatattaattataaaaaattttaaataagacgaaaggtcaaatgttagacacggaaatctacaactgcatttaaaatgggaccgatgaagtagaatatctcaaaatattttttaaaaaataataaaataaagtgatatgtgatatatggcatgcaattttaaattttacttacaagtctataaaaagggaaaaaaagtaattttctatgatgccgcgttggtgtaccgtgttcttgctcgccgtggaccggcgcgaccgcaaatgggcgttgacggctgagacgacgtcggtggcggaccgaaacagaatccgggcggccatgcatggtcaaaatattgacaaccattgtccactactggagaaacgcaaaataggtgcacatatcaaagctcgcatcgcatttttagtttagcagaaagtccacgattctaagtgaaaatcatttgacttccgaaccccttcggacacaggaatattcttggtttttttaaacaaattaagtactatctccatattttaatgtatgacaccgttgactttttgtccaacgtttgattattcgtcttattcaaaaaatttatgtaattattatttattttattatgacttgattcgtcatcaaatgttctttgagcatgacataaatatttttatatttgtacaaaaattttaaatgaaacgaatagtcaaacgttggtcgaaaagtcaacggtatcatacattaaaatatggagggagtaatatgttaaacattagaaataaagtgtacatggataagtgatagaacattgttagctgttagagctgacatgagggcttccttagtgggacacatgaatattcttggtgtttcatgtgaattgttcagtttcacgaaaatcctcaataaattctctgatgaataatacttctattgaatttgttacttctagccgtcggggttcaaattattgaggattcgtaaatttggaagtgtcacatgtataatccatattatccgcataagctggttagaacagaatttttaattatctttcaactttttaactttttatttttaaaataaactcttccaaattttttttttaaaatgggaaccttttgatcaaccatcccgcctgacgtggacgctgctagcaatgggcgtgccaatcttaactagcgtgaccaaaagaccagatttggttttggagtgtttattttaaacaaaataaaaatttagaaggttcaaaaaaagtttttaaaatcattagagcatcccttaacgatagcttcccaaatcagctctgaaagggatatgtctcatcggatattagattgttatattttggaacgacatagtactcgtaactgattagaacatcccttaacgacaacttcctagatcaagtttgggatcaatttgcttggagctgcagatataaaaaaaaagacttggagtgagagcattactacgaacatttttcaagaagaaattataaacgtgttggaaataaaggggttgtttggatgggagggactttagtccctcacgggactaagggcatgtttggatcagggactaaagttcacatttgatgtttggacactaattagaagtattaaacgtagcctaatgaatctataaccttgctaatttgcgagacgaatctattgagcctaattaatccatgattaacctatgtgatgctacagtaaacatgtgctaattatagattaattaggcttaaaaaaattatctcacgaattagctctcatttatgcaattagttttgtaattagtctatgtttaatactccaaattagtgtcaaatattcgatgtgacggggattaaagtttagtccctgaatctaaataccacctataatttttgtgaggggctgaaattagtcccccatccaaataggaccctaaacttgggacttgtatgtatctctggagctgcagatatatgttcaggtgagtagggtggcctggcactgggcgtggtagtagctggaactgggctatgggagagaaaaaggtgcagtggacaatggacagtgcctttctccggctgtctccctgccggccgctggaattatttgggggcaaaggtttggttgagtgaaatcatggaacgtgcagtgcacccatgcaacggaagagtagagagaggggggggggggggggcagaattttatggcgagtggggttgcattttgcagtgctagtgcactgcacacctcccaactaattcctgcgggcaataattctgcacctggcccacccaccaacgtggcttttctcaagggttgcagcttagaacaggtataagagctgtgagaaagcagaaagttgagatggatgagagagggtaaaggagagatatgagaaacatgctgtaagagcaagtttaatagtatagcccactactagctttaattcatctataatcaatctaatagctaattcatacaatagttgcttactatactattaatatatggtcccacatgtcatacacacattgcgtcttaaagtccgtgctacagctggctatagatatgtagcccactgctcttctctctcatcttttatctcattaaaatatgtttatagctggctaatagtctgctattgtacctgttctaaggttacagacggcttaggcatatgaaccaagaaaatttgtgagacaaacagatgaatcatgaagagctaaccactcggctgagagatatatctcattaaaatatgtttatagctagctaatagtctgctattgtacctgctctaaggttacagccggcttaggcacataaaccaagaaaatttatgagacaaacagatgaatcataaagagctaaccactcggctgagagataggctataaagatctatacattcagcctggttatattatgattcttgctcttacgtgtgctcgatctgtaatagtacactgcacgatcaattgagatccagtgcagtctattatcgcagtcctgcttgcgttgtctataatctccaagtgatcatatagacgctagcatttggctgtttggttcccaacaatattttgctaggcatcatttgtcaataaaaattaccacactttatctaagatgaggcgatcaactttttagacacaatttacaaaggttgagggaatcttgtcatacttttagtcattagcacatgaaacccaatttattataaaggaatcttgccacaactatagttacaaccgaacatctatcaagttgatcaaatttacctaaccttagacataacaaagtgtgacttgaaaccaaatattcctgcttagtcgcttacttctcaatacatataatgtctaaaaagtctaaaataatttatcatcacaaatatatactgctatttctttcaaataactatctatataaacaattaatgtttagaccatatgtccattccccacagcagtttcggttatgtcgattataaactgtaacagtttattagctataaaaaataatttataaataaaataagagttttaataatttataatttatatatatctttattaatttaaaaaaaatacccgaaaaaaactctagtttctctgccaagcaataagagcgttagttctctgttctggtctattgctatggtcttcacgtgttagattcagggtttcccaaaccgtcgaggccagggttaccacgccccggcggtaagcacagttatcgcgcggtaaccgtgaaaaaccgtacgaaaccacgcaaaatttatcaaaaattcaaattattttttaaatttatttgaatttaaggaggttaccgtggtatttctattaccgtaccccgcggtaaggccagtaaccacagtaaccgcgcggttaccgacggtttgggaaactctggttagatttcatgctgagtctggctctcatgtactcccttcgtcctgagttcggctgtcatggaaaccatccgttcaaaaaattatatattttcggactttctaaagtaaagttatcattcttttactccggttagcacatcttccgaaccgctacatggtttttttttaaaaaaaaagaaatatctatacaaaagtttcttaaaaatcatataaatattttttttcaagttttttctgagattaattaatcatatattaatgagtcactctattttgcatgcacgtggaagatcacaacccctccatctgaatgcaccctgaacttatccaagtttatggtaggattttttttttttgacagaagggataagaccttggttaagactccaataaactctcgtgccagtaccccagtcaagaactgggaactttggtgtccaccgctacgattgttggacagaaaagcaaaagcagttcagatagctggaaaaaacaccgttcacaaacaaattgtagtggataagtcctatagcgaacactgtagcaattgtggttcaacaatgctgtagccgtgtactgtcaggttatcaagcccatatcatgtttggagtgggagacaaacctggacctcaaaatcaggtgaccctaaaatttactacatttgatctttgttagtttgtgttttggatgttgacacaatcttcggtgcctgttcatcatcacttcatttaactatatatttattaaaaaaattaaaatataactacatgaaactatttttcatgataaaactattaaaatcatttatacatactgtagtccttttttttcatttaatagttggtaaacataccgaggtttcactgcatactttaggacatcaactatttgagaatggagataccgagattgtaacttatgaaacaaaaaatattttggttattggcatttttcaaatttagaatttcattttgcgtttagcatcgagatatcagattcttgagtacggatttgactcctatatctcgagcgctgaagttgtattttttatactaatacacaaacagtactggatccttagacaacaactccttttccttgtaaagagaaactgtgggcaactatgtcaaagatggctccaatttccgatatcaccagatataatctgactttccgtttggtagggtgtccagcaaacaagagtagcaatattgtggtgttagggacagaaaaattaccttggctgcactttttgaagaagttgcatactgtataagtatttggatagacaacaacaaggcagtcgccgaagatccaaaagatgaagtgcaggcatcatgtgggacgtagcaaatcgacctgttcaagaagctggtagctacaattaatctaggaacaaatagtagttcaagagactgatagttacaatctaagaacaaatagttagacaggatagctcagttattaagcatttagtacaagaaatatatgaacagaaagccatcagttggccaagagcgattatatgccacacggcttattagcaacgtaaaacttttatacatgtattcttagcaacttaaaagacaatggtaaaaagaaactacgttgaaaataccctaaaatcaacttactttgaaattatgctgtaaatttcggcagctgctaatttgttataggggacaaaatattatagcaggcataagtctattggcggtccatgcttggtatggacaaccaacagggagtccaaatccaacctgaccataggcccatgattatcaatgcgggcaactgggaggcggcgcgaggagctggcaggagaaagtaattaaagatgtgattaaattgtgatcacatgattaaccgccgaataggaatggaatatgaaatcctgaatatggctgaactggcaccttaaagaaataaagcaaggttaacctgaattcccatggcttgcttgatattgacacatcactttggttttgggactcgatgcttctttccatagaaagacatgagcagctggaaaagtggcaacctgaaatccaaaggaatttggtaatattaagtggaagaaaagaatagattgctgataaacattcaaagagaatgatggtgggtttgctgattgaagtgccggttcccttaggcaccaagggatttcccttccatataacaaatcaaactacctttatgcatattagtggtcaatctttcacaacgttgactgactgcgatctagacatctaggataagcaataaatggagggattattgtcattgtcatctggaaggtcgagttttactgacaaaataattggaaagcaaaagtaacttacaagttgtaatcttgccagcaaatctgcaatcatgaacctgctaccttcggcaatccacaagtattaggttatttgtttggcaatgtatccagtataaggttaagtttaaaaatgtctcgtttgtgacaaaaaccagccctatagaatgacttgattataaagtcgaacatatggcaatcagagagtacaccatttccttcaaatacacggtgaatctctatattattcaccactctaaacaagccagaagatccattggaaatccactttaagtgatttcataaaaatataagtatccttgtcaaattttccatctctgcataatctcatcaaccaataatgtatctgagtgacttcatctggattctggagcaatatcctgcgctgtcgtgcacgaaattaggtacttcaactcattaagttttctaaggcagcaaagccaatcaatgaggataatgtatgccacaacattagtaaaaccttgaccatggaccaggctcttggttatggaagactttctccctaatgcaaagagccaaagactatgaataaaaatgttgaatgtctttgcgattggacgatacttttgtcgatcatgtacttggtcaagagcttcagaacagccatttgcccatatctaacagcccgctcatcagagtgttgtatgcagagttgcagaccctcgctaacaagcacaaggcatatgaaaccctcagtcatggagaaggcaattcggaagaacactcgatgtaaaagccgagggatccaatcctttcacttagcataacatccaactgatcaagtacttcctttgcactacctttcttgcagaggccattaaggtatatgtattgtaggcgagcatactgtgcttccaaccgctggttctactactgttgaaacctgctctgaacagagttgtaggtgataacattgggaggacaactagcccgatccgtcacggccatggcggcaatatgcatttaacactggacgtgcaagtgtacatcacttattcagcattcagtctgaggatgccccatgcctcggcgaccttcactgcatgcgccacagccggcaaaccccgtgatgagcattgagttcatggcaatgccggcctccaacccgtgctccccccccccccccgatctccaggatgagcttgcaggcgaggcgaggcgaggtcgaactgcaacatccacccgtacgtgcagcttgaccatgaccatgaagttgtccgacgcgagcatttcgtcgaacgcctcgtgcgcatcccccgcccgcgcacgcgagctcatcgaggagcatgctgtgggaggagcacgtcgcgcgtcgcgccggaccaccgccgtcggtgccgtccacgtcgtagtctcgctccacctgccgccgcagcggaggaggtgagtcgggtggcgctttgggcgtcgtcagagtgttcgggggagggggaggagagcggcggtagaggcggaagaaaccatgcgcgaggggtggtcgccaatggaagtgaccgacggcggccacggccgcggcggaggcgccggcggctagaggagagtggtaagcgacggtgaagggtgggggaatcaaacgccgccgtccttaaaatttgaggtctctttggatttgatgaattttgcagaaattatagggaaattgaacaacggctaaaaagaaactcttgttaaggtgtgctggtttctactgaagattgattgatcgaagttagggcaaaaaaaatatataaaaaaaggacattagcccatgattaattgagttttaattattattgatttgaaaaatggattcgtatgatattcttaagcaacttaggccttgtttagttggcgaaaaaaaattttttgggtgtcacatcggacgtttgatcggatgtcggaagaggttttcggacacaaataaaaaaactaatttcaaaagattcgtctcgcgattttcatgcaaactgtgtaattagtttttgcttttatctatatttaatgcttcatacatatgtccaaagattaaatctgacgtttttggaaaaaaaatttgggaactaaatcaggccttatatacagaaagttataatgcgaaatgtatcatttaacaatttaaaaaccgaggtatactcataaaggaaacgagcctaaatcgtgcatttcaaatgagacctgcaattctcaatagtggttttgtggagtgaatttatgagattgccactaaaattaaaatgaatgttctttgggaggtaggaattgaaaaagcacatgaaatgcgagaaatatagtcatgtggaatcttaaggaatataaaaattcggaaattgttcaaccatgttgtttggatgcttttatatgaatttggagacaaaacaacacaaaggaaaattttccaaaagtttagctcatgttagatttccttccaaattttcatgaatctggtcatttcattcaaatttcaaagggtacattcctttgttccaaaggagcatataagaaaatcttccaaaagatactcatcctgcgttttttttaaaaaaaaattaaacctttgttccaaaggagtctgagataattaactgatcatcccaccgtctttccactatcaccctaacccaaaaatatattggtcaatggttgttgccttgccggagtcattagagatggagaaaacaaaatgttgggatacaaatctcggagagttggagtcaatctaaatgttagaaatttcaacctaaatctctaaacaaaaatgtattcacacatgtatagcaatttggtttagaagggaagttgtacaagatattatcttttgcttcacaaacaatgaaacaaaaatgactgcaaaatcctcctgctctctggacaaattcaagcaagaatatttgaatacaaaaaaaaaaaaacttgtacccacgaattttctcacttgattatccacacaaaatttttctcatcatcttgcacgcgaatgcggcaatcatgaattaccaatcacaaattcacaagcaaaaaataacatataatttttttccatacaatccaacgcaatgcaccaacgccatggacgccatggatgcatggccattaattacctcctcttcttcgtcttccagaggtgcacgacgagagagaagccgccgccgtcgttcatcgccgcctcctccgccgtggcccagtcggccaccgtcgccatgctcccggccgacgacgccgccgacgtcgacgccaccgacaccgccggcgacgagtccgaccccgacctgaacggccccctcctccaccctctcctgtcgctgtcgctgctgcaccagctctcggcggcggcgccgccgccgccgccgtggtggtggtgcttcctgttgaaagagctctgccttagcgcgagcatgccggcgtcacgttccatgtcgatcttggaggtgtccgcgacgtcggccgtctcgaaccggaggacgaacaccgcgacggcgtcggcggcgaagagccagccgtggaggtcccacgagacgcggacgcggccgcgcgggaggtcgagcctctcgctgccgcggaacttccaccggagccgccgcacctggagcgccttctcgccgtcgatggcaacccacatgacggcgtcctccaccgcgatcgacacctcgtgcctcccccccgcgacggcgacggtggtggcgtacgcctcgccgccgccggcggcgaccgcgttctcgcggcgggtgaggaggaacccggcggacggggcgagcagcgcgaggtcgcccgccgccagcacgagctccccgtcgacgcacacatgcagggaatacctcgccacgggctccggccgccgtccggcgaggcgggcgcgggacatgtcccacgtgaacgcgacggcgtgcccgccgccggcgaacctcttgcaccctcgccgccgccacgggagcaacggccggagcaagaaccgcagcgcgggcgcggcgccctccccggcgaggtggagctccgcggcgaggacgagcccgagctgcccgcgcgaccacgtcagggtgacggtgccgaggtgcgtccagtacaccgacgtcgccgacgcggccggcgccggggacgacgacgacgaggcgcccgcgcccccgccgccgcgtgcggcgaagcaggcgagcggcatggcgcggcgcggcgcggcgtggcgtggcgtggcgtggcggcttcttcttctcgatcagattggtttcctttcgagaggcgatcgagtcagagagtggcttggcttagttgcaccagtgcggacgtagcggcgacttgagagggagcaggcgaaagttgaccggatttctttctctctctctctctctctctctctctctctctctctctctctctctctctctctctctctctctctctctccatttttcacatttctttttcatttttttgtatttatttgatttgatttatgtctttgtttatgtgtcaaactgtccattttaaggctcgtgtatttccttttcagattcagaggatatgacccaaggaaaggaaaattagggactttctaccaataatgtgttgttacttctgttactaactccagtcaacagcaacttgtttttaattttttataactcaaatgtgatgccactttgacagcaactccaatttgggtatcatatatgttgtgagattgtcgtaaaagtgacaataagcagagctaatggacaagggacaacaaatactttctgttttaaattatttatcgttttagatttatgatcatgttccttaaaccttttcttaaaaaaacaaagtttgacatcatgtttatgtttttagattcatcttagggggagtttttataacatataattcacatgttattaaactatatgattctttataaaaactagtgattttagatattttttattcagacaaatctaaaatgataagtactgatttgaaacggagggagtttagtaaattagatttagtgtcagaggcagttaagagtttggtcaacggcaacaattccactgtgctacctgcagacagtcagcgacagtgaagggaacaaatgtggttttcgctctggctcgtagtatttttttaaaaaaaaacaatccatcattttttctttgaggaaaattaatccatcattaattgaacaatgaaagtccaaacatcattaatctgaaaacaatgtcaaaaggagatcttccaagtcaggactgacaaagtcgtaagcgtgtaaagtaattttcattttttttgatagagaaagaagattaattaactttttgttaagtctagccaactttttatgcagttttcaccaggacatcactatcgtatattcgtatcatcgctggtgtggtgtgtgttctcagctattacaagtctgaagtctccatcggatcaagaccgttgatatggccacgtggtcgtccccaactactcctatactactaatctatatggacagtacagtatgaaatggagtagtagtattcagtagtcagatcaattattcagtattcagtattgtagtacatcatatctactattcttatataattgtcgccattattgtgattataggcagccacatcaccttatttatttgagccatcagatcaatgtcaaaatcttacagtaactgttagatctaagcatctccagtagaggtcctaacacagcccctgtactaattttgagagttgagactaaaaactcaggtccaataagaccactactaaagctcctaaaataagaaggcctctaaattatcccctcgagccccgagtcctaggggctttctccgcagcccccatccatggcagagatgcgcgggagaaaatcccaccaccgaacgggtactatttttccgcgcaaagtatcctgctagcccgcaactaccggcgcctccacagatctacgctgctcctcctagccggcatcctcctccctggtaggcctcctcctggccggcgcggcggcaccctcctcccctacaagcgtcctccctggtaccctccttcccggctggccacctgcctacccggcatcatcctccccagatccatgtttgaaaatttcaaattaaaatttgaatcatgttgtttgaaattgtaaatttaaatatggttgaattccatgcgctagaattattttatgtttgaattattatagtgttaaactagatataaatataaattctatactaaaataaaagagaaaaagaaataggggctaagttatgggggctactgctagagttaatgacatatttaaggttctaaagatttgggagcagcccccatttaacctttaggggctttaaagtaggggctactactagagatgctctaagagcgggtaaaataggagttttaagctggcggtagaatggccccgctagcaaaagcaatgagctggcaaaaagaaagaaggaaagagagtgtgaatgggcgattatattaccaccggctgtacgtgagcttcgagacaaggtaagcaactgctattggcctatacttgcatgtgaattgtgaattgtgataggtcagtgaggtctgcaaacaaaccatagtaattggcatgtctaaa

SEQ ID NO: 74425 - DNA, 3060 bp, Oryza sativa
gtcgcagccctggacgaagcagtcgtggaagtggagccggatcagcgccgcggcgaggccgacgtccttggcgatggcgtcctgcaggaactcgaacacgacggcctccgcctgcgggcaactcgcgtcgtagtagcccaacgacaaccccttcgccaacggcggcatcctcgccgccgccgagctgcacaccagcgcagccgcggcggcgagcagcagcatgccggcagtagcactagtcctggacgccatggtcgatcgatatagctaagtttacttagctctcgtcgtactcgtactgatcgatcaaccgtgtgccgtcctcggaggatttccatcgcttttatagcggacgcgcactacttgcgagtgtcgtgatgaaattgatggatttggggcgtgcatctgcgatttttccacgaggtcgttggaatcgtcgaaaaatctatgataggtctattatatgaacgcatgcgcgaacaaattgcagcggactgagactggctgatgcggcgaacgatcgagcgagcttgtcgggattgagcaaattggcagcacaagtggatggctttttttttctttttggttgaaactttacaagtggaggttggtgcatagtacaatgcacaaatgctcataggcggctatataaggattagtagcaaatttagttatgtataaagaaaaacccttaacttggcgatttttcacatatgtgtaatctcgcaaattgaattatagctaggctcgccgtttttttttccccttttttccaacgagctagcacgattctttggagagaaagatcaataatgtgtgattcgcttcaaatggttcaaccttcttccgttgaattattcgaaagaagtcttacgaatgagtggtgcacacagctcctccatcggaatccatgcatgcataaattagctgtcgttgtttaagggtgggcgacgggccggcggctacgctgatcagtttatcatcattgaaaaataagaataagctgatgaagaaagaaaaacacaagcaaatttaactactcacacaaatataaattgaatccgattcatattcctcaaccataaaactagataaatcgacccctctaactatcaaaaccgtttaaaatgactacatcaactgtttttaaaagcggtttttcgttgacttggtgttcacgtgacatcccaatcattaaaaaaaatagagtgggttccacctatcatcccctccatctccatttctgacctctctctctctcccatatcgatttttttcagtctcacattgcccaccaccatcagaattcagaaagatgtcctggaaagttggaatattcatgtcccctgctattgctttttccatcgcccccgctcgagttgaactgttgaagaagaggtggtggtgtttcacggggttcagcctcaggccgtcagccccttgtacaaggccaggaccggccaccactcaggtaaagcagattaagtgctatgccgacgagcttagactgacttctttcctagctttctcaactcatcttcttcgttttttacacatacacttttcaaaccgctaaacggtgtgttttttgcaaaaaaattctatacgaaaattgcttaaaaaatcatattaatctatttttcaaaaaaatgctccatccaattcaggttataagacgttttgactttgctcaaagtcaaattatttcaagcttgattaagtttatagacaaatatattaatattgataatactaaattagtttcatcaaatcaataattgaatatattttcataataattttgtcttgggttaaaaatgttactactttttctgtaaacttggtcaaacttaaagcagtttgactttcactaaactcaaaatgtcttataacctgaaatggagggagtagctgctaatgagccgctccattttatgtgccaagagatttgttcccaaccagtagtaacgaacacagccgtaattggttatgcctgacgaactcttgaccttcacttcacatactccatcctctgtgcacaggggcagatccaagaacaaaaattgggaggaggggggctcaattacacagtttgttcaacctccagccatttagaagccttaagtttatcattcattttaaaaaaattaaaggggatgctctgggaggtatccatgggccttgtgggtgtaggggggactccaaaccccccgcacccacgttggatccacccctgtctgtgcatatatctatgtgatccaatatgcgcatgcatccaatatgtgcatggttaggttgtcacgtcaatgtcctacacttctgtcttctgcatgggctaaaaaaaacggcccatcgaagttagtaggcccaaaaaattttgaaggctgaaccgccactttttcgcagggtgcataagcaatcgattcccaaacaaattttattttattcattccttcaaatatcaaagtttgatctctgaactaacatgcggattataaaatgcagctagcattaacagactagcaaccgatgagcgtacataaagcggggaaactattttgatggatgctagctgcctagctgcattttataatccacccaaacggttattttaaaaaaatatcatccaaacagttataaaaaaattatataaaatttgataatgttcgtacaacatatctatacaactccacaaaattttagatccaaactcaactcacacatcgacatatagaaaagacaaacttatgaatagtagcatattgtatacaaaatttgtctctctttttttaatcttagtgggtatgtcaaattttagcttgatttttggtggaccgatagatatcactatactctacattggcaaatctatatctatatctatacctaattaaaaaataagtaaggttttcggttgattttttttttccgtcattaaagggtggggccacgtgattattttgccggttatccgtgaatccggatgcattacgacgatttttgaggtccgcaaattaaagaggatggaaaaaaaaaagagaaacctagcgagcaggccgg

SEQ ID NO: 74426 - DNA, 4235 bp, Oryza sativa
ctaaagatcccccctttatatatgccttcttcctcctccagctcgagagcaagcttcaaaatttctcaaagaaagaggggaggtcatgccaaaatttcttgtgaaatttttttagtgattatatacaaatcggaggtgtctaaaaggttagtaacttcatcctccaatgtttttgttgttatattacttttggagctatgtttcacacattttttttgtctccaaaactttgttgtaagttgatgagagagaaaatttgtgtggggaagaagaatatatagaaattttattctcatagattaaaatatgatgaaaattaatcttaaaaaatagaaaacaaactaaattgaaaattaagataagtacaacattaatattagtttagatcttcaaaaattgttaataagaattgcttgtcgaaagagtttttaattattttatcattactgtttgactgtcattattgtacgaaaatttatttatgtacgattttttttcatttcatgtagatggatcggcaatggatgtacgctgaccggcggtccaaagagtttatcgagggcgtgcattatttttttagagtggccgaagataacaagcgtaacggttttatttgttgtccatgcaacaagtgtaagaaccagaagaagtattctgcatccaggactattcatttccacttgtttgagtcggggttcatgccaagctataattgtttgagtcggggttcatgccaagctataattgttggataccactctggagttcttgcaatggaaggcaaaaggtggtgttagtgacaaggcatttggcgatttattgaaacttgtcaagaacattcttccggagggaaacaaattgcctgagacaacgtatgaggctaagaagatagtctgccctctaggactagaagttcagaagattcacgcatgtccgaatgattgtatcctatatcgtggtgaggagtacgagaacctagaagcatgccctgtttgtaaagcactacgatacaagattagacgagaggatccatgtgtagttgacgggcagccaacaaagaagagaattcctgctaagatgatgtggtatttccctataataccatggctaaggcgtttgttcaggaacaaggggaatactagaatgatgcgttggcacgctgaagaacgtcaacaggacaggatgttgagacaccccgccgatggttcgctgtggcaaaacatcgacagaaaatttaaagactttggaaaggacgcacgaaacatacggtttggtttaagtacggatggcatgaatccttttggagagatgagcagcggccatagcacttggcccgttacgatgtgtatctacatcctccccccttggctatgcatgaagaggaagtacataatgatgccgattattattcaaggccccaagcaacctggtaacgacatcgatgtgtacctaagaccattggtcgatgatcttaaactgttgtggaaaaaggaaggtgtccccgtgtgggacgaggacaaacaggaggagtttaacctatgagcgctgttgttcgtaaccatcaacgattggcctgcacttagcaacctttccgggcagtccaacaaggggtacaaggcttgcactcactgtatggataaaacataaagtatgtatcttaagcactgtacatgggtcatcgtcgattccttgctgcaaaccactcggttcggaagaaaggcaagcactttgaacataaggcggaccaccgtatgaagcctaaacatcgcagcgggaaaaaaatgtttgctatggttaatgatctgaaagtagtgtttggaatggggcctggaagccagcctataaagagcgaagatggtcacgcggcgatgtggaaaaagaactctatattttgggagttaccctattgggaattcttggacgtccgccacgcaatcgacgtgatgcacctcactaagaacctttgcgtaaaccttattggcttcctaggtgtatatggaaagtcgaagatacactggaagcacgtaatgatctgaagcatatggaacaacgtggcgaccttcacccggaaccaaaggagaaaggaagccattacttgagtccagccagctacactcttagcaaggcagagaaggaaagtatgtttgaatgcttggagagcataaaggtaccatctggatactccacaaatataaagcgaataataagcacgaaggagaagaagttcacaaacctaatgtctcataactgtcacgtgttgatgacacaactgctaccagttgtaataaggggtatccttccagacaatgtccgggcaacaataacaaagctaggtgctttcatgaacgcaatttcgcagaaggtcatcgatccggatagattagaagcccttcagaatgatgtggtgcaatgtcttgtcagttttgagttgatatttccaccttcatttttcaatataatgacgcatctgctttgtcaccttgtcaaagagattggtattctcgagcctgtgtacctacacaacatgtttcctttcgagaggtacatgggcgttttgaagaagtatgttcgttaccgtgctcgtccagaggcaagcatcgccaaggggtatggaacagaggaggtcatcgacttctgtgtagaatttattgaagaccttcgcccaatcggggtacctgaatcacgccatgaagggagactacggggaaaggggactctcggatggaaagcaataatgacggtagacaacaatttattccgtaaagcccatttcacggttctacaacaatcttcattggtggctccttacatcgaggagcacttggctccaattcgcgccagaaacatcggtaagtccgatgcatggattacacggcatcacattgatactttccctgcgtggctacgacaacatctcatgggtaacgagacgattaaccaataactggccttcctggcgaggggaccatttggctcgatcaagacattccagggatatgagatcaatgggtacacattctacacgagagcccaagacatgaagagcacgaaccaaaacagggatgttcgtatcaatgccatgggacacgatggaacaactggcacgtattatggtgccatcgaggacatatgggaacttgactatggtcttctcaaggtccctctgttccggtgccaaagggttaggtttactggtggaggcgtaacgattgatgacagtgcaatgacaacggttgaccttaacaaggttggatactcggacgaaccttttgtccttgccaatgatgtaacgcaagtcttttacgtgaaggacatgtctagcaaaggaaagaagagcaaagggcctgacgagtcgaagcgccatgtggttctcccaggcaaaagaaaaatcgtaggagtagaggacaagactgacgaggattacgatcagttggatgggcaaccccctttcacggtgacgattgaccctagcatcctcctatcaaatgaagacaccccttactcacgtagcgatcacaaggaaggaacaacagtgaggagaaagtacgtgcggtcaaccgtcaccgccaatgtattgtcgtaattattgtgtacacgatgtaaactattttagatgtattgaatatccctataaatcaattgttgtatggcatatgttaattatgtatgtttattagatttttcaacaattttaaatcatgcatatgctaattatatatgattattagaatttttaacaagtttaaatcattcatgtggtatttacgtatgttaattagaatttttaacaattttaaatcatgcatatgctatttatatatgattattagaatttttattaattttaaatcatgcatgtggtatttacatatgttaattagaatttttaacaatttaatatcatgcatatgctaattatatatgattattcgaatttttaacaaatttaaatcattcatgtgcttattacgtattatccacttaatttactacagacaacaataatttttcaaaataattgtcattaattttttgactttaaacaattttaatgcattatttactattttagaaacacatatgtaatgaaattcaatattcagtgctattatctgtagtcccggttcttaacactaaccgggtttaaaaagaatttgaaaatagcaggaaaatatctttagtcccggttggtgagaacaaccgggactaaatatatctttactcccgattcgtaa

SEQ ID NO: 74427 - DNA, 6410 bp, Oryza sativa
ccgggactaaagatctaggggcatatatattccccatgcgcgcccttgtcttctccaccaacacttaaaagtttttttccccgatctcggcttctccttcgccgccactgcctagggcatccccgcgccgacgccgccgtcgtatctcgccatcgtctcgcgggcgtcgtcgtcgccgccttcgccgccgccgcatctctagggtgagccgccgccgcctccctctctctcttgacctcgatctctctctctctctccaaaccgccgccgcctcgttgccgacgccgcagccgacgtcgacgcggccgaccccgactccgcctcccgtcgatgccggccccgacctcgatgcagccgccaccgccgacgatgtcacgctggccctgccgacgacgccgacgccactgccacgccgccgtgccacgcccccaggccacgccacgccgccgcaacgcgacgccaccgctgcgacacgccgccgccgcgccgccgccgtgccacgccaatgccgcgccgccacgccgccgctccgctgctgccactgccgccccgtcagtgaacgaaacgtgaacgaacgtacgtgaacgaaacgtgaacttaacgagaacgcgaacgtgaacgaaacgtgaacttaacgtgaacgcgaacattaacgaacgtgaacgaaacgcgaacttgaacaaaatttaatgaaatgcgaacgaacgtgaatgaaacgtgaatgaaacgtgaaagaacgtgaatgaaacatgaacgaaacgttaatgaacgtgaacgaaacgtgaacaaacgtgaatgaaacgcgaacgaacgtgaacgaaacgtgaatgaaacgtgaactaacatgaatgaaatatgaacggtcgcctttacgacactacgtgaaatacaatatatgttactttgcgtttagactaatacatttttttgtatgttgcagaaaagacgtcgtcgtcgtcgtccctcaagccggagtggtagctagccctcgaaggaattcgcgcaggcaagtgatgtaaagatatgattgttagatttttaatataatttaagattattagattattagacttactaaatgtgagtgttagagattattattagagttttagacttagcataggtgagttagcatatatgattatttgagttctaatatacgacacttagacttagcatatatgattgttagaatttataagattattagatttttaatataggactaataatataagactattagatttttaatataagattattagagttttaatacaaggttattagagttttaatataagattattagatttgtaattagacttagcatatatgattatctagggttctaatatacgacacttagatttagcatatatgattgttagagttttaatagaagattagtacaattttaatgattatctagggttctaatatacgacacttagacttagcatatatgattgttaaagaaaatgtgacctatagacttagcaaatatttcttgtatgaacagatggctgatcgcgatgaggaacagatattgtacgatacaatcgcaaagggaaacagccagtactggaacgaagaagaggggaacgaggatccaaatcagtacttgaacgaggaagggaacgtggagagggatgcggagaggaacgaggaggggaatgtggagagggatgcggaggggaacgaggaggaggaggctagtggaagtcaaccctccgctggacagaagagggcacgcggacaatgaggtgccgcgaagaagctacagggtcgacacatcataacggaagtggacgaagacggccgacctagtgccccagcagaagcagccaagaactacgtacgatacagcggttgggttgtgcaggataacgtgcctgttagtacggtgtactggcgcagaacaagggcacgcggagatcatgagagctttgtcccagattcggagaaagagatgctgtggaccacaatgctcgagacattcacccttcccgcgggtacagagaacatagtgaaaaggtggactctaaagaaaatggcagacaatttcagaacttcaagggagatctgtaccagaaatacatcctgaaggggcagacaccaaacttcaacacattcccgaagctaagggatcactgggacgaattcgttgcttacaagacaagtcaacaaggggaggcgatgatggaaagaaacaaagaaaatgccgccaagaagaagtaccatcaccacttggggtcaggcggctatagcgtcacgatgccaaagtgggaggagatggaggcaagcttgcttgagaggggtatcgaaccggccaccgcttaatggccggatcgatcgaagttctgttactatgctcacggtggaacgttcaacccagtggatggctccctggtctttagcgatcagatacgcgagggtgcgagtcgactaacggacgcagtggaagcctcttctcagggcacgttccgacccgacagagagaaggacgagctgtcactcgccctgcagactcccgagcatccaggacgaacacgagggaaaggggtgattccttggaagattggattcaaggaggacatccacacgtacaggagtcagatgaggagcaagagagatatcgaggcgaagattgcagatcttgagtacagggtatcgagctatgagctcagcatgcaagaggaggtggcaaggaaggtggatgaacgcatggccgcacatcggtcccaggatccccagccgtacattcctcctgcaatggtcagcccatcaggcaatcgtagcagctgcgcctcaacggggcaggtaggatcactcagcggacaccatgtgagctgcatattcccttcaagaacttatcaatcaaggtaagctcgtagtttatagattttagacttgtccattccgcaagttgctgcttatatatgttgattactaatagataatctctcaccaaatgaaggtggcgtcgggcatgaccatcccaacggaaccttcagggacttccactgcaggccgattccagcaggatactccaaggtcgaagttgagtttgtggaagccgcgtatgaggacctctagttggactaccctggaggagacggtgagacgcatctacgagacacaagccacgccattatactatggcgcaagtggtacatcatcctccctgggctacaagcggcgtctcgtgcaccatctcctcctcaggctcctgcaccgtctcctcctcatgctctagcaccatctccacctcaggctcctgcaccgactccttctcaggctcctacaccgactcctcctcaagctcctcgtctggtaccttccaaagtcaagggccccccaagctccaccgcctgcccccacaagggcaacgaagaaggcgaaagttgacgccaccaaaaataaggacccagggtacgattgcacgcaagaggagcttgacgcttatgtggcatcagaagtcaggagacaattgaagcctcgaagtccagaaaagaagattcctatagacctgagtgttaggaacttcttcaagagtatgtctgcacctgccaaggaggccataaagctatcggactatgggcgaacacttaagaaagcatattctgcaaagtccaaaccagtccctcagcttggagagcaaccaaaccaggaggtcgagccgttggtgaccggtgaagaaattggaataaaagaatttatttctgacaccgggctaactacggatcaattgctacgaggcgcaccaatcccaaaggcggaagtgaaatacaagtacgaactcggtaaaccgcttgtcaagcctgagcaactgcagtccctatagacacagatgtacaaattccatcaactgtacatggaaatgagcgccaccggtagagagatgatcagagcgaggatcgacgtctctattatgagttgttggattttgtaagtatcgttcagttagatttcttattacgtttccattaattaattaggtccttgtatataagtacaccatatataatatatacttccttttatcgctgtagaatggagattcaaagggcccgacggcggggggttttcgatactggtttcatcgaccctcggaaaataaacatcgcaatgatcgacaagtatccgcaagccacagaggacaatctcgtccatctcctgaaggcgcaacattacaagatgttcatactattgccgtacaacacacaattagtttttactgtcttcctaccaaatttcattcccgtacgtacatgctaagtgtttcatatgtcatgcatccgacgcacattgcagattccacggggtccttttactcttcgacttggaggcctgcgtagtcattgtatatgactcaatggataaaaaagagtctacgtttgaccaggtttttaaacatatagacaggtaatgtcataagttccaatgttatttctaattttgatataattaattgctactacgaatcatagctttaaactccacgtagggcttggtatcggttccgtcatttggtccgcggcaattggaaagaaaaacttaggcggaagtttaaatttcatgtgagtacacatgcattacatttatattgaatctccaattcaaatacaagcatatatttattagatctctcaccgtttgtcatgtatatatagtgcgcaaagcaagaccagggaactaacttgtgcggctactacgtgtgcgagtattgccactgccttgtagaccaaatcatcaccacaagagagctcaatgtacgtacaaataaattcaaaatttcattgcgtacgtatcgatttgttgtttactaattaatttcatatattcataggttatttgcatgagggataacctcacacacaaggaatttatcccggcggttcaagaacaactcatgtgattcatcaacgaacaagtccttgatcccgagggtgaattctactacgatggaaatacaattcatagctcattagcttctgagataacgactactacgtcgaaatcgtagctagctaggacataatgaattgtaattaatacatgtctatttttctatatgtacacatttactttagtgtaaatatatattttggtcatatatatgcacataaaatgttagtgctttaatatatatatatgcatttgcatacatatatgtataaatacatatatattatgcatgtatatgtattgaaacatataatatatatatatatatatacatatatataatatacatatatacttgtataatataatataatatatatatatatatatatatatatatatatatcatgcagcaacagggccatgcaaataaaaaaaaagggcagctcgatctttagtccagaactacagggggttacgaaccgagactaataagggtttctccaccagtgaatcgtgctcgtgaacagtcaacgaccgctcgcccattagctttctcctcctctctgattgcctcgactagactctcacatcgccgccctggagatatgcgtgttgcactgtgttttgctcgcgtgatgtcgattcgggatggcagctgtcacagccctagtgtatttttttctctcaagctatttgatgctttgactttctttctagggtgcatgattttttttctattcatcagtagtgcatgctgcatcaaattgaaccaaaactacactttaatcggtatgttgggaaaactgttaaatgtgcacaaaatttcatagcagtttagagatgttttaatttattcaaacaaattaatcaggtttgaaccctgtaagattcaaacaaatctcagcctgcgatgtattttattattatgtactaaaagtccattaaacttcttcaaaacactctcacgtcgccacttggcgctctaataaattagtgaaagtactcctagtaattctaagcaaaaggcaaaacatcaagccattgatttttatttaaactagtgaacacataattttgcatcgttagattagattaatctccggggcccctctcctaccaaagccctctctaggaacctgcggcacatagctgccacctcctgtacgcccctatttctttttcttttcctttttattggttgttaagatatttaatggcctattttatatagaaacttaaataaattcacacttctctttttttaacgtgaaggatgagatcggactatgcaccgcttgcatccatgcacttggcatgcatttgtggtttatactttttgagttggtccttttaaaaataaataaacagtatttttagtggttacagcttttaaattgtatataaccaatttgtgatcgatttgaaccattcggtatttctttacttaaacgatttcagctgcattgaactatatttcagaatacaagacaaatatt

SEQ ID NO: 74428 - DNA, 11721 bp, Oryza sativa
gaattggatttaaaaaaaggaacaatttcattattttgggaaagtaaaaaaaaaatcacatgtctttcttttttaaaaaaacatgtaaccaccaacaaaatgaattatttactgacaaaataaattacttttagaaaatagaaaacaatcacgtgtctttgttttttaaaaaaacatgtagtcaccaacaaaatgaatcgtgtttacatccagattttttccctcatccacatcaattttttttcattcgttgtatgtttttgttctaatttttttagagtgagatgatacaccacttttttttttctttccattcatcgtacgatttccttctgattttttgagtgaaagcgattatgcaattggagtacagtgagatttatctgatagctagcgaaaaacatttcttgtactattactactcttgcagtatgtaaaaaaaagtgtttatcaatatcaagtacaaaaatataaccatgcattgcaaccgactcataataatacatgacaaaaataaatactttttgggtttcaaactttagtatgtataatacataatttcattttaaagtggtattaatagctttcttataatccatgtgaatggatttagagcaacgaataattatgtcatgttagcgtcttacttgcaccgaaaagattcgatttgactataaggatctcaattaacctggtggcattatgctcccacacgcccattactatttatttttgtcttcacccagtgcaacgcatgggcatttcgctagttttattagaatttttcataattatttgtatcgaatttagaagaaaaagatacacgagagaatattctctcgagtgattaaaaatttaaaatccaccccgagtaaaacgtgctacatgcaagctccgagttcttcatcggagcaaagagtaattgagctccagctaggtgccaccgccggcggcgttgcgcaccgagcagttggtgcggatctccccctgcactcccgtcatcacctggatctgcgacatcttcaccatggagaaggcgaagcggcggaagaactccggctggtcgacggcgaacctgccgacgaggcccctcgtcctgccgtcgctgaacagcacctgatcggaggtcaggagcccctgccggctgagcaggtcgacgtagtacttgttgtcgaaggcgttgggcgtccgtacgtcgatggcggtggtgttggtggtgttcttggccgggcaggagagcctgaggtgggcggcgaaccgcgcgtccatggtggcgtccacctgcgggaagaggcggtcgtcgaaggagatgcagcgggagacgccgagcgtgtgcgcgccggagagcgccacgaggtcggcggcgtcgaggccgatcttggccacggcggcgaggagcgccgtcacgttggagctcggcggcgggaacgcggcgacgacgcgctccctcgccgcgatcgtcgcgccgtcgcgccggcccagggggaccctgtactccggcccgccgaccaggcggacggagtcgcgcgcggcgagggtgaggatgtcagcgcaggagacgacggccccgctgcacgcgtcgtctagcagggcgcggagttgggcgacggccatcaacgccgacgggcggatggtctcgttgggtggagcgtccagctcgctcgcctccgtcgccgtgcgcgccaacagcaccgacgcgtcgcaaccctgcacgcacagcgcagcacaattattagtggcggtttcgcgaataattacccgtcacagatgcgtgtttaaatatagtatcgatcgatctgttcaatccagaattcaaaattcagagcatgtttgaggcgtaatttcatcattttgcacatgcattatgcatgattaggtgtataatcaattaattttaatcaattagttaattgcctggacgaagcagtcatggaagtggagacggatgaggccgggggcgaggccgacgtcgttgcggatggccttcttgaggaagctcctcacgatggtctccgccttgggacagctcctctggtagaaaccgtacgacaagcccttcgccgtcggcgggtaatcgccggcggaggccgccggagcacacagaagcagcaagctgcagcaggaaacgaccaaaacctgcaacgtgctgctcatttttctcgccatctcgatcggcttaattttgtgtcttggagttggggtgaatgagcttgcatgcgagtgtcttcatcaatttataggcgtttgctcgttcgcacctacaaaatcattttcgcatatacaaaatgatgtcaaaatgtcaacgcaatcgactacctacaaaatcatccatttcgcgcagctgtatgaaggttggcaaaaattgctacctgtgttgcgttttgtctcaataatgtgagctagtagcttccatcgattgttctattttatcagttgcgtgtgatcgagcgatcgagttcatcgatcacccaaaccggccggccagtacgtacgatccgatgtactacgtagtacgtacaaacgttgcagatgctacctagctagtcgttagtcgttacgttgcctccttcgcaaacgaatgatcatttgacttgacaagctagctaggcaaggtcaaatttctctctttaggattaatttttcatatatcaacttccatgcatgttgattagtagtccgcacggagttgaggggatcgagaatgattaacgtaccttcaattcagcactacatgaatgtacgtacatatgcaatgtaaacaaattaatcaatctatgggctagctcttaattcttctttggatggaagctagttgctagctacgtcagtgatgaaaacagggcgctgtttgtcacgtatgatcacaaattaaaactttaaatttaaaatacacgtctttttttttatcatatcgattcttgcaatcgtgttgctagttagaaaattttgacgaaagtttcttttccgaattcaaacatgatcagtatactcgatcgatccgtgagtgttcaatacatgcattgtggtctgctacgccatccactgcacttccaccacgtacgggtcccatcacggagcggatgccgtcttactcctcgtgctcagcttctttttcttcttcttcttggcattcgtctgttgcttcctcgtcgtgcaatttgccaccctcccttcgaacaatgttacaggcttcctgtagtagatgatccattattaatatatgatataccattccacgaacattatataagtaaaatttgacttatatataagttccttctaatatatattgacgtgtaatccttttgcacgtttgcgaaaacttaatttgacttatataagttccttctaatatatattgacgtgtaatgcgggtttgcgaaaacttctactaagttataaccaaaaggaacaaatatagttctagatgtatgttttagcaagttttagtttaatttattttttttattgttacaaataagtcaaatttaacttctatattttttatgcgatatatctgttataaaagtaccttgttacaatttgtagtttcattatatattttttaagtcaatatctcttattaatgtatatcaacctttttttgcaattaaaagggtatatctagggatgaaaaaccatcttcttttgaattagatgaaaatggtcaaacgtattcccaacgtcaacgatttcatctatttaaaaacagaggtatagggtattttacttatttgattgattaattgttgctagaaattattttcgcgaacgcgcaaaagaattgcatgtcaatatattagaagaatagagttttgatacacgactcactcagccagaccggcctatgccaagtaaggaagaaaacaaagataaaaaacaaagaaaggaaaggaaaaaaaactcgaaaagctctactccaaacagcggaagggagcagagccactctacgctcccaacaattccccaaagtaagtgacggccgctaacgaccacagccggccctccaaaaggatgacctctaggactactgcgaccgaagagagcacagagtcaaggaccctggagttacgttccctccacagttgccatgagactaggaggaccagggagtcgaagctggcacggagatgatcaggtaaacaagccctagaagatggccaccaatcatgcagccatgtgccatagaggggagagagggcagcccagccaggagacgataacacccgtgttggtagaaattatatttctcctttatttaatttggtatatggttaagcatatatggtacccgatcgatccgtgactgttttacttagagtatgcatgcgtgaccgaattgaacgagataatccgagcctaattcgaacctaattgcaatccgcacaaacaaatagtaccaatcaacaaccacacatacatcgatcgtgatctctagctagtacattagcagagagaggcatatatcagaattaattattatcgaagaacaataaataatgggcgatctagagaaccctaactacgatggttatggcggcgacggcggcggcgacggcgatgacgattactacttcaccgccatggcggagcgggatgtcgggatcgacaacgactacggtctggtggccttcttggcctgcctagctgtcacgacaatcggcgtcggcgtcctcatggtgaagtactaccgctcccaccatggagcccttgccgtcttcctcctcgccctcgccatcttcctcttcctcatggcatccggctgcggcacaaaagccatgctgtataccctccacggcaaccctcctgctcctgatgaacaacgacttctcgtagatgatccattggactgatagatatgtatatatgattcttagtttagatgtcgtctgattatttaagtgatatgcaaataacgaggagatatccccttccctcgaaagatcaagaaatagtttcccctccacagctcgggctaccatggcggcttcgtcttgtgcgtcttggcatgccgctgttgcacaagcctcatccgtcattccatctacaggaaccatccgtcattccattatactgtatgatccatcagcagacaagacgccggcgatctgattaattattgattactacctccgttataaaacattttgattttagttaaagttaaactgctttaactttgattaagtttataaaaaaatagtagcattttcaacccaagacaaatttattataaaaatatattaaattattgatttgatgaaactaatttactattataaatattattgtctataaacttagtcaaatttaaaataatttgactttgatcaaaattacaatgtcttataatctgaaacggaaagtactgtactttactttattttgtttgatatattggtgttaattcggatacttcttcagttgaagtaatctgtgacctggagggtgacaaactatatatagcttgcttgctgccagcaacaatcgacatgtgcttgctatctgctgatgatcgaggatcgatcactgattggtgttgatcattgcctaatcaggatcaagtaatcatcgggatgtttttgtcatgtatgcagcaaacgtatgtctttagagtttcagacactaggttgtttctctctctttctggtatatacgtacatacgtctatttatgcaggtatcttatgaattaattattaatctattatcgttgccgacaaatattgtacgccttaatactcaacgcatgtgtcatgtgtgtctacaggtgcgtgacttctgcctccactccaacctaattaattaaatcttaaatttggcttaaattaattaaaagaagtgatctgcaatatacattgggaaagtggttttatcactcaagggatatcttctcgattcgtgcattccacctaaaataatcataaaaaattttggcaatatatattaatatgaaatatatatcactccgtaaacatttaagtttaaattcaacttctataatgtaacaaaaataacaaatatagctgcgaatatatatataactatgttcaatttaatttgttctttttgttgcaatttgtagaagttgaattcggtcttgtatgtttatggagtgatatatttcataataatctatgttattatatataattttttaaatttttaataactatttagataacatacaaacaataaaagatgtttcctgcaagatgaaaatccacatccatatatattgatcataaaggaggttgtcatgacgtcatgcatttattcgacatggcagtaaccaacatatatccacagtcgtcgtcgtctctttccacattcaacgtacggtacacgtactgacgtacgcgtccatggcgcgcacaattgtgtgtctagagcacgatgctctcggccgcctcgacgacggtctccacggcggcggaccacgggagctcctcgtcggcggaggcggcgccggggttgcggacggagcagtttgcccggatctgtccctgcgagccggtgagcacctggatctggcccatcttgacgacggagaagacgaactggtggaagaacgccgactggtcgacggcgaactcggcgacgagcggcctggtggtggcgttgacgaagaggtcctggtcggaggtgaagaggccctggcggttttgcaggtcgacgtagtacttgttgtcgaaggcgttgggcgtccggatgtcgttgacggtggtgttggccgtgtcgttcttcgggcacgtcagcttgagctggccggcgaaccacttgtccatggtgccgtcctgcttcgggtacagccgcccggtgaaggaggtgcagtgggcgatgccgacggtgtgggcgccggagagcgcgatgaggtcggcggcgtcgaggttgagcttggccagcgcggcgatgagctcggggacgtgggaggtcggcggcgggagcgcgcccagcacctgtgacggcgtcgccgatgtgaggccgtcacggcggccgagcggcaccttgtacgacggcccaccggcctgcacccaattgcaatgttcaacattttggtttttatatttatttttcttgaaaagagggtaaaagctttgcttgtatattgatagagtaggggttacatcaaagaattgggcatcaaagaatgacttacattatgaaacggagggagtatgttctaacattcactgattaatatttatctttgcacagacgtaaacatttctaacgtttaattaaatttgtccagaacaaacatttatgtaatactccgtaccacttttccagtccaactactcctttaagatttattgatttacacgggcacatccgtaaccatgcacaaaccaaacatacacaacaccacgctaataacagtctaatacatactcaaagtccaaagatatggggaccatatcatatctttaatctcattattttttttagaaaacgtatttttaacattattagtaaaatttctagtcatcaaaacaatttcatctaaatcttaatccatgctttgactccttaaaaatgtttatattcgtgaacagagcaagtaaatgatatgtaatgactaattgattaataaataattaattagttaatgaacatcgatggtacactcctagtcagcaaatggtcttattaatatctgttacacgtattagtcgtcctaattatttaagatgtcgatgttctgataattttggccattgggcatgatacagtgattccacacgtggttgagacagcaacacaatttcctgtttccttcatctctatcttgttcttcttgtgccatttctcgcaagccaataaattctacagaagtactgatcgtgacagtccaattatcccgcgttatagtttcctatggctcttcaagggaattgttactcagttacatggcttaattaattagattaatttacgtgcaaattgatctccaaatatctttcactctaaagaaggctagcttaaagggaattgtcttttctaacatgcagaactctgcgtagattcttttccctttgtttttcgatgcgtgcataattaattgttgggtatttaattaattaagagaattttaaagggatgatcattatattgtaagatgttctttggtcatttctgttgattaatttaggaccggacaacgaaagtctcttgtccgctgccagatcgagatatactagaaaattggagaaacaagatgcatggatcatggatggatgaaacacagttcgtgcatcggcagcatcgtgcagtgcgccagtgcccacatcagggttcagactttttgtttccggtatctgtatcgggtgccgatatgatgatattttcgaaatttcggttcaaattttttgaaattttaaaaatatgttattcaaatttaaataaatattaccaaaattcatgaaaaaaattaaaaattaaaaatttagctaaaatagtatggtatcggatggtctaatatgaccaaaatttcattcggaaattttgaatcctaacccacattacttaagttaattttcctatcctctattcatgaactccactttttagatagcagtagtgtttaatccatctcctcttccatgaaaaacttttccagtggcagtaagtaagtgaaaaaaatattaattaatcaattaacttagttagttaccagtttgacggaatcgcgggcggcgagggtgacgatgtcggagcaggagacgacgcggccgcacgccctgtcgagcagggcgcggatgtcgttgacggccttgaacgccgccggccgcagcgactcgttgggtatcgcctgctgctcgccgtcgggcccgccgggcgtcttggtgaggaggatggaggcgtcgcagccctggacgaagcagtcgtggaagtggagccggatcagcgccgcggcgaggccgacgtccttgccgatggcgtcgcgcaggaagctgaacacgatggcctccgcctgcgggcaactcttcttgtagtggtcgaacgatagccccttcgccaccggcgggtacgacggcttcttcgccaccgccgccgccgtcgccgccgccggagcactgcacaccagcaagtatacagatacagctactaccgcagctgctgctgccatggccggactagctgctgcacttctacgagaagccatgtacactactgttcttagcttaatatggtactagaaattattaaggtgccttgatttcaatggagatcgatcgaggtggcttgtggagaacttgcgccagccggtgtcctcatttatagccatcgttgttcggcactgtacagtgagaatgtgagatgatcgatcagtgagtgacactgcaacttgcgcggaaacaaacaagcgggtttaattaagctaccaaagaatatgcccttaatgatgatcaaatgtttatgtaatatttcagtcaccaactctatcgatatactaacaaattaaattaaagtaggacaccacacttccactctcgtagcagttccttttcctacatgtagaaactaccggtgttttattttggacttttcactagctttgctatttattgatttaatcacgttctctgtctctctagttcagtctcttcagttcatccttgtgttgtcactgatgatttttatccatgtcgtctccctgtgaaagcggcacgtatgtggaagtgagcaatcctctttctagcttaattttcttttcctgaaacaccacagaataaaagatccaaagacattggttcggtcacagagctttcaggacaatttctaagtaacttcgcttgcgacagaagagcacggtgctattctatatagggctgtgtttagttggatccaaagttcggattttagttgaaattggagatgatatgactgaaaagttgtgtgtgtatgacaggttgatgtgatggaaaaggactgaagtttgaatccaaactttggatctaaacacagcctagtgagtatatatcacacatggcactatgcatccactgagaaaaaaaaaggtcacactaagcagtcagattccaggattaatcaaagaacagatatccctgagcaattaagcagtcacccattgactaattaaccagtctttggcttggctatagctgtgtagtcaccatctatgtaccttctttttaaccaacttgatagtactgcttttttttttccccagccattattccatccttttcgtcaccggcctcaccttttcttcccacgattagagatagcaccccagcaaattcagcttacctgttactctgagtctctgggaggttggcaaattgcaactttcttgacagtgagattcatgtttagatatcaaagccgccggaaagagagggcccggccggctaaatcatgtgtaaaattaaagtattagcatcccaaccaactcaaattagcctctttttaaactgttctgctgcgactattgtcgacatcttaagataaggtcttaaaaaaagcaaatttaaacactggattgcgtcacgctatgtatatgttaattgctgggcttgcaccgcctcaaattttccttttccccactgtttttgtcagagtgaactttatcattattcactcacaaatttagttggactgcgtaccctataaagatctctatctctactataaatgcgtaagaaaatgaagggttcctgctccttggaaaataatgaaacaatatgggctccgtacgctggggcctttgagtttcagcagttttcaattatcttgacatcatatatgagtttttctcttttttgtttttgaaaaaaaggacatcggatcacatgcgtactcaaccaagagagactagtccgttatcaaaatgtaccacagaactttgcaaattggtttttttcttaaaaaaaagcatatgacaaacatacgttcacaacacgcgcacggtcgtccctataaatatacacacacacaccttacccctatgagcatctctaaaaactgtactagcaaatcttaagattgacgaagtcagcacggatgtttcgttgtcgacgtatacatcggctaccactaaaagaaagctgtaaatgttgagcacgtgtaccaagtttagaacttgatcgaggtgggcggattctactacaagaaactaactagtggagctgtgctcacttcgtaaaatggaaaatattctgattagctgcagagtgtttcattggaaaatctacctaggcgactgaaatctttttcagaaaggagaaacttttgcagaaagagaaaaaaaggaaaagaaaaaaaaagaggcccgtgtagtcaattgaggcccagaacacatggaaggcgaaacagagcccacaatggaggcccatgtggtggcctctatatatcaacccatcacaaagctagggtttttctccccgcctcgctgcttcgcctctcgttccccaaggccccgaagccgccggcgccgccgccctcctccggttcgagctctccgccaccatggtgagtagcgacctccgaaaccgagccacattcgtttgctccgctatgctctacccgttccgttgtctgacgcgatgccgcgctttgttttttttttgtgtcgcagatcatctccaagaagaaccgccgcgagatctgcaagtacctcttccatggtgagattctccccctttcttctcctctatacgccgactctgtacattgtgtatgtgctgatcgtgat

SEQ ID NO: 74429 - DNA, 25483 bp, Oryza sativa
ggaaaaaggggcgatcaattccggtcaaaccggcggatcaactccgatcaaaccgatcgacattgatttgagggtaacttttaattccgctataaatttggtttttggtactataaccattcaccgccttttttttgttggcttagttattgctgtttgatcctacaaacacctggtgacagcttgccctcacaaaatacaagatttcgtgaccaggtgacagaaatttgatgatttgatgactgaatgctgtcaccaaatctctttgtgaccgcctttgggcttttggtgatggtgaggggtagtcgccaaaaaaccattctctggtagtgaacgacgtactatactatacctaccgtttgatgtttcaacgagcacactttgatttttttatgggcgaaccggcgaagtcaaacgtgtgaacatgtgagctagtcatcccagtatatgcatgatcacaaattcaactgctgagcaacctctaccacttggaaggtagaattcaaagtgtgaacaatttcgtcgcatacaacgtccacaccatatacagactacatcaatattgtaggagatgaacaaatttcgtcgcaataaaacgtgggaacatgtgacctagtcacctagaattaatcccagtatatgcatgaccacaactactgagcaacctctatccacttggaaggtagaaggttcagcgttgtactatgctacacttgttatagctagttgccagtagtatattaattattgtatgagttgctgatcgtgtaacttctgtagtacgttacgactgtcatggtgtatatataaagatcgagaggggataattgtatttcaacaaatacaacatacgacccagcgtgcatccaagtatgatcagggtgctgatcctcctcaccctaggcttcctagaagcaattgctgagaaaccagcagcacagcagccgacggaactccaaggctgccccgcccccgatatgtgcggcaacatcaccataccccatcccttcggcatcaaacctggctgctacctcgccggcttcgaggtcatctgcgaccgcacgttcaacccgccgcgagccttcctcgcaggcgacccgccattgttcggcgacaagttgccgccgaacgttaatagcagtaaaccattcacggtgacggccaatttctactactctggcacagatgcaggcatgcccagcgaaatggtcaactacacccgagggcctctcgagctcctcgacatctcggttaatcagagcaagctacgtgtttatgcagccatcaactccgactgcagcacgaatgaaacacaccatatcctatttgagcagtcaatcaagcttcagccgtcaggtccattcaccctgtcggcaaatgataattccctagttggcgtcggccaaaacgtcatcgcgatgttcgcggattcatacgccggagaagaatactcgacgatttgcctgtctttcctcagttcagtgtccaaggcgaggaatggaccgtgcgagaatgccacggggcttggctgctgccagcagacactgcctcctggcgtcaacacgactcttgtgagattccagcacaggaacaacagcaagtggagaacctatccatgctcatatgccatgctggtggagaagtcatggtacaatttctctacagaagatctgtttgagtaccctgcttttcccaacaagtaccccaggggtgtactaccggacaagtatcctacgggtgtaccccttgtgcttgactttgctatcaggaatgggtcctgcccacaggaaaatcgtggcccacctggaaaagactatgcttgtgtcagcggcaacagctcttgcctcgatgcaggaaagggccgaggatataaatgcgagtgcaaagagggctacaatggtaatccttatatgcctaatggatgccaaggtatgcatacgacactacttctctctccatcttacaatagctattgttttaggttatttagcacagagtagtatttgattaaaaaatgactaatacctcttattagatgatgtatggttataactgggtaagtggttaaggctagaacttgaagagatttaaatgagaggtgattgatgggttaagtaatacactattatgataattatcttaggataaattttaaatccatataattattttgggaaggagacagtagtaaacatgacagctagctcatcacatgcacagttaattttaaataattttgctatctatttatcgacataaattcagaaataatttagcggatttttgaccgctaattagattttcttcaagattcatgcaacaggcactcctactgaaccccctacaggtgacggctcataggtgtcggttcaattggaactagcttgcacaaaaaaccatcacctatagtttagttgttggttcttaacctaaaaccggcacatatagttaggaatagctgtcagttatttaggcacctatacggaggaaagtataggtactgattccagctccaaaatcagacctataatatattataggtattaggtttttctaagaaatgggtaaccatacaaaaccatccaagctgaataaccgatacccatccatcattatattccacaccaccgcacgccacaccgtatccatccatcctcatccccacaccacacaggctccttgcctccatcgcatgcttctcgcccacctgcgtgcttcccccatccacctccccgtctgctagctagtctacctcctcatcgatccccctcccctgatgcgttggtctacgcaggccgctgtggccacacagcggtctacctcctgtggccgctgctagccacggcgacggtggtagctgggtagcccttccgcatgaagcagcggtgtgatgaggagcagtgcctcaaggtggcgcgcgggcatgtgaagtgcttcgatgaggacccgcgtcaccgtctacgatgtctccgagctcgatgtttgcacctgtcctcgtcctccccttccggtcaccatgctcccctctaccaccatctcattggcgcccacgcagaggactgaggcaaaatgggagcacgagatggagatggaggcagtggtggtggctagaagcgacgcgtagggccaacagcagcactgctgttggtggcagtatggctgtgggccgtctccttcctcgatctcgctccccttgtgcccccgcccctgctctatctgcgttcacggtcacgttcttcgagatcactaggagggctgccatgtcggggcgggaagcggtcgtcctcgaaagaggcacagtgatgagttgtgcaagaacgctggcgtcatcatcccgtgacaactctgtcggtggtccaggtacgccgactgctctgcgcgtctcgactcactctcccccctcctctctgtcctccccctcctctgggcagcggtagcgtcttcctactagagctccacctgacagcagtggcacctcccctagcccatatttttttataattctgaagattattggtgttggttatatatattgaactgccacatggaatctctataggtgctggttctacaaacgacacctatgcggttgggtaaaggtgccggcaaagtgatgccggctgggaaaccgacacctatagtaaggggagcccgattacaagcgaattatacaatagttaaatgcgagttaattataatgaagtacacttataattatactgtatttgtattgagagacaatttgtggataaatggatggatggctcttttcagcctccggactatgggcatttggcctaactgtttgtatagagtatagatatatagtccctagtttaatacgaagagtacatagcttataacttaaacaatctcgatcataaatatatatatgattggaactaatcctaccataccataacaactggattagtaacgttggatgctcacatgctataacaaataacgacggtcctttgtaccgtaacatattctcttctatgtacacaagctttctatgcacactggtgcacatcaactagcaaatgttacgaaaaattctaaaacaaattaaacatttattcttaatatattatacatatatgcaaagtcttgtattcaaatttattataatttagccgtaacaaaaaaagtgaaaaatctgacagttttgagggtaaaaataatctgccagaattttatctttttaaggctaaaatataatgaatttgaagatgagaattcacacgtaggtgtagaactattagaaatatgtgtccaatttttttagaattttctgtgacatttgctagttggtgtacactttatatacacgggaagcatacgtgcatacgatatgttcccaatgaagtaggaggagtaccaaactctacacgttaatgtttttgatgtttttgaactatcatgtatgggcttaggctgagttctaaattctaaacgttaattggcaactttcttgttttccattaccacattttccacataaaagttttattagaaaattcgaataaattagttaatttatgatacgctaattagccaagccattgtacgtgccgctaataagctcaaccaaatctcagtatacaactacacaaaaactcattggtaccggttccaaagaccttataggtgccggttttgggcccagcaccaattggtcgacacatattcctaaaattataggtgccggtaaatcactaataaccggcacctatgagacatatgcgaaacaaaaaaatgcccgccggccgccacctcgctttccaccaccctagcaatcaccagaatatgagaaaacaaagtcaaaatcaaaccaaaaggggatgaagaggaagaggaggagaaggagaagcgggaaaggaaatgtaccgccttcctcaccaccgacggccatactggctgctgtctttgttgacagcgaccaaaccgtcgacctcgtccacccctccctcggagtccgcaaactgcacgctgttgtcgccgaccgggtgagccttgtaccacagcagatcttggcctcgctcgcgcgcccccgccgcgcgcgccgcgtcccccacaacgaggggactgacctcaccgccaccatcgcgcgcgagggcttcgacagctacgtcctcgccgtcctccgccgctcccaccgcgagtgccgcggtggccgctcccgccccgggaagaaggcggtggctgcgacagcgggggaccgagcccggcatcctgaagcgcctccccccgatggatctggcctccctggcctcgaccccctcgcaggcggcggtgcgagctagataagtgaacgtgagtggacacgagggatggataaggttgaggcgtgacgaggagataaggctgaggatgcgaggtggcaacgtgcgctgtgcggctcggctccggccagtttttttataggtgccttttttcgaaggaaccgacaactatggctactattataaaaattaaaattaaagatgtttttctgatactttgttatgtcattcttatttgagtcggtttttaagtttattcaatttcggaaatacagatgcatgtttgagtcaatttttaagttcgttcgttttacgaaatacataaggagttgtataagaaatctctttaaaaatactcgcatgctaatttgagttgatcggactcctaattgcagctcttgattttgtaaacaaaaatatacaagcgaattccagcaatcaatttcacctaagctaaactgtagcacagtaataacattaaaatagccttcacccgttgcaatgcacgaatatttttttctagtatataaaaaaaccaacatctataatattagtaccttttttcactagaaccgacacttataatgtaagtataggtgctggttcttttaaaaaatcagtacctctactatttgtacctatagttcttaaagatgccggttcttatttttttcatcgtgcggaggtagaaatatgccgataggtgtcggttttaaatgaaccggcacctataagactggtgcctacgagggttttgtagtagtggtatcgaatggggtagtgacaatagcctagcctacattaaacaatatattcgaaaaccaaagaacttattatccggttaatattccttttaaaaatataaattatcctatggataactcagtgtatattaacacgtataattcttactttgcagatatagatgagtgcgctcttccgggtattatgagcaattgctcctttaatagcgtatgcgtaaacagaccaggaggctttgattgtccatgcaaacgaggaatgacgggcgacggcaaaagaggaacatgcaccgagaatttcccaccagcagcaaaagccgctgtcggtaagctagtcggcacgcatttaaatttggatttaactaataataagtcatcaacttgttctttcataggctagagtgttgcataatatttgtttgctctaataattcacaaaaaaagttgataccaaattcggaagatgattgttgtcagtctttttctacatttcaatcttgaatttcataagttaaaatgttccccaagacctagtcatcttaaaacaagctaccggtgtttcaggaatatacaagtgtcaactccttctgcaaacatgttggaatttctcctcataatatcatttatgtcctttgttatgaaatttaaaatcttacagagaaacataatatataagtcataattttatcctcatgtggattctgaaaaaaagttcaatctagctagagatattcattttgcttttatcttgcatatatagtattattgacgacttgactggtatgttaattaaggattgctgaactgtcaaataaaattgtttaattactaatgctgacctattttccaatctcacgtgcaggcctttcttccttcattgttttcatcgtcctaatttttatggtgaaacaacacctaaaacttaagaagttctacgaacaaaatggtggtccggtattgaaaggtgtgagaaatataaagatctacacaaagaaagaactgaaacaaataacgagtaactatagcagcgacattggagaaggagcctctggtaaagtttatatggggactcttaagggcggacaacaagtggctataaagaagtccaaaaaagttgatgaagaaagaaaaagtgaattcactcaagaggtcatactccaatctgaaatgaagcacaagaatataatccagctctttggttgttgccttgaagttgatgttcctatgttagtgtatgagtttaccgtgaaaggaagtttacatgatgtcctcttcaaatgtgatgagaatatgaaagggaatttacatgacgttctacccaaatacaatgataacaagaaagggaaagggaaagggaaagggaaagtacacgacgcactcgttgaatgtgatggtaacaaaaatgtgagtttgcatgatgtcctcttcaaatgcggggataaaattgcaatagatacacttctggagatcgctattggatcagctgaaggactaacttatatgcatacagcacgggagactcccatccgtcatggtgatctcaaatctggtaatatacttatagacaataatttcgtccctaaaatttcagactttggaacatcaagatcactggttgcaggtcataaatttaggcctgataaattcattcctgcggacatgaattatatagatccagtatatatggaagatggaatgctcacggagaaaagtgacatctatagctttggaattgttcttattgaacttgttacaaggaagcccgcaaaatatgatgacgacaggagctatgttcgaaacttcattcaggcctaccttgataaaagagaaagggaaaaatgccataaagagattacaccagatgtggaaattaatattcttgaaatggttagtgaagttgctgtggcatgtttagaacctgtccaggataaacgccctgatatgatagaagtagaacggcagctccatcgaattagacacattgcaggccaaaggatagaggaaaaaaaagaggaatttcaacgtgcattccctagaacgggatcggttatctcaaacgggtttaaagcctcgtctctttcaggtagggtccctgtcactaagcaaaggtcactaatgtgagaacatatctcaatcaggcacaaggccgtcacggatgaaagtcatctcaatcaagccaacaacaaagcccgtcacagataagattgaccaagcaacccgagtcaaaccaggcaaggaaagagcccgtcacggatgaccaatcttaatcgggcacactactaagcccgtcacggatgactagtcatctcaatcgggcattaagggaaaggccgtcaccgacaggttgacccacttgttgagtcaaaatagtcacgggccggaggaattatctctatcgggcttatagtaatagcccatcacagatgactatatctctatcggtctttgttggagcctatcacagatggctctatctcttttgggcctagttgaaatgcccatcagagatgagtatatcagcaaaaaaaataaaatttgttttttttgctagactcaggcttttgctagtcatgcctgctgcaaaaatgatagaagcaatatgtatagtcccattcccagcatccattcacatattccatcacaacattgacatattccataacaccattcacatattcacatatttgcatcccattcacaaaatcaaacatatgcacattcacatccacaaacccattcacatatatatgtcattcacatcctatgtgctctacaaaccgccgatatgcatcaaaacctgcaaaaccgagttataaatttgaataagtttatatgtaattttaaatgcaaaaatttacataacatcgtggcaaattgtattagaaagaatatttacataaatccaatgttagtcgcaagcattgtaaatgttcaaccattcagagacgagctagctagaccttaactttaaatattccttgggctgacaagatatcatctagtatgaatcgtgctatttcctctctaatgatatcgatgttgttttccgggatccttgaaagtttttcctgcatgtaaggcgccaagttagtatatatacttggaaagttgtcgtcctatgtctatagtaatcaattgaagcacacacctcaaggtcgagcaatgtcaccttgtctgcgaagctcctcatgttatggctgtaacaccccaggtaaccatgtacctagagtgccacaccaaaataaactcaaaccactaactcccaaaattattagaaatttcggcagaatcttccctgtaaatacgaacatcaacgacaggcaattataagttaaactaataacaatatccttcccacaatacgatccatccttataatccatggggaagaaactattagaaatctaaaacattattacaagaccgaacgatgatatagtttaagtatcattatggacctaggcaatatagtttgatattgtgcagataaatgtgtatataagggtgctacttcccgcccatgcatgtcggtctcaatatgtacctaaaaccaaataaaacacaagagtgagtttaaaaatactcagcaaagtacaatatggaactagaaaacacatatacacatcattggcaataaagcatgaacacaaggctttctttctttgataggaaacacattttcaaacaccaagtcaaagaagatagtagttcccatcccgggcaggcatgaattgaaatagtagtttccatcccgaacaatagtgaatacatcctagcattgccggcaaatccgagtaagcgtgatcagcgcttacccatagaaacttgaataaagatccaaattgcactcccatgactacgcatggtacttgaataattgaaaccggaatcaaagaaccaaactgaaaccatattgcacaattatttaaccagatccaaaatacggaatattgaaataagaataacatcgtaaacataagatgaactcaaaatgtaaatagcgtgaacaataatctgaacataagtagtcacgtataacatagaaatatgtcggaaataaatagatagagtaaataatccatgaatcacacaattagttcgtcatacacttgcctccaacgaagaatcagtatcatgcacgatctgatgggccaccacctaatcataaacaaaacctcagcaaacacattcaaacatgtgtataaaacaatgaaaaaagtgaacctactgccccatcccatcaaaacgcaataacaaggaacgccgcttggactatacacaagactgctgcttcaaacctttatatcttgaaatatgaaaagtctatgattgaaaatatatacattttgaaattctacagaacagtaactacaactttgatgtagaaagcatatttttattctacaatttatatggtctaatttgcgcttgaaagtacgcatcagaatctgtctagaatttcagactgtccacactaaaacaaccataactggagttctactcgcccaatcagggtgtactttaccaatatggaaagctaagaaaaacctctacaactttgtctataggcggcctggctgatttcactgtttatcccctccaaaaacagtttaatctactactatccagattatgacacaaaaacaacagtcatactaaaaaaaattatatctcctaaaccacttgatataaaatctcgccctttggtcagaagatagatccaaacattatctacaacttttatatggacactttgatcagaataaatcattttgaccatgaaattaatggaaaacagaggcgctataaatctgcccacgcccagaactaccaatccgaatcacaacgtccaaaacgcttctctaaccctcctcaaccacgaattaaaccactagaaccaccctagaacaactcatacaataaggggataagcctcaccttgggttcctttagagaacttgtgaggagacaataggggagactccggtgtaacccctccttgtactcctctcctcctccttgttccgtttttccactttacttcttgatccaagctatgaagatggagatctagggagagcaatttgctctagagggggagagatgcaaacacaggaggagaggaggaaggaggcgccggccagggagaggggtggcggcaccacgaggggaggtgggatttgattcccctctctctaggttttaagggagaactaatgggctaggtttgtgggccttctcatgttggcccacttctaaagatatttttcttttatttatttttgttaacatctttattttaacaagtcaacccaaactaaaaaaacctaaatatttttttaatatacggggtattacattgctccccccttcaatcgaattcgcccactgtagagcttgagaaaccgtaagaaggaaaggaatacacaaaacatacatataaagtagttagtactctcaagcaatttcgaggaaatctcctatattcgcaacactgcttgcttctaggtatggtagataataattaactagcataagaaagtatggtagccaacaattcaaaaacagctaataaaccaactcagacctactagacaggaatattggcttgccaaacaagcgcaatgcacatactaaaacacccaattgggagatattcaaaaatcattggaacacatcgtgaagaatcttactacaaagcaatggaacaatttgtgaaaacaacctttacgctcaagggaatcgggaatacaacataagctttaacttaaaatttaaagaaataaacactcacacccatcacatcttattagtatgttgctccccttcaacaactaaaagtctatctttgattgccaattatttagaggtaataaacaatatctaagaagtcagtctcaaggaccataggccacacctgttccacctagaggtaactagaacaaaagcattatcctcaaaaactgctctgaacatcagtagatcttgaattttctaagaaactcaaacattccaaagtaaatgaattaaatccactcaataaaaaacaatttgttgggtgcgtttaattgaaaagaaataatcgaatatgaaaggtcaagcaacaaaacaaacaacataaaaaaatgaatatttagtctcaaacgcggttttcttaagaaatctgagatcaggataatgactacctataataatttcaagaatcacacgtaaagacaatggaaatatttagaacatggaccgagtataaaaccactttttgaagaaaatgcgtagaaggaagcatcctcttcaacttgattttttttaaaaaaaaacgaaaaggaaattttttttaccataaactcatgaactgaaaatcaaagttttgaagtttgtttgtcacctcaaactgcgaatccggacgctattctattaaaaaattcaaataaagattaataatcaaataagtgtgaacttcaatccaagaatatcaatactgcacacagttgtgagccatgtaatgaaaataaatcacttggtaaagaaattcagatttaatacaagttctccataacaagatttaaattagtattttcaaatagtattgtgcatatcaataatttataatttatcagcacaaaacaatcagacaacacttatgtttgaataaccaagcgaatgaaagcaacaaaagtgaaactaaaataaatatttagtgttaattcctttctgaaagtaaaaaacaaaattagaaatcaggagaatatttgtcaccaagtgatgattgcaaagtcaaatgttttccttttggaagtatttcagaacgtgtaccacgaatgagaaattttttttttcatttcctcaaccatagtcacataacagaattcacaaaaaagaaactaataagccatatcacccttgaatctcaagtctgaaaaatagtacatcctcttttttttcttaccttttttctttgcttttcgggtgaagacatcactaccttgatgcgtcaggcataacacatagacacatcacaccagtgtaagaaaagaatagaatgagtagatgtcatgggggccaatccatcccgtacccaaactattaactcggtacagtgatagatgtatcacgacctaacactcacactcggacaacctcacttggcattgggaaaaaaaataaagagtaaaagttccctcctctaaccactttgcattgcctatatggaagaaaatttacctattcttaaaggatcattaagtcttatagcatacaacattaattacttctataaaagagattaacacaagttagatgcagaacattaattacacaatacggatagtccggtgaagttcgtgcagaatttcctggagaaggaaataaagatgcccaggaaccgttattggaaggcgccggtcaaatcaagcacaccggccaagaagctagagcagtcggctgcgaggaagccgtcctccgcaccaaaaccaaagaaggtgtggaacgaaaagccaaagacgctcgctgcatcacctccggagatgagtagaaattcgcgaactaaactggaaggaggtacggtcttgcacatcggacctaaaatgacgcgaccttcgccaacaggtaaattggtatgtatcctcgtatttgtttttcagcaatttaaatttttgcatcaacacatgtttgaatttcaaaattgcatttaggtttgaggaaattcttcaaatgaatttttcagagcaaattgcccaccaggtgtatacttaaatcaagtgattgagatagatcggtctccatgccgagacaatataaatcacttagattgtaatatatattaataacataactatatatgtttatagcatagccgatcaaatatatctagcatgtatcggctagtactccgatacgactctatgttaagatgttaaaacaagcagaatataccaaacagaagcttaattgtcacgcccggaatttctatccaaaattccaaacgcttacatgtgtgtaaaccctcgtccaggaatcagccgaggcacacaataacaaattgataatagagtacaattattactctaattattaagcgtataaaatgtcattacagaggtagatagttcctctcaatcaataaagatctaagcagcggaaaaaaaaaataaacagcgcagacggctccactccacaggcagcttgaccaaggctacacctaatcctccacaccatcagcttcaccgtagaactcttcttctgatgaacgattgcaaggtgagtatatgacatactcagcaagccacgcagcaaatatgcaaatgcacaggataacaaaggaaggcataatagggtttcatttgcaaaaagcagcatttagcaaacatttgagaatttaaaatagttaagtattaattaagcaatattaagccaacgctatacaacataccctgttgcataggcccaaccattctgaacaaccatcccggctgtacagttctatctccaaaccaggaatattccattccaaaccaggagctaaccaaattattaccagttatagcattatttactatggtgagaagggtgagactaatcacgaaagacattgttagacccgcccataaccgcgggcacggctattcgaatagttttactctgatcagaggtgtaccactgtacccacaagacacaaccccacatcatgtcgccatgtgcctcaatatcaccacgatacctcggaaaggagttgtgacaatacccctcgcataacacaatccactgcagtgcaccttcctggatcataatcacccccttataaacaaggcatggactccccagcgacccccgtgggcttatctccgccacttctcagtctggtgctccgcaatgaaccatactacacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactaacattaagccatcatgaaataatagtgaatcattagttatcccaatagtgagctaatgtttctaagcagggctaagcaattatatctactatctagttgaaccagtataaataaagctcaaccagtcaaattataataacccaaggtatcaaagaataaggtaaacaagaaaaaggggctataacaaagaataggttatttccacccaatgacattcgaaaataaatgcagaagttgaatgaaaacaatagctttaaataggatcaacatgctcaaagggttgtttgggatctatgtgacttgccttgttggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcgggttaaaacacttaaatcggttaaaattgaattatgacgcaatattgaattatttttgaaaaggaaaagagggtttattgcgtcagcggctagggtttgggtggaccgggcgcacgggcggtggttcacgcgaacggacggccgagattgatccaatccaaatcggacggccgagattgattgggtccacggcggttcacggcggacggacccgatgacgccagcgatgacgtcaccgacggcggcagcggctcggcgggcggggacggctcgggcggcacacgcttgccggcgaacggcggcgcgaggacgcacacggagggcaccaatgggtagcggacggcacgacgaactcaccgatgaccacaacggcggcggagaagcaacggacggcgccggcgacgaggaggaaacggcggggctcttcgggttgacgacggcgacgatgctccagtggtctccgacggcggcgaaggggcggacgaggacggcgacgcgacggcgaacacgacggcggccttcccgagcgacggcgacggctggaacgacggcggcgcacggctggagcggcggcggcggcagcgaagctagggcgcatggcgctaggacgactccggcgacgagaggcgaagacgagggtggcgacggaaagagaagagcacggggatccttttaaaggggctcggaggcgacggcggaggcccacggcgacggcaacggcgaaggaaactcgcggcttggagaggaagaaaaccgatccgaatcgaactcgattccaaagctttccaaagcgattcaaccgacgattccaaagggaaaaaggtagaggagatcccggagagtatttcccctcaaccaattcggccggagaaggaaagggacggccggatttggaagggaaacggcggcggcgcgggctagggttttcggcggcggcggccgaaggaggacgaaggagaggagagagagaaggttttgggccgactttcggcccaaagccaaaagaagacttttttaaaatctttttcaatttaaattatttcttaaatgcaattccatttattaaaagtacttccttagctcaaataaatcccagaaaaatctaggaagtatagaattaagcaaagtatttaatgaaattttatctggccacttttatattggaatttatttattaaaatttgattttcttttcaagcctttttaaaataaattctagaaattccatttaaacaacaatttatatttttttgaatttttagggtgtgacattaatatacttagatgcaataatatcttgatataaagggcagatctaacatatcaatgaagcatgtagagcaaatatagttaaatcagagaagatcggctgaaactccgatgctaccctaatcggtaatgagaaggcatgctagagattgatattctaagcacgacttaatagatcaaactcaactgatgcagcattaagtatgaaaagaagaacaatatctagacaatcaagccgctggaagtttcatagagtggtagatatcttatataatctgaaccaacgtcgatatttaacctaatcggctgccctctatcaccagatgttagccgattgtaggttagatggcgatattgttagagattatgtaagatatatgataactcgacgaattacgtaaacaagattagagtatcataaagatggaagcattaatcccgagaacacaagccgtcataacaagttttacctcttgttgaagatcgaaaccgatgcagctcaacctgaaagcaagaactcgtcgaaataaaactaaagcaaaagggtgacgatgcgctgaaattgtattgaacgtgtgtgttaataattacatagggctcgggttctatttatacccgagaattacaagatatgtccataccggacacgactattatctctaataaactctaagatatcataagtctttgcggcagacttttgcccatatttatctctaaggaatttacataaaatatcctaattaatagatacaattgccttcccatgactctatccatgtatggcaatcatcttgaagcacgtcaactcaaacccgatgtcggatacaagtcgtattgtcagaatcagctgtatcacttaacccagtcctactcggacccagccgatcctaatcgtagccgatttggattccagtcgattcttgctctgttctcgaatcgatctccgccttcgactccacttcgatctaattctcttttccgatgctgatattaccaaatttggtcgttaacacaaaccaaaacaaaattttcaacgaaaattcattgtgccacgaccacactgaccgttggaatccaacggccgaaagtggggccggttgggcccaccaggggttcgcccgaactagccatataacagctacctgccacttttggcaggtaacagctagtgggtcccacatgtcatttctgaccgttgtgggtaccctattaaagccagacgaccgagagagggaattcaaccccatttcaacacattttcattccctccccgaagtttgctctcaagttcattcaagcttggatagttttccctcaaattcaaacacttagctgcatatatacaagttgctttggtgaaactaaccggcgggtgaaacttgtgctatttctaacccccgccgagatagtccgttctagctccattgtgcagaatgaggaggcaactgccttgtctgttcaagcagtccggctcttcatcaagtcatcatgacgagtctagtactggttcattagctgatgtctcaatggatgatgtcgacgctccgcgacgtctcctgaacgacgccgacctcgaccttgtcgatgatcgggaaagacaagcctactacatgctgagtgaccgagagtatgctcacacgcgagaatactctccggagctgttgaaaaggataggtatgtgtcgacgggggatacccgtagaccggatatagagggtattggggtacgctggtataaggatctacgtagtacgacatcgagcaatcaaaagacaagaattatactggttcaggccccttgataggtaatagccctaatccaattgatatgggattatatagtggaaaacacagattacaaaggaaaagacggaactcaagggatttggcgagattgtagtcgagatgattcgactttctctcgtcgacttggctccttgcaggctctgacttcgtaggctgtgtgggttgtgttggctctgagattcgatgatctatgcccttcccggggggtcccttttataccgcaggttgggtgctctccgagtaggactcgaacataccagacttggtacgatacgtgggtaacccaattcttttccaagaaggtctctcctcgtccattgacttcacgaagagtttccttagatgtcaaaggaactatccgtgtacgcgtggatatgctatgtcgatacgtgatgtatatcgaggggtagagggtatgcctgacccgtaaccctgacagtagcccccgacttctgttcaaaaatgaactcgtgcgaccatttgcaacttcaggtgtcgagaacgttgtcattccaggtgcgagaaccacggagatgacgtgtagtcgagcataccgatacgtgatgtatatcgaggggtagagggtatgcctgacccgtaaccctgacagtagcccccgacttctgttcaaaaatgaactcgtgcgaccatttgcaacttcaggtgtcgagaacgttgtcattccaggtgcgagaaccacggagatgacgtgtagtcgagcataccgtttgaatcccaacggtcacgagtgaattttgaactgaagaccaaaaaccaccttgcgcaacggacctagaaatttccggcggggatttctcttaattccttggaattcgcaccgtcgggagtgcgcttatttaatgggattttgggtgcgcgttttgaagtccgcctacttcgttaagcaaacactgctcattaacgctcctcgccttcttcgccaccgcaaagaaccctatcttcgccaatcttcgtccatctccggtgatcctccggcggcgatggatcttggcaagtcgacttccaccagcgcgaccctgaagaagctccaagaggagggcgcccttcctggccgcgaaaaggcggagagggaagcagcaggtactaatccacagcccctcttaggtcgcatggttgcgatcgaatattatgttgtctgcgggtttcttcctcccccttctgaattcctcctgctagtcttgaatttctaagggctttcacttttgcatttgaaccccaactccattgctttccttagcgtctttgtgcatttttgtgaggcctacattggggtagaaccttttcttgatctgttccgtttttactacgaattgcgctggatggaacccaatagggtgtctggttgcgtcgggttccgacctcgtgatggaatgaagtcgcgctatgtccccctccagtgtccctcttctcgcagtaaatggcggaacaggtggttttatcttgaaatcaaggattcgaatccggtcctcgttgttcctgaggagcaaccggacaagattccgatttggaccgccaagccccctttgaccccctctctccaatcgtttatcgacatcatcgatgatctccgagaacagggcttatcgggatatgaagtcgttgcagacttcgtcagtaggcgaatccagccgctccaggcacaggcccacccggcatataactattccgggccagatgaagcgacccgggtttctccttggggtagccttcttgcattcattttgatatgcctgtactcgcgttacttttcgacttatcaaaaattaattctttcttgacaggtctgagtagcgacggcgtggagcggcgcgttggtcaagtgatgatcagcggcccgacaaccgtgtcacatcctgattttcgtttcaggatttataaattatttaataaattattattagaatttatattaaatgttcattaatttacaagagaagttaaatgtgggaaataaaatttcctaaatataaagcatggatggatttaatttttattaaattctctatggttaattatactctctggaattttctcggatttttcggagctcaattcctaattttaatcatacaaagaacattttagtaattatccacatattaaattaatcattaaatggtctgattataattttgttaagtactttgagtgtccaagtattttcaggatttttcttgaaattatttgagcattggaagtatttttaacaattcaaagatcattttagtgattattttaattgaaaaagtttttaaatccctccctaaagtcgttcggccgaatccggcccaacactcctctctctcccgtgcggccgagccggcccagccacagccgcccgccccctcctcctctagccaccgacaggtgggccccacctgtcggaggcatcttcctcctccagccatccggccgagccggccgaccgagcccgagtcggccgtttgccgcaccgtttcctccacaatctctccctttttgttccgattgtttgagggattttgatccccacatcttcctctatgtgtaccccaaaaatcggagcaaattgttgggtattttatccgaatcgaactcattttcgaatttatctccaaaaccgagtttttgatttcccagatcgatttcttgcgggaggagtccgatctcttcaatccaaggctataaataggaccccctagtcctgctctttcgtttgccccttttcccgagctctctagtgccccggagctccggcgccaccgccggccgagccgccgccgccgtccacctcgtcgtcggccaccgtcgttcgtcgtttggctcgagggtgagtaccgttgggttcgtctcgtcgtcctctacgtgtacatgtcctccaaagtcgcagccgaccatccaatctccggcgaggtcgccatcttggtccggccattatgatgtcatcatgatgtcatcatctcctctttttcagtttttctttaatagattaaatagattaaaacttcggaaattcataactaaataaccgtagatccgattcgagtggttcaagttgctaaatttttctaaaatcaagatctacatgttaaaaatatccacatgtactgtttatgcttgtttttgtactgtttttttgatttttgtttaattgctttagtttccgatgttccggaggagagtgtttctgttgaggaagattccgaagcgtttgcggaagctcaaggcaagtcacacagatcccaaacaaccctttgagcatgttgaacccgtttaaagctattattttatttcaacttatgcattattttttaatgtcatcgggtggtgaaccttttcccgaataattaatggccgaagatgaccttattttcctatgggttataatttgattagcatgaaccttatatattggattggttcagctaaatgttatatgtattttgcttagccatgcttagaaacataagctaactaaaggggttaaatataaattatattatattattcttattaattatggttatatttaatggtagctcacgatggttaatcgtgtgatgttaatcaattgataattaaaacctggttaaggtgggttgtgagcatatggttttgattgttgtgctcatgacaattaaggactggttcgcgagctactgttgtgaaacatttaccgtaccaaccacaagccagcgtgggcaacggctttaccttttgtatagcatgattcattatggtgtgccagactgtgaagcggcgagaagttcgtgggggtcgctggggagtccattgcctctggttttgagggggagattatgatgcaggaacggtgcactgtggtgagttgtgttgtgcagagggtattgtcatagcctctattcgggtactttccagtatcgcgacgcatggtagacatgatgttgatgctgtgtcttgtgggtacagtggtacacctctggccagagtaaaactattcgaatagccgtgcccgcagttatgggcgagttgagcaatgtttttcgtgattagtctcacactactcattaatgttaataatgtgataattaatttgactcctggtttggaatggataattcctggtttggaggttagatctgtacgaccggggttggttgttcaggtttggttgggcctgagcagcatgggcgtgctgtttagtgttgattaaaattgatgattaattactctactgttttacttctcttaaatgtttgctaaatgctgcctttgcaaatgagcctatattatgccatcctttggtatccttgtgcacttgcatatttgttgtgtggcttgttgagtatgtcatatgctcattcttacaataatcatcaaacctcagttgaagaaaaaggatccagaaggagaagacgtttggcttataccccagttgagctgcctgtgggagtggagctgaagccatcgttagatcgttatttcgctgctgtttttcttttcttttgtaagtatgtaacgttattattaagatggatttgtatattaaattgtcagtttgtgtacctcagctgattcttggacgagggttttatgcacaaataagttcggaaattactagtgaatttccgggcgtgacaaaccgcaagcgacattcccgcgcccctttgtgaaaggggagcggcagaatgtgacgaagccatcaatgtgagttcatttaataagcgtccgccttccttactcaaaatcggcttatgacgtgatttagcgtaggcccttcccttgactgatgtcatcggtccgctcgcggatcatcaggtggcgacgtctctgaaggagaaggtcgtccaggaggcgtccgacgctgccaccactagtggtggcaaaactccgactaaggcgaggaaattcttgtctgtactcggaaatcgccgcaaggcggaaactcccttggtaatttcctccttgtcgttaggttgtgcagcgaggagaatttgttctcactctatatcggttgtcttgtaggcttccgacgtatttcccccgcctgctcgacgtcaacgtattgtgacggtcggcgagaagtaagtgaaggatttctagactcttatgtcttctgttcgagcggagttttgactcatggcggttaacagggaggcgaagtcgaaggctgctcgcggcaagtccgggggaacgtctagcgcgtccgctgtcacggcgtcaacggatgttgtgcccgtggtcgggagtcgggaggcgacgccaagcggctccgtgggcgatcccgtcggcggccgtggtctgtcagaggccgtcctcacctgggaggagctccatgtcgagatggggcgtcttctcgaggccggtgctcgtggcgttggctgcgaggtctcggaggtgagggcggagacggtagcggccaacgcgcgtgctgagcgtccggcgcgggaactggccgaagcccgtgaagacctcacgaagatgagggagctggtggccggcaacgagtgccagcgcaaagggctcgaggactgcatgtcggaactcgggataacctctccgagatccgaggttcgctgcgggtcacctacaccggtctccaccaactcgccgaggagtgcagcattaagtccacgattccggtgaatcccgacgagttctcgttgacctcttcccttgcggagatggcgacggcgatggggaaattccctccaagcacgcggccaggatcatggaggagacgtctaacggtatctataccgggacatgtcacgtcctcgcatgcgtgaagttgtcgcgtcctgaactcgacctgcgtgaggtcttggatcagggagcggcaagtaacgcacggaaggaggtgatggaggaagtcggtgatctgggggagtctatcctccccctttttgaagagtaggacccatgtattttttctgacttgtaaactttaaattctagttgcctttgcgtgcatgattaccatccttgttcactattgatttcgggaatctctcttgttgattgtagagatgctgatgatgaggatgtctagcagcatgggcagcccgagtcactggcaatgattccggtactcgagtttgaaccacgcgcctctcatgacgtcgaggacgaaactcttgatacggaggtcgaagtaacagcaactgcttcgagtgagtagcctatcaaccttgatgatgttttggggttttccgagttgtcttagtggtcgttacgtgtcacgaccggaaataacccaacgggcgttccttacgtgcgtgcattaatccttgtcccaggaggcaaggtacaccaaaagttgatacaattcagagtttaacaagcagaagcgtaaaatagttaatttattacatgggcgacgaaggcccagcacacacaaagacaaacgagaagcagcggaagactagggcgacgaccacaggcgcttgacggcaggcacgagctagacaccgaagccttcatcaaccaggaactcctcttctggggttgggaaaaattgagcaagactgagtacaaccaccgtactcaacaagacacacccacaagtgcggaataaatgcaagggagtacaaaggagtcatactataaaggggtagggttgcagtaaacagcatttaaagacatttagttgcccaagctattttgtaaacacgattctagtactatacaatgttattaatcaaggccgtgaacccacacgaacctgtattaaaccaaggcctatgatgattcggaccgaactggcaaccc

SEQ ID NO: 74430 - DNA, 1095 bp, Oryza sativa
ttgtgaatgctgttgtgaaactgggttcgatgtttgaaaaatcagcagctgacgggatcagctaggcccgggtggccgtttgaaatgttgttggcccgggtggccgtttgaaaagctgttggccgggtgccaacctgtttcaagatctaaagactgatacattgcacatactccgaccggacgagatgcactgtctcatccgtgtcgtttgagaagcactcacttagactttttagaaaagagttcaaacaaaatcaattacgaaaaaaacagcctttccttgaagcctgcattaaacacttatttcccctggcttgctgagtactcccgtactcacccttgctctatataaataatcctcccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttactgtgatactctgtctccctgtgataccagcactatttcctgggactggtatcgattaatgtcacaccccgaagttttcctcccaagccaaattgtaaattacaaatgaccccaagaaaatgcagaggaaatcaggataaaaccctaagaaaacaatgcatataataatcggatttgacatgtggaatttttcttgaattctacatgtcgaaatgcattaacaggatttttagtggaattttcagagctctagaaataattttaaccaattaaaaatcactaaagtgcaatttttaattccagggaaaaccctttttccttttcctttttctttttcttttccctccctttttcctcctttttcttttcggatgggccgacggcccattcccctccttcctccccctcctccttgctgggccggccgcaggccgagggcccagcctggcagccgccccccgcctcccttctcggggtcgcagacaggtggggcccacctgtcgggt

SEQ ID NO: 74431 - DNA, 678 bp, Oryza sativa
tttatggcaattatgtcagaaagaagatggacattgccattgattccacggtacaaaattgattttgttgataactgactgtgaatccaaattaagatatacaggctgacaactagggatgaaaacggtacaaaaacggatagaaactacctttatcattttcgttttcattttttttttcagaatcggataccccggatacgaaaacggaatcaaatattgtcgaaaccgaaaacggcgctgatacggtaacgaaaatttatcggaatacaaaagcccctcaaactaagctttaaactatgtcaaatccaattctcaagtctcaaatttcaacattacattacaaaacacaatcatgtcaagtccaattctcaagtttgaattgggtgtattgggttggactgaattgagtgactcaggggatgctgaattgggttggggtggggaggaattatagactatggtatgggcctttataattccaaaaattccgagaaatttttcggaaagcttccgaccgattttgagttccgacggaaactgcccttatcatattcgattccgtttccgagaaaatagttccgaatccgttttcgtttccaaaaaatttccgaccgacagattccgttttcgaaaataggtccggaaccggaaagtttccgtactgtttttatctat

SEQ ID NO: 74432 - DNA, 28353 bp, Oryza sativa
ctaaactattgacaaataaccgaaccatatactgcagccttctattatatgaagtgttttttttaactaagctttgggtgacacggccaattttaccgtcgtcagcgggcagtactattggacctgctctaaggcaagtactatgggcatccaagcacatgcccaagataccacataggattaaatagtgagatggaggagagaagaaggatgagagagaaatagtcacctctcatgcaaggggcagctcctacccaaacttcaataaatatgtgagagtgttagatatactggggattgtgtggtagaggtaacctattatacatatcacctcttaatttaaatatgtatatcatgcatgaaattggatgtgtagtcacccatactataaaacttgcccttagatgtctaattgttggtcaccctcttttgcactcatgtgtcacctagccataaaagctaccttcaaagtaatttttgcactaatcccaactattctctcaaaactttctttcaattcttattatagttaggacagtcatcacacatcatcacatcctccatcggcacatttgacatttttgtatttacccacgtatagtttatatctagctacatacacaggtaaaaggaaaaaaaatcaaactatgtgaatagtacaattatatatgcattgtttttttatttttgaaatttccaaattaggcactctcacacagaacaaaaatcatgctaagagataaacaattgtcatctatcattctattcaaccttccctattttacaccttcacaaataaatcttatttctttataaaaattctcgccgcaacacacgggcatcatctattatatctataaagttcatccacactaaatgcagttaatgttaattatctcttctctcatgaagtcacatcatattaattatttttagcctttggatgatcatcaagaatgtaaattgcatctattttcccaaaacacaccatacaatccaatcatttataacctttagataattgatcaaggtaaaaaaaacatataagcacatgaaagaaaaacgtattgtagatattaagaaagaaatttttaaaactcacatctattgcatcatcgcacaattcatccacaccaacacgcaaggtacccatctaattttacttacaccaacatctactgatctactccctccaattcaaaatatagcacttagatttatctaaaaaataataatatcttcacatgtatttccttctcaaccgataacaatcttccatcatttacatacttagtatttctaaaccaattacatttttttctatttaatttcacttttctaatacatgtgtttaaacctaaaacttcttatatttcagaacggagatagtattaaatagtacttgatcactgatgatttgtcacttctaacagtggtatttaatgatttatcaatcaatatctcctcactaataaaagaaaggttgttcggaaatcgtaaatgattgttgatcggaagccatatattattacagaacaatcacttccgatcaggcaaaagaatatctcggtcctttatatcatggacacatgatacgaaattcttaataatatatggcttggtctatctctgttgttgtttctgtcgtgttcgtcatctctatcctccaataacctgtctgtggttgtggacgtgtccattcttccatgagataactacagtatactccactgacaactaactacactacagtagctcagtttcattcaacaactcaggtaagcaatcctctcattctttacgggcatatttctaaaccgctaaatggtatgttttatttaaaacttttaaataaagattatatatatatatagtttgtgatagttaattaatcccacgctaatgacctttcacttcttttaccgtggaaaatctcatctgaattactgaaatgtaagagtagtaaggctgcatttggatctccatatagacaaagctaatatcgtgttctccatgaacatgttttccaaactaataaatagtgcacttcatataaaaaatcaaatataatttaatttttaagtttatgataattaatagttaattaaccatgcactaatttacttgctctagtttccaagccacttagtagctcagcagttctgcgggaatgaacacatcctaagggtgagttcggaagtgagtttgggtttgacaactttctaattctccatgagcatgtttcccaaaactgcattaacgatatgtttcatgtaaaagttttttatagtagtttcttttaaaaaaataaatacacctagtttttaagtttataataattaatattcaactaatcatatactaatagctcatttcgtttcacgtgcctaaaatatctcatcccacgactacagccgaactcagccttaagagtatgaatgcactgttcttcactattcgcatttcgtggcaaaatctcataatcttttcaacaaagcatgcctaatcaagctaagtactcatgagtcaatgagtcatgacccttttctcccttcagagaaagcagagacagaaaaagattaatgtatactcagtcgaacacttcaatctgaaactctgaacctttggtcccataatctgaaactctgaacacttttatatgcagtaataatcatgaacggcacggcggattgaacatcaactaatagatgatcgtgtaaaagatggtgattaactcgatggttcccactggtgtgaatatctgaaaagtttagcggccaaattaaacagtgggagttggtagttttgacctcacctgccttcgctttgctgcttggtcagtgtgaataaatgtgatctccaagcttaacttcctcacgcgtggaaaagcacacagcgtaagctgcttactgaatactcagtcaagcacctggtccaagtaagcaaggtagtactaccagactactagtagtagtattaaaagagtttactagtaatgtgctccataaaaagagttttggatatttgcagattgtttaattttttgatcggaccagtagtttcaaagttaggaaggtaccagtaatatctgccggttttatgagtcacatctggatttttgcgtttgttcggttgaaatttggagcctttgttttgtgtgcaatactgcaatgcattggttagccttctgtttgactatagtagtgtagttccttcacttttcaaaaggaaaattcagacgcttgaacgagttcgttctctctgaatgatacctgcgaagctacatttcgggccaagaagttggaccatttattcattcagacgaacaacaattgcgccatcaagataaagcaaagcgaaagtccattcctactccctcaactataccccgagtcttgtttcgtgtagcacaaaattgggtagaaaatctccctgaaccattaaaacatgatcattttacctccctgagcagttttgatggcggttttgtactatgaggcgtctttgtggcgtatccagaaagaaaatagcggggggggggggggatctaaatgaaatatacaaagctatagctcatctttcccatctaagtatggcaagaaaaattagtgggggctctcatggtactcgtgccagtagtggaggctcgagctccactgctgccatgctggatccgctcttgtctccagatcaaggatcatcccagctgccacctcactcatccctcagtcgctctcaatagtgttgttgcccttgcaaccttgtcgtgactaagctcggaggagtgctgctgtaggctcatttccttgcacccagcctcgccatcatgtcaccaacaacaccaaattaccccaccgagtggatgggaacggaggacggtcgtccaatgacccaaccttttcgagctctagcaatgggctgggtcttgaagcacggaaggtgggaagcgacacggtggagacaagaccggtggcgtcggaggtgaaggagagagacgactagtgacatcgagaggaggcctacatctcccttctctctcctctcctcttttgccaggaggccatccgaatatattaagaagaagaaaagttattagaaaaaaggcagaagctatcgagatcatgtgtgtaccaaagtgcgtgtccaagaaccaccaccctctctcccgtctctctaatcctatatacttatgtagttcatccccactaagtgtagttaatgttatttctctcttctctcattaagccacatcatcacaattatttctagcctttggatgatacatctatggttcaaattgtctcttcttttttctcttttaaaaacatgcaatcttaattatttttaggctcaaaattgtatcaaattgttttagttttgattatcaaattacatcttatttgtacatattatgcaacttaatttttcgcagcaacgcggcggggtattcatccagtatggatgatgaaatgactgggttttaataattcgggaaggctttataccctactgaggaatacgaatcaaactcgggctacagttaagggagacaaaaatggacgctttcgtcaataacagcagatccatacctaaccgtgatactcgttatggcccgaatatgttgtacacggtggcgcccaaatatgttcttgtggtcccttatacgtgtgaagggaaattaacacaaaacaagcatagttcaccatggctgaaaattgccgtggaaatcttcagcaaacgaaatacgaacacgccgatactgtctgccattatctgatctaactacttccactagccaccacccgttagcgtcaggggaagcaaattcgcggccgtgcaggccccctatcctatcacactgcattgctgctatagctgctacaatctgcagctgcaatggcgaacggatcggacaatgcaccattgattgctccccgaccaagccgcggattcttttgacaaatacggacagaaatctctcatgcagacaacatccgcgatgatctctgaatctctctctctctttctcttgcactgcactgcaagccagcgcgattagtgcagaggccgcaatggccaccatcatgagcgagctgaaatgaaatgaatccatcctcgccgcagcacgccgccccggcggccgccatcaatggccctgcattgcatgcaatgtgaggttcagaaagttcagaggtgtaactgctgctgctgctctgcaggtggatctcctgcgcctgaaaattcgtccttgggatgccgggatctcctcccacatcgatcgcggggggattcgttgcgttcgtacgcctcgtgcgctcgtcagggggctcgatcggaccacggtgtagcgcataaaagttggatctcttcctctttttcttttgccctttctgcacttgcctgaatcttgatctgaatatctgatggacagacacactggtaagaacttcagaaattggcatgtttgcaatattggcctgtttagatcgcctggcaaaattttttcaccatgtcatatcgaatgtttggacacatagatggagtattaaatataggcaaaaagaaaaattaattacacagattgcgtgtaaattgcgagacgaatcttttaagcttaattactccatgatctgacaatgtggtgctacagtaaacatttgctaatgacagattaattaggcttaataaatttgtctcgcagtttacaggcggaatctgtaattgttttgttattagcctacgtttaatactttaaatgtgtgtccgtatatccgatgtgacacgtcaaaatttttcactcctgaatctaaatacacctatatcaatatcgattttatcctctgtcagggttggtggtggattggatttggatccaatgtgggggatgttggggttttagtggacagaaatgtcttgaaaaatttgcgaaactgggatgattttcgctgacttttgggttgaattggtatggaccgggaattgccactttcttgtcgctgttgttatcagctttatttattacaccatttgcttggctttgatttgtgctctcttggacttatgagagatctcattttaaaacacgtgcagttatactgtaaacaccctggatgaagagtgtgtaagattatacccttttctgttcccatgaggatatatatattttaccttgatttttgttagcatgtttttcaaatggtgcgatccgtgcgaaaactttccatatagaaatcgctttaaaatattacatatatccattcgtcaaatttgtaataattaaaacataattaatcatgtgctaatagctttatcgttttacatgcgtcaacttaatctttatcttcatgagtttcaaacaccatcatgtgttttgtaaaaatgtcatcaccagattcatcataaaaaaactttcaaacaaatatattttattatatacctcacaatataatatttttcaaaaaaaattagcgacgcatagtgtggcgtgtcaaaagtgtgctggagactacgtagctgttcgtttggcgactaaacctcattttatcgatacaaaagttgaccaacacttaattggtcatagagcgtgacaacgttaaaaaaggaaaattgagtatataacatgcgagtgggtataaggcctagtaaagggtgatatgtcgcaactatatcaaccattgagagtggaatctctccggactataattataattgtaacaattatagcaactagtaaaatgtggcatatcgaattctcttcacctgcaatctatgtaactgagtaactccagacttttttaacacgccctactacatattttcgcatgaatggaaaattcaggtgggaatctctcccctctaatgacttgttaaaaataattgaggcacacataagttttaacacggtagcctttggcacttaaccaaacaagccctacgtgcacatcgaactctaacaaataagagcagtagtaataaaaaatataaacctaacttatcaccatgggagcatgaaaagcttgaagatgaaattaagcacatgacactaattaaagtagcagaacaaaaattgaaggtctcaactgcaaccctattatgctctaaatgatgctaccgtatacacaagctgctccagaactcactgtgaccaaactaacctcgatcagagttcttcctcacatagcttactaaactaaaaaaacaaaaaaaaagaaagaaaaaaaagagagagagaaagaaacaggagatggagcagagaagaacaggtagatgaacagggcacatcagcaggagatctccatggagaagttggagtcgaggagctcctcgatcatctggtccacgtactgctcctcgaggaacccgccgctccactccgccgtcgccgccgcattgcccaatgcgccggcggcggcgggaagggacggaatcacggcgcgcgacgacgcggcggcggaggaggaggtggtggagtcgtcgtcgttgctgttgccgcgctgcgcagcctggacggaggcgaggttgaagcggtggagcttggcgacgagcgccgcggagaggaacgacgaggaggctgcggcggcgctgtgcggcggcggcggcggcgcggcctcgtcggcgacgtcgtgggggaagttggtgcgcacgcgcgggccgcacatgatccgcgccgcctcgtcgtacgcgcgtgccgcgtcctccgccgtctcgaacgtgcccagccagatcctcgtcttcctgcaagcccaaccaagaaatcaaaccgccatggccaagaaaccaatctacgcgaggaagaaacaaagaatcaatcaatcaggaggaggatggcgacgatgaattacaggagagggtggcggatctcggagacccatgagccccagtggcgctgccgcacgccgcgataccgctgctgcggccgcgccattgccgacgtcctcgagctcggcgacggattgcgcgtggtcgcggcgagagagagcgcgcgctcgcggcgggagagcgaggagtgagctcgaggttgaggaggaagtgaggtcgaggtgatcagtgtggtgaggcgagccatgggggcggtataaatagggagggaagtgaagcagaaagagtagcgagctcagttcaattcaattcccggcttgtttgaattcaaagcaacccagctccagggtggggcccgcctctgtgcctgatcagtctatgattcctggggcccacctgggtcgagccaaatttgttccctctgatttgtactccctgtgacactcctccctctcagaaaatgtttgcatttctattgcttacgtataagcatttttagggttggatacagttattaagaaatttggtatgattaaatgaggggagtgttgtgattggagaaaaattagaggtaggtgtgaaaattgaatggtggaggattgtgattagttgagaagagaatattgacggagaagttgttatattttgggacaaattctaaatgttagaagtggttatattttgggacagagggagtaattagcaaagactaagaatgaagtgaaaaaaatatccctttcagacatcttattggttaaattttgaattttgacttgctcagattcccctactaagcacatgataggttgaaaatacctgaatttccgtggattgaaatcaatgtctcgaaaatactcatattgtgtaatgtttcaaaaaaaatactcatattgtgtataaaatttggatcctacaaatacttatatttagaaacggatggagtacttagcttagcttttgtttgccattttccctttttgtttacttattagtagtagaaagtttgattataaaaagatagaggacatgcagaagtcaaggctagtgtcgacaatattcccctagaacatccaaatcatggcattgcattatccagtgaaagtaatcacctaatccagtgacctatattaagggaagaatgaggttataataattaatctagtttatttagttcaggcctaactctagacttatccacagtgcaaccatgttagttcagttataatgtcatatggtaggtaaaccagagaaaactaatgtatgctctcaggaaaaaagagagcatgctactaagctctgaacttcggattccccacaagaacccaaactagcctacaagcattttcttgtgcaatggtactactactgaagtttttttttaatataaaactctctgtttttatcctagtcatggctagggtaatcatttttacaatgaaagtacaattctcagtctctgcattagggttcctttgaaacgcgggataggaaaaacatagcaataggaacaaacataaatcaagtgtcatgagtagccgaatcctataggaaacgaagataccgggaatttggtagagaagatgtttggttacttcataggaaaaccacaagaattttgaatgaaatacttcattcgaatgggtaatagtagataaaagacaagatattaagatacatgttgccttggactttccgaaggaaatgcaaacatgatgagctttgatgtaataatgtttggaatcatccaattcctacaatctaaagggctttcattaaaattcctatgaaaatccttggttcctagggaggcccttaatgggaatgcacgcaactatatcttttcagataatggatgctctattgatctcaacacaaaatacatcaagatgatataactcgtaccaagaacactcttgacctttgcataactaagatccatgtagccaataactcacaataatatgctaggatcattcttgttcagatttgtccctagaagttgattcttttgggggcagatagtgtaactaaagataatctagttaaaccaaattgtgaaaagctcaattagcccattatacatcatcctagctagctatactatactagaatagatgatgatcacagccaagccaaccaaccagttgcaatggctagctagatgttgagataaccttattgggctgctaacaatgtagctggttggcaccatccatggagccagagtgtcaccttgggaagagcagggtctgcactgatctgcaccttgggaagagcatgcagatggaactaaactgaacccaagccctcccccaaaagacaaaaaccttgcaaatattgcaatggctgctgcgcctgctgaggcatgatcagtcatcactcatgcattgcctttgcctatcatgtctgcctcctgcttgtgcagctgtaagtatgtgcatcttcagcgtcagttcagaactctgcaattgtctgaagctctgagtgcctgcatgtgtgtgcgcgcgcgctgtgtgtcattgaacccgatggctgtgcacatgcatgcaccgtatccaccacacgatcttggctcgtcccttctcatgttggacgctagtgtggtgttttagcaaattaaggctccgtttgaggagcttaagatcctggaaaatagccagtgagaaattacctgatgagaatctaaataagctgggcttttcagtttatagtttatatattttctggattttacaactacaccttctcataatatggatgagaagctagctgatgagaatatgaaagctgttttatcagcttctgacttctagtttattttctatattctgtaactacattttcttaaaatactagcatattgtccatgagctgcaatgggatttaaattagttaaataaaattatcattaatatattattaccatctcttaaatattctatatatttgttactgacatgtggattctttagtcccacaccattcttttttcttcctataaaaagtagagagttggtgagagtacttgacatgtcttttttttttctaaaagaaagttgggagttggtggccaccaccactactctgagtatagataggtgaaattttgaactatttaggagaattgaacaatctagaagaatctatggttatcagaagctctctaaaataggatctaaatgggctcaaccagctgtgaatttttatcgttattttagctgatcgtaatgaagaggaagttgggagtttgtccttatgtttttctattcatgttagaacttattggctacatgcttaacgacagaggctggggatgtaaataattttactatctaaaaaaaatcagccgctaatgcataatgcaggccattaattctaatcagggatcagtacaatgtgcaatgtacatacatgctgctaccatgtacagtgttatgctggatttttcctgatgatcagtgtgagtcagggtatgggcactgaccagggtttgttttggaggctcatggttgagacactaaactatactgttgtgccatgtgggttctaaatagtagtgttcttaggtgacagtgagagtagctagtctgtctaatcactgctgatagaatttggaacccttcctccatgctggttaactctgatgattaattgtttatcaatcctctgacaaatgacctaataaccatattgtctcctctgcagcttccatgcttgaattggcatccattcactgattcacatactatatgcattgaacctcacaagaattggacatcacaactactagttatacacatagagataatagggatagagcttaatctaatgagcctcacaacatggcagcacatgctgttcaagcccagccaattaaaaacaaatctgtactgaacctttactgcaacaacaatctgctgatgcgcacatagttcctctcttgaatgataagcttacaaaacgagaattttatggctctgctcagccacagtcccaaactgttcttactgggagtctgtcatggtcgaaaggacaaggccacaggcaagaaccgatcgatcggccggccaatgctgcaatcctgcatgcatgaacacgaacactgacaggatctatccgtgatccgcctaaccggcacagagaaaagttcagaaacagaaaaaaaaaagttcagagaaacaggttatcagtatggttcttgaggcggctacgtggctgcacggcggctcgtcaggccggcccctacgccggcgatgggggaggaggaggaggaagacgacgacgacggtgaccgtgatgatggatggatggtcagatcaggtcagtgattggattggattggattggattgtgttggatttggattggttgggttcagagtttaggagtggagagaagcaaagatccgagtacaaatcttggccatgatccgcacgatctgtggcgctgtggctacacaaacatcactgtgttagtagctctgcatgcatcgctagatgctaccatgctgatgaaatcttgtcactcactcactcactcaccatgctgctgctaagctaaaaagcttagctagctatggagcatggaaaacatggcatgttcttgtgaaagattactaacgtttccatgccatgtgctgcctaatctttattactactaaagaaggtttcagaataaaaagagagaaaagatgtacatgaacaatggaagctagcagggtgttgctacctgctacctaacacatgattcactggaagagttgctgaccaaagtcccaagctaattaaggattctttcaacagcatatatcttaatatctcattatctagatcttgatatcttaacacattatatgtgttaattatctatatgcttcattttacccaaaaaacagcttcattttactctctatatgttgcaagcactgtacattacctgaaattttattgggaagcaggcagaggattacatgtcagttctgtacatgggtcaaatgacgttggtcactctgatcatctctgcactggattgtgatccgtgtttaatgttgatgtcgtttggccccctcctcacacggaatatgaactcattatctgacgattgtgacattgcgaatctgatgctcttttttgagaatacgatgatctgttgttgcatccgagttcaatccagttggcagattaaaactagctgaatgcctcaaaacctcacaaattgtcggcaacatgtgtgtatcagtatcatcatgcagtgcagatctttaatcaagtagtagtggtatcctttttctttctctcaattcagtaattaaaatgcatttcatgctgtttaattaaatataataactctcagatcacaatctgttatcttaataaagtagtattacaactctcagcaaaatgcagtgcaaatctttaataaactagtatcctttttttcccttctcaattcagcaaaatgcattgcatactgttttatttaaatataactctcaagatcacaattgattcaaagagcatgatcacaaattcaagatcatggcaacctagctttcatttgtttttggaggttttcttttcttctgaattggaatatttatatgcataatgtagcaaaacaaaaacatgcaaggaacataccaacatggactgccaagtggttaagaaacgatctgacattgcaagtggcctgattagacatgcaaacaaacagtatttacacgtgtcgcttaatcttggtcggcacatgaacagcgcttaaattctttaattagtctctgaagaaggtcaggtctcctctgccactggcaaagggcagcatccgaaaaccccatgtgaccatgattgcgagatgtcgatgaatcataagacgatgttagtggccaatgagattgcagaataattcagggcgtgccacgtgtccctaatcagcatcaagatttttagagtacagcagagatggtgttatttcccgataacttgtatgtcggcgagcagggatgcaagtatgcaactggaccgacccattgctgatgcatcttatcataagtttgaattggaggaattttagacatttttctttctcgtggatatttacgcctttcttgacctcttttatgtgaaaacgcttgtagcgcagtggtagagccttcagtattggggacaccgaccaagctagggttttgcgagaaaagaaagaaagaaagaaagaaaaacactcctgttagtagaagtgtgctcatatggcttgtttggcaactcgaaggaaggagattgggagtttacatgaaaaaattaatggtgagattaagaccaaaatttgatttttaatcccaaaagatttttctcgactcgtcggtctgagtttttttaatggagcacatgggttctaccgttttttttctttttttttttacaaattttatccattccaaatggaaggcctaatgtttgtagcgtggatcttttatattttgttccaaaggattggtcaaagaacttaaacagcaaaggatgaaaaaaaatcctaatttaagagaaagagttacaagtgggaacactttttttatttactggttctctgtgttgttcattattttttcatctttttggagaaaaagtttttcattcgtatatttagcatgacatgaagaaaacctaagtattcttaggcccatacctatatttagcccatcgaaacgagtccatgaatggccggaatttccggtccatgcatagttgggcaaggaatacggccatctaacaggcccaatatgagcccattaggcccatctggcccacagctcatctgcatataaaccctcacggccccgaaatgctgcggcttctccgttccaagggtttcctcgcgccgccgccgccgccatggtacgcacctcggttcatctctcctgccgctcttctcgtctcgggatttgtttactcctctgattgattgggtgttcggcgcagccgtcgcacaagacgttccagatcaagaagaagctggcgaagaagatgcgccagaaccgccccatcccgtactggatccgcatgcgcaccgacaacaccatcaggtaacctccgccgtcgccgccttgaatccgatccgtctatggaagggagagacaccagtttccgatccgatccctgagctgctggtgtccttcaggtacaacgcgaagcgcaggcactggcgccgcaccaagctcgggttctgagcttggggaggagaggaggacgaggcgccggacgccgctgccctgggaagaagaagaagaaggagaagctagggcttatgggttgcgtcgtgttcgtttcgaggttttgcctgtcctgaagagactatcagtagctgtgtgtatcttggagcatcataattttgctgattaaagaaccactttcttatcctgcctaaagttgtctgaattttatctcagctgcagtggattgatcagttgaactcccttgttagcataatctgaatatctgattatctgcatattgcctgaatccatttctgctttagtttttggtactgtaaatagctacaccgtttagggtgtagatgaatgacctgttgagattttggtaggggattgggctggtgagtttctctatacttttacccttgatttaacagtgacctgctgtagccatttgtaatcacaggggttgcatgtttgttcttagtcagagagcaaagaacctttgatagcatttctacggggacattagaaatctttggaggatttaacttccgaagcacagctgcttctactccagtgagtttaaccaattgggcatttctggagttgtagggaatttgtcactagattgatgattgaatttccagaaaaataccatgggctggttgaatacatgctaatgctgcaatccagtttgaagctacttcctccgtttcatattataagaccttctagcattgcccacatttatatatatgttaatgaatctagatatatatgtgtgcctagattcattaacatctatacgaatgtggacaatgctagaaagtcttataacctaaaacggaggtagtagtaaaaacttcaccctgcctattgcttgaatccatttctgctgtagcttttagtaccgtaaacagttgcaccatttagtatgtaggatgagatagctgctgagatgttggttggtttaggttgggttaatttagccgtgacctgctgtacccatttgtaatcacaaagggcacataagttcttccttgttggttaatttgtgtgctgcatcactttggaggagacatgcttatacttcaatgagttataaaccaatgagatcttaggacaatgatgcttttgcatgcttctaaatatcagtcttcatgtaggcctccttggagcaatattgttcgatcgtgtgctcttttgattagatttatgaattttgttagtaatatgagatgacagattcataggatgttggcatgatatgtttgctaagttggtgctcgttttgtaagaaaaataaaatgctgcccctgtcctttctgggtgtatgttgtttctgtccccttgttgcagagttcttttgctttcatgcttcctacgaattggtgagttaagagagggactcccttttgtggtaccttggccctgtttagattccaacttttatctttaaacttttaatttttccgtcacatcgaactttcctacacacgttctaatttcttcaaactagcaattttggcgtggaactgaacgcagcccttattgagcccttttgtgtgtgtgtaggtgtgtgtgtaggaaagttcaatgtgatggaaaagttgtaagttcgaagaaaaaaaaaagttgaatctaaacagggcctaagttagtttaacatttttgaaagtttgttaagtttgattaagtttttagcaatatctaaaacatcaaattagtttttattaaaactaatattgaatatattgtaaaaatatgtttgttttgtgttgaaaacgccactatgtttttatataaatcgatcaaactaagaaatttgattaggaaataaaatgcaaaaacgaactgagggaatatttagcaaaaatctaatattgaatatattgtgaaaatatgtttgttttgtgttgaaaatgctactatgtttttctataaaatcgaacaaacttaagaaatttgattaggaaagaaaatgcaaaaacgaaatgagggagtaaaatttagcaataacatggtactatcgtgaattccgagcgatcatcgctgactccgctgaatttctaaacctgaaaggcaagcagatttgttttccctcctttctcctcggagagactatggattcggcaccccatatttttaaaaaatcaggtgcaattctacccacccgatgcttggtgcatagagtactctccctctctctttccttactgtataaccacctttttttatcaaacttttctctcttaatcttaaattatttatatgatttgtaatccgatcacacggttatatttgttatgattaaatctttaaaacaagatctttattatcacacatgaaacacgtgatacattcagtcgtaactagttgtaactattcaaacatcgcaaaaataaaacgtgcaacttttgcaaatgatctagtgtaacattagaaaataaaaatattctctgcaacttccaaataataccatatgtaaatatgtaatattagtaaaaaccattgcaaaaataaaaataaaaatatgaaacatggtcaacttttagttgaaacattatcttctcacctttgaaacataaaaaaatcaatttgtcaaaacctatacatttttttcgtcaaaatataatcatgcgagctattgttgtaagatttagttgtaataaatacaacgatgtaatcggatattagatcatataaatattttaaaagaaaaaatggtttgaaattcaaatttaaggagcccatttgaatcgcgggaatgaaaaaacgaaggaataaaaaacacaggattctaaccgtaatggaagtgtaaaacagagaattgcaaaatacaggaatgacggtttgattggactatagaaaaaaaaacaggaattggatgaaagagatagactaaaaaaaattcgaagagctttgagctgttgctaagtttccttcaaaaatctctatagtattatccatttcataggaatatcaaaggattagatatgatgcaatcctttaatttaaaggcactcataagaattttttctatagaaataaaatcctctaaattccctgtatttttccttcaaatcaaatggccctaaaatatattatatcttacatgcaattgtacccctctcaccatattacgtcagtggtttttttttttttttggtcttgctgtcttgcgtgtatgcagtactgttgctagagccgatcttgttgctgtcttgcatgtaagccgtattttctccccattttcccgcggaatcctgggcctcacaacgcggcgtcgtggcgaagtcgcgacacgtgcggcggtcgagcgccggtgcgtgcgcgcaggcggaggcgccccgcgaagctcgctcggtcgcccatggcggaaaccggaaaagaccctataagacgccccgcgcgaccgccattgcctcgccgtcttccgccccgccccgcccctcccctccacccacgcggagaaggagaggaggagaggagaggagagagggaggcagcagctcgcccgccgccgcccctccctccgtgcccgcgccgcccaccccgccgccgggcaccggccaccatcgtcttcatcatcttcccaataaaccccccatggcgtcctccctctccctcgacgacatcaacgacgactccgtcgacctggtacgcacgcacgcacgccatgtgttcgtccatcgtcctcctcctcgtcagcgtctaatgttgtgtaaatgttgtgatgtgcagtcgaaggcgccggtggcggaggtgttccagaagctgaaatgcgaccggaaggggctcaccggagcggagggagagagccggctgcggctgtacgggccgaacaagctggaggagaagaaggagagcaagcttctcaagttcttgggcttcatgtggaacccgctgtcgtgggtcatggagatcgccgccatcatggccatcgtcctcgccaacggcggcggccgcccgcccgactggcaggacttcgtcgggatcgtctccctgctcatcatcaactccaccatctcctacatcgaggaggccaacgccggcgacgccgccgccgcgctcatggccggcctggctcccaagaccaagctgctcagggatggcaggtgggaggagcaggaggcggcgatcttggtccccggcgacatcatcagcatcaagctcggcgacatcatccccgccgacgcgaggctgctcgagggcgacccgctcaagatcgaccagtcggcgctcaccggcgagtcgttgccggtgaacaagcacccggggcaggaggtgttctcgggctccacggtgaagcagggcgagatcgaggccgtcgtcatcgccaccggcgtgcgcaccttcttcggcaaggcggcgcacctcgtcgacagcaccaacaacgtcggccacttccagcaggtgctcaccgccatcggcaacttctgcatcatctccatcggcgccggcatggcggtcgaggtgctcgtcatgtacccgatccagcaccgcgcctaccgcgacggcatcgacaacctcctcgtcctcctcatcggcggcatccccatcgccatgcccaccgtgctctccgtcaccatggccatcggctcccaccggctgtcgcagcagggcgccatcaccaagcgcatgacggccatcgaggagatggccggcatggacgtgctctgcagcgacaagaccggcacgctcacgctcaacaagctcaccgtcgacaagaccctcatcgaggtgtgctccaagggcgtcgacaaggacatggtcctcctctacgccgccagggcgtcgcgcgtcgagaaccaggacgccattgacacctgcatcgtgaacatgctcgacgaccccaaggaggcacgcgcggggatccaggaggtgcacttcctccccttcaaccccgtcgacaagcgcaccgccatcacctacatcgacggcaatggcgactggcacagggtgagcaagggcgcgccggagcagatcatcgagctctgcaacatggccgccgacgccgagaagaaggtccacgccctgatcgacagctacgccgaccgggggctccggtcgctcggcgtgtcgtaccagcaggtgccggagaagagcaaggacagcggcggcgacccgtggcagttcatcgggctgctgccgctgttcgacccgccgaggcacgacagcgcggagaccatccgccgcgcgctccacctcggcgtcaacgtcaagatgatcaccggcgaccagctcgccatcgccaaggagacggggcggcggctcgggatgggcaccaacatgtacccgtcgaccaccctcctcggcgacaagaacagccaggtgaacggcctccccatcgacgagctgatcgagcgcgccgacgggttcgccggcgtgttcccggagcacaagtacgagatcgtgaagcggctgcaggagatgagccacatctgcggcatgaccggcgacggcgtgaacgacgcgccggcgctgaagaaggcggacatcgggatcgccgtggacgacgccacggacgccgcccggagcgcgtcggacatcgtgctgacggagcccgggctgagcgtgatcgtcagcgcggtgctcacctcccgcgccatcttccagcggatgaagaactacaccatctacgcggtgtccatcaccatccgcatcgtcctcggcttcctcctcatcgccatcatctggaagttcgacttcgccccgttcatggtgctcatcatcgccatcctcaacgacggcaccatcatgaccatctccaaggatcgcgtcaagccgtcgccgacgcccgattgttggaagctcaacgagatcttcctcacgggggtggtgctcggcacctacatggcattggtcaccgtgctcttcttctacctcgcgcacgacacgaacttcttcacggatgtgttcggggtgacgtcgatcagggagagcgagagggagctcatggcggcgctgtacctgcaggtgagcatcatcagccaggcgctcatcttcgtgacgaggtcgaggagctggtcgttcgtcgagaggcccgggttcttgctgctcttcgccttcttcgctgcgcagatggtggcgacggcgatcgccgtgtacgcgcgctgggatttctgccggatccagggcatcgggtggcggtggggcggcgccgtgtggcagttcagcgtcgtcacctacctcccgctcgacgtcctcaagttcatcatccgctacgccctcaccggcggcaaggccggggacagcgcccagaaaaaggcaagctcgccgccgccgacctctcaaccttagatagacttggagatggattttttctttcttttttttttcctcgagaggggaggggaggatatccccctcgtcttatgtatgtatgatgtttaaaaggttattaaaaaatttgaaaaaaatatttagtaagatagatcaatatatgatatgttattctataaacatgtaaattcgaattcgacttttataattagaaacgaaaaaaactgactacgaattacgtgttatatttagagtcgaatttattattttttaagtaaatttcacaaaactacatatacttaggctaaattattagaactacatgtaaagtgatgtatcacaaagttacagatttaacaataaatttatcacgaaactacatgtcgtaaaactatagatttaattataaaattatcacaaaactatatattttggagttcaaatctttaattctagtgctatgttatagttataaatgtccaagttttatgtttaaattgatattactttctccgtttcacaatgtaagactttctagcattgttcatattcatttagatgctaatgaatctaaagatatacatatgtctagattcattaacgtctatatgtatatgggcaatgttagaaagtcttacgttgtgaaacggagggagtacatttgtagtttatgataacttttttgctaaaatctgtagttttacaatatttcaccttaaatctttagtagtgtaataattttagtggtaatttgatgcatcatattaaatatatagttttataataatttgaccaaaaattacccatgattttatgaaatttactctattttttcttcttctagttatgtaagttgaatttgaacatacattttatgaagtgacatgtcacatattgatctatctagctgattttttaaaagaatctttgctaactttttaagcgacgcgaaaaaaacgagaggacctttcctgaaggaatgaatattgtttcgtagatggattctaatcacttgggtggatgtccacccgtttattatatgtcaactaaatgattatgaaaaaattcaaaaaaattgacaagatatatctatatgtagtatatcactccacatacatgtaagttcaaattcaacatctacaagttgtaacaaaaataacaacttgtaaaagttgaattttaaattgcatgtttgtggagtgatatattacatattgatctatcatgttttttttttaaattttttcataactatttagaacacgtgcaagatgtccaccgggtgattaaaagagttcccctatcgtttcctgtagttttcgccatgattgttgtgaacgctattgatgatgatggttgtgtgtggcgtgcgtcgtctccagtgagggaatcctgggtgtttgtctcgcgcacacggcgttcacgacacaaggaggaggagctcacccagccccgccgacgcaaccgccggccgcggcggcgtttccgaccttctcgccggcggtaaggaggagctctccgagcaggccgccaagcgcgccgaggtcgcaaggtatataggcaaacccttcgaaaaccttaacccatgcatcctttcctccggccggccggacaccggccggctggccggagacggagaagacgacgactgagccggcggctgttgcatgtattgcagatcgactcggtggtgaagctgaacgccggtggccggagagcttgttcatgttgccgtaagcgtacgtctcgtgtttgcgtggttttgagcgggaatgagcttgtgagaaaaacaaaaaaaaccaaaaaaattcagtccatctgctggtatatacatatttcatctgttcagtttttcagtacatatatcttgtcaactgtgtatatttgtgcatgtctatatataccctatatacaagtgttcagttgaaatttgcaaattgtgtagatatactccctctgttttttaatagatgacgccgttgactttttctcacatgtttgaccattcgtcttattcaaaaattttatgcaaatgtataagatataaatcacacttaaaatactatgagtgataaaacaactcataacaaaatctatatacctaattaaaaaatacgcaaggtttccggtagtaaatttcgtccgtcctccggtttatccacgcgaacgatccgttttgaccgtccatttaacgagtccgattggaagttgcctcactaaaaatattcatattattaaattttagcaacgccctatgacacaagcatcacaattcccagttggttagccaacgaagcttctgaatggtaggtttggagttctactgccaccaccccttagttttctgctgcttatcctctcttctatttttcctttttctctcctaagctgattatatttttttaaagtacatccatatatttaaaatccatattaaaccaacaatatatgtaatttcttattgtgcttttctacactttatcacctcctcttattaattttttttgaaaagtatgtcctattttttcactactaaaaaaaatcatttgttgccatgaaaaaaatcgtggcatcaatactaaaattgtggtaatagatacatgttgccacaattttaaaatcgttgctagccgtggcaataaatagcgtagtaataggttattgcaacgatttttatttagtgataataaatttagatcttgccacggaatggatgtggcaaaaagtcatattgcaacacttcacatcgttgtgataaacattattgccaccactccatatgtggcattagttttacgtaccaaattaaaacttcaaatattaatctagcatcctatctatttatctatttattttttttatatcgtgtcttggctagaattcgaaccccagacctatccttcatgcgtgctctcctttatcaactcacctaggcatcaattctgttagaaaatacatatcgttccatttaagcctacctaactgagatttgaatcataattttgaatatctaaaagatttcaaatgaaaaacttatcacctacaaaattgtagatatcgttgaaagctataatttccacataaaatttgtctcaatccttgtccatatgaaaaaaattaagttaaattatgagacgataattttttattgtaacgaatttgttgatcgtggcaacaaaaaatagtgaaaagtaccaagtactatgtaaattgccacaaaaattaaaattatggcgatagaacatgttttttgtaacagtacgattttttgtggcgacatcttactttctattgcaacaaaagtactaaataaaacaacgattgtagatcattgcaataaaatataattatttgccacagaaaaattatcattgcaatagtgcaatatattgctacgaattattttttgttgtaataatttggtggcaatagctcaattatcttgtagtgttttttctctcttctaagcttgattatatttttttaaagtacatccatatgtttaaaattaatattaaaccagcaatatttttaatttcccactgtgtttttttaccacctcctcttattaattcatttggaaaagtacgtccatgtgattgcaattaatatgaaaccagtaatatatgtaatttcctactgtgttgttttacgttttatcaccaactttgtatttttttttcattgataacataaggaatatctttcaaatgtcaggatgaaattcatgttaaaccggcatacatacatacatacatatatatatatatatatatatatatatatatatatatatatatatatatatatatatatatataattttctactatatttttctatacattatcatcttttttataaaaaaaaacctagcattttatcatcgataacacaaagaatagttcttacaatttgaaggaacctaatttgatgaaaattctaatgcaatttttttaaaggtatacatataatagcatacattactttttaaatatgtatgatcaaattagatttatgattggctacaatgcaatcctgatcgaattggaatacagatctggtggcttgtctttctcaatgcctaggtggatccttggttatcttcatattagtgttatcattaacaaatttgaattgatattatgtttctcctcacatgataaatcatattcagctttagtaacacaccatttattagttcgaagagatatttgcaattaagtgaagcaagcgctaggagatagcttccatgtgggtcaacatcatgatccatgatatcaaaatactacgcatgcaagaggtcatgaaactaaacaattagttttcccgatgcaacgcacgggcattttttctagtaaattataattacgtaaattttttgaatagacgaatgatcaaacatgtgaaaaaaagtcaacggcgtcatctattaaaaaacggaggtagtatatcttaccagcaatgtgacttcatggcttcatcgactaaaaaaatacagggtttattgaaaatgaacagagtttgcgacatgggcaatatgttacatgcaaaactcacatcttcgggcctgttccctttgatgcaaaaaaaaaaccttaccaaattttgtcattggcatagttgccaaaattttggtagaatttcttatatagttaccaaaatttggagcctgttcactttgatgctaaaaaaaccttaccaaattttggcaattttagcaaatgtgccaaaattttggtaacttgccaaaattttggtaggatttcttatatagttaccaaaatttggcagcaaactaaatgtagccacttttttggcaactttaccaaaatttggtaaggttgaaaatggcatcaaagtgaacaggctcttggtagcaaactaaatgtagccacttttttggtaaatttaccaaaatttggtaaggttgaaaatggcttcaaagtaaacaggcccttcattccctgaagtttacagaagagattcgaattctttgtaagagtacaaattgatggccggaaaaataacgacgaagtcacaacattcaaatactagtattcaactacagtactaaaaatctaagatgtcaggagaagattagtaggcctgaactatgtttcctggaatgagagataagctgctaattgggagatggcgtctgaagatatccaggcatttgagacgctcactggaagtcctacggaaggcatcgctactccactgaattctttgtttcctacgttatagctcatgccatgtggattgacccagattagcttcatatttcgatatgctgtagcactttatctgacattccaaaacaggaacaggatagcacttaaggatcagttcgactaccaccatcctccaagttcctttgctcatttgaagttctaaggttctttccagcaagtgaattcaggaggtattaggttttcgtcgcaggaaattacagccttggcagtaagctttccagccaaaccatggaacagaagacccctggcaccaaggccaccaactagcaaaaactacagttgctcctcttgcctatcacatcattcaaacaacccaacagcggcaatgatccgttggctgtcagtggaggcattgctcttatcccagcccttgcttgtacaaatttccatttagttattcctggataaacagcagaggcttttgggagcagctcttccattgcattgagagcttcatcatcagatacagatgaagaatagttttctgacttccactgccaagtcgacccaatggaaacggtacgaggaccttggaatgccagccaagcatcagataagattgaaggactttgactgccatatgtttctctgcaggaatgaaacacaccaattagataatcccagttgatgctgtaatgacttaagttcaattcttaaacacaaagaatttcccttacattgtatctgatggcaactggaattcagctataactcctcggcatgttctaagaggtagcttatttgtgagttctggaagtgagctagctctagcaccaaggcagataattactgaatcataatcacctgcagatgtttgataggatctttaggttagaagaagtccatactgaagcagcttcagtgaaccatacaagtgttgcattttaacatttttcttaacagaggtctctgaaattaacaattgtaaattgacaagaacaaatctttgcttttgcttcaggagtagacactgtgtgcactttcagtttaatgttaatggaaaagccaaaattgaaagcatggtataacaaggtccatgtttgtccttgctcaatcaggtgattgagcgagaatttacctgccaattgctgtagatcatcgacgtgttcgttgtacagcttgcactctttctgttcgctggatgataatgatgcttcatcagacatattttggcatgcgaagaacaaagcctgcagagcccccaagaatgggtatcaagaatagatgacaaatcattgacaacgagatagcgtgaaggagcacaccacctgtaaatatttcttagggttgatgttcagcgctaatggcatgtaaactgcaaagttcaacggaacacataacccagggatcagacactgtgcctcgtctgaatcaagaacttgaaggctgcaactctggagggaactctgagcattctaacttggataggtcgaagcagtcaagatcgtacaccagaaacaaaaaaggaagcacctgagcatatcagcacaatcttaattcagcagtacctccagcaatatgtcagcagttttctcgcttgtaggcggccgtataattcccctgctcagttcagttaaaccacttctcataatgtgcacacacaaatacagcagcccacaaaagacatgccaaacagaagcaataagtaaatccataacaagtctatctacaaagaacaaggaattgccttctccagataagggtctcatcttggctagctccatctgccccagcggctccattcgcttgctccgcgcaacgcagcagatccatgcataactactg

SEQ ID NO: 74433 - DNA, 18683 bp, Oryza sativa
ggggggggggttggttggtcggtcagctgcgcagatgagtttattgcgttttggagcggctgctaagcttgtgcgtactgacctttatacccttctctttggccaggtgttctactactcgcttttggatgttggaatgtcaggtcactacgctttacttccttgttccaaaaataaatttattttttatccatttcacgtatatttaatataacaagaaaaaaaaatattcttactttattgaatcacaatataattattcttttttatatgctttcaatacaaactgattacttaaaatgaacttatttttaagagaaatgagaggttaaaaataaacttattatgtaatggagggagtcacttttttctaatcttctgcattttggtttagccgccatttagaaaaattggctctcatgttgaggcctttaaaaaattgaaaattttgaatgaagtaagaaaatgatttacaataggaaaatattttatgtttgtataatttgtgatataaaagttaacactgtaagttagactacgataaaagaaactccaaaatcaactctaaattaagttttaaaattcaaatagctaataagccaataaaccgactatgggtgccggaatatttctccattgctgtatacgaaattctgataaaaaaaaacttttacaaattctcgtgtctcattcctgaagagttgttgcatttcagagtcccgtagattttagttaagaaaaacaaatatttttggactcttgtattaaaaaagatcaaccatagtatggtttggtggcaatgttttattttttttctactcatctccaataatctgttcggtacaattgtatttctacttccaactgtcaagtataatctatataaaatattatcccctaaaaaaagtatactattatttgcacagggggggagttagcttcagatatatactactctactatgaattttccgatcttcacgaacttattcttgatacggatacctgcctatttcagcgcgtcaaaacgggggaataaagtcgacttgtccagcttcaattgcgtggagcgtggctgcaaacgatcctctggatttttgtccgacgttatccattcccgttttagcaggcaacgggtggcttttcactcgattcccgacctcgacaccttatcacctgacgtgtgggccatgcacgcacgccggtgtgctctcctgctttgcaccggccggcgagctgccaactccggcgagttttctgctcgctcgagcccgtctgagcaagcgatcgccggccatggcggcggcggcggcggcctcaacagctgcaaaagatcaacatgaagatggcagagcatccaaacaaagtgattaaatcagtacagtacatgattgaagggaaatgtataaagatataagaccataatgaacattggattacattgaacacaacaaaatcgtattgagcacacactctcgagaggtctgtctccctccatccatgtaattaagttggccttcttgcattttagagctctctcgctctgaaccattctattctttatgtatggttttttttcccgtaatcatggatgtttaaaccatctttgtgtctggtttttgatgtatccacatggttcacttcaaaaaagaacttagcacaaacaaaaggagggagagttattcacagctcaggaatggaacacacacacaaactctgcatcctacaaaacaaaatcggcatttccatcaagtatggaaatagtggttcttggtttggttctttactttcccttttcgttttctttgtgtggtatgcaagctagaaggtgttattgtgtcagcacaccaatctgctgcagagctgacttcatgtcatctgtactgtaaccctcaatgccaatgatatttgagctgtccagggcgacgacatcttgtaacggatatctcctgacagtatggattctgttcgcggggatgttgaactcgcccttcaggatgacggtcctgtggagaccacctagcagttcttcataatccgaatcgccactttcaccaacaaggactgcaacatttggcagctctattccccagcgtatacacaagtacctaaatgaacattaggtttggtcagcacaacgggtaacaagataaaacttcatttctgagcaagtgcaaatggttaggtgcacagcacaatgacacacaagaattacagcaagcatccttctactgtgttgtaaacaatgataatttgttcacatcatcgttcattttagcgaatattaaagctggcatgagtttgaaaaggaatcatattgcacattttgttattatctctgtttgaagcaaaatagtatggaactacagacagttttttacttaaaacttcaaaattcactgtttattgaagttaggcaacacaaaatggaaaaatacttctatggtgagttggtataaatgaaggaaagaaaaatgcaaaagaagatgccaaaccttagtgcctgggaacgtgatgcgtgaatgggaactacagagagtctggtggcactgtggttatacaaggcattgcaacggagtgattggattctcatcaatttcctcaactcctttaaagggggtagctacaatgaaaaaaaccacattaaacattcaaaagggaacgtctaaaaaaacattaaacattaatagcacacatcacacacgataaatctgtgtgtcagtgtgtggttggaaggctcacatgatttggattgaccactctaaatgcaagacaataggttgaagagtgttcagggtcttcaaaaataatttgtctttcgattcttccctttctttctaccactgaagtagcccatttcactagatactttcttaggccttctcctccccatcgatactcaatatgtgcttggtgattttgatctattgcaggagtaacctgggaactgcttggcgtatctcccgaatacaaaggataatagatattacttccactattgcagatgaaagcatcaaaaacagtaggcaacatgcctgcagacactagcagcgagcgtatctctgatattgtaagtgaagttgacagcacaaaaccagttgaaccagacattttttctgtgcgtgtgacttcaatagtgtttctgattatccggactagatcttccttgttaacagagtctacagatataacaatgatatgcttccttcctgatatgggtgccttctgttcctgtttgccaccaatagcaggtgatctcggaccaagtgtcaatatccttgacaagtaattcttgcaatgttcaggccatgagaactggtgaatattttttagcccattctctctacatctcgaccaaagttgtttgtcagaaagaagcttatacagtgcatctgcaatggcattctgatcatgtggatcaacaaggagaccattgttcagcacctgcatgaaacatccacaagaaagtaaagtgatttaccccttcagtgcgttgttgtatttttgacatataacatggtagaacatatacacacctgattaatttctacaggagctccattttttgttgcaataataggcaaaccattcatagcagcctgcatatagatataataaactggttatgatttggagtttaggacactgaaaaagttgaacagctggaaaaggcaagttgagctctcaaagttctgacctctattagggtaacaccaaattgttcaaaataagccacattcacaaaagcaccctgcagaagatcaacagatgatcaacaccaaagtaagtgggaaaggaacataaggtactgatgccttctgcctattataccataagaaaaaaaaagatacttcagttttaaaaatcaagaaaacaatctttgtttcagcaaaaacattgcttaaaaaaattgcaacatggggttcttctgcaaagcgacgtaggagaaaaaaagaagaaacaagagcccaccccatttcacaatatctgtccattcaaagttgcgccacagaccaaggagggactaaatctatttaaaaaaagctaatgtaaaatgaccatatgtacccccttttaaatgctatctacagccaattatccacttttttactgaatcaaatagagctggagtgtggaaatcttgcaatctcaatttcttcaatgggcaaggcacacattgtggtaaaaggtggaatggagggagtacattgaatggtagatttcaaccaagaacacttacagaacataaaagcagcataaaaaaactaaaacatagaaaagtttctttgctttatttcaggaatagcatacctttgtcctggcagctaaacgataaatgtctggaacttcagagtgcttatgatgcttgggataagccacttgaccatacaagtcatattcatcaatcaatgtaagcactgaggtcaagacagcagcactcatgttgttcatcttagaaatggcctcacggttacccattatcagtgtctgcaatgcataataaaattagcacctaatagtctaggaaatatatatcattttgtacactatacaatatgattatgacattacagagaaccaaaccacagaacatcgagatggtttaagtccaatcttaccagatttgctagctcccttagagggcgacattcaccaaatgcctttacaagtgatgtaatattcttttcaggatatggacgagcaacagccagaatcataggcttcctaggatttgtaaagaagcgcattatctgtcatcagttgcacatgtacagattatcagtgatcaaactcaggtacaggtttaacaggcagaacaaactatcctcaataagacaagaaatactgaataaaggttatactagtaactgagatctctgtaggattctaaaggaagtgcagtgacctgagaccaaatgggtgggtcctcagaggctggacatggattttcttcttcaccatccatttcaaaatcgtgaatgatatgaccaaattcaacaccaggaggtattatctgaaaaatcaggaataggaaagcaataaacattaggggttattgacgatgcttgcaactacagctaggcagctggtgctaatgccaaaagccctaaggtgtaacatatactttcccaataatttagaaattgttgtgcaaggggaggaaaatgtgtatactcacaaccatacgaggcatataacggccatagcagttagcaccacgcttaactcttgcccgaagcttccttgcaagtataacctcaaaaccatcatacaagttccactgctcttctatctcctgtctagtgctagcaataacaatttcagatgcatcaagagataattcctctgcctcaattcggcacattattttgtatgtcatatttatttgttcccttgaatgtcgcccttgcttgagaagcccttccaatttgtccttaccaagaaaatggcctgtaaatgccataggaatattaagagacccagacaacagagcagcagctattcctgcactggcatagtgtccatgaatcacagcaggccatactggatgcccacagccaatttcttcaccaatggtttttgacatccgcacgatatggccaagtgcaccatcaacaaattcttgaatgaaaggccatagatgttctttagctaggtatttgtcttttggtccaaatggtatccgaatgatgtatgcaccactgttctcacccttttcctgtttagaatttttaaagcttgttgaaaccaacatttctgtaggttcaccataactacgatcgaaatttggtgccaagatttgtcttgtcagcaaatcaaccctgtaaactccaggagatgaactcaacgctttagcaagttcaaccacatatttgacctacaaaatggtatgtgaatatatatttaagaacttgttggaacttctgctatgagaaaaatctcagtagataaactagaaatggaaatagagaaaaggtctgtaaatctgtcatacactaacagataatgcaaaaggccttagttttctcaggaaaaagtgtaaaagtactagaaattaccaccaaaaaggaaaagaacatctacccctacccccaccctgaccccccacaaaaaaaaatgtccagtgggccataacaaccattggatattagaacctaactcaaaatttaagactgcatcctaaacataaaaggattcaaattaaaatacactcaagtaaattttgagttgaaaatattagaatgtcagtatacataatagtatttgtagtcccagtatgatatagtcataaataaatttgtgttgccagagattgggatcccatgtgcacaatcatgatatagtagcagcattacctggccaccagtatctgaatctcgtcctagctccatgttctcaccacggaccagaccatgtaggctgcagtacgaagcatgaactgattaatgaacattacaaattggcttcaaggatagagtaacagacaccgtttccacgtgagcatggattataaaatcaacatggaaaattttggtcggctgcccattatgaagctgttcaaaagatgtatgattgtttgttaaacatgtgatacatttatatcttgtcaattctaagttgtggctcttgttctttcaacagtagcaacagactgcccaaaagctaaggaaatagacacataaatatataatataatataaactctgcaacagaatcagatgcagaaacaaaatgcatgctaaaatagcagcgtcgatccactctttcctaaaaaggcatgcaaagtgcgcaaaatgataatgaggtcatcctactagagccagtattcattgtataccacttcaagcttgtgaatacctaaatagacagaggaatgcaaaatgcacgagcattacacttggactagaaggaatcaaggaaatctacagaatcagggcatcaaagctagataatgctttggacttcgtttcttttcatgtgcctagaagcccagaacaggagagagttcttcagtgtcatggacatggccaaataaatgtcatgataaacaagaatactgccatctcgttatttgaaattactgcttcatttgtcggattttctttgaattattcttatagtacagaatgatgaggaactcggctgcagtttactcaggaagtatggagaagttcctaataaaaaagaaagaaaaatcgacacagatagcagctactactattaccttaagaaatttgactaaagtagtttgattaaattgaatttttcgtcctgatgttatgctgaatgattcacaaatggtaaaaaaaaagggttacttaaaataatactttgtaccttatcagtactatgtatagcttgtcaattgaactcgtcttaggtgagctccctgtggtgctgtcaccatacgcaactgagggatcaccagcatcttctcccttttctccttcaaatagatcttcagacatatctgcattagtatcagttcgtaatttctcagcttctggttggcgtttcaacagacgacaggcttcttctttctcgaactgcatgtaagaacatctgaacatgtatatgacaagcgaaggacaaaatacaatggtacagaataggtacaactccaacatcagtctttcaggcaagaatatttgtacatgttggtatagccaattatattacaacacgaaaggtaggtagatgctgaaaagaataaaaatgaaacattcattgaactgggaaaccaagggttgactaagacttccatgcaaaagtacttccaaaacagatggactagccaaaacaggatacgttgcgtcatgaggacaaagtaatagccaggcagagctaagagcttaagaaatagacaaaatggatgatggaacaggatgcgttatattgtgccaggcatgtaccatcaggtcgagttgctattcatatattacatttgtttgcagcctttgctttcatatgtatgaattaccaagtgatacaattcaggcactcacattgtacttagcaatatgacaaaatttaaagcttctaagattgtagcacgaggcacgatgacataaacagtagcaagagatactctctatcgtaatacctcaaacaaaagatgcagcaaaacaaatgacttcattcacattctacctagaacgttaggggtcaaaatggaacaaacacataaaggcttatcaattgtagtgtaatgacatagcggtcacaagagtattctaaacaactgaagcaatagaagcaacaaagcaatccagcattctctgcgtgctgcccgcatttgttcagtaactcggctcaatgtcttctaaaagtcttatcatagatgacgaaacaactctctgtaataaagcaatgccaagcaggcaaagcatccttcctaaataaaccaagagctttgttaattatcccctctgaacagatccagcaccatctaagcaagtaactatcacatacgccacactttatcaattcatccattagaatcaaaattacaccgagtcactggctgagctctctgcaacctacgcacactatcatcatcatcatcatcatcatcatcatcgaagggaacggagcgaagagctcacctccttcttcttcctcgcgaggttccagatcctccacgtcatgttctccagccgcgtgttcctctcctgcgggctccgcatcgcgttcgcctgcgccgcacacgcacacgcacacagatcgatccaccgatcgatcgatcaatcaaacaaacccaacggggaggagagcgcggaagcggaattagaggtggggggagggagggagggagggaggggggagccacgcacgcggagccatgtcttgtagaggtcggtctcgtcgtacccggtgatgacctcctcgacgaagtagcgcgccggggagaagtggccgcgctcccggaggaggagcgaggggcggtcgccgccgattgccgccttgccggcgtcgaggatggcgtcgaggtaactgtttatccagttgtcgttgcccgccatgccgccgccgccgccgtggagatcccggcgagatcgtggagggggagaggagtgagcggaggagtggaggcgaagccaagggaagggaaggaagaggaggaaaaggagaggagaaggagcaagtgcggagaaatggcgaagcataataattaaaaaatgcgtccgatttggggttttttttattattaaggagaaagaaaaggtggcctcgtaatggaatgagtaataataaattagtgcctgtgtaaatccattgtcaaaattttttaccatatcacatcaaatattttgacacatgcatagagtattaaatataggtttaaaaaactaattacacagattgcgtgtaaaatgcgggacgaatcttttagacctaattgcttcgtgatatggcaatgtggtgctacattaaacatttgctaacgacggattaattaggcttaataaattcgtctcgtagtttataggcggaatctgtaatttgttttgttattagtctgtgtttaatactttaaatatgtgtccatatatttgatgtgacacgccagaactttttacccctagatctaaacacagccttagtggactgatgatgaaataaatagttgtttaattctatatataaaaaatattcaaacaaatcttgcttttttaaaaaaaaactttgtttttcagggtggatttgtccatcttttccaaagggcaatcaaattccattcagattttggacaggctaccatcaaagttaggtgagcccttcgaaaaaaaatactaaattagtaagcagtactgacgccatttctaaatttaagtgcaatttcgagggaatatcatggtttgtgaaataaaaaaagataataagagggagcacgtttggtccaattcttctttgagaccatcatgtgtagcttaacaatttggcccaactctaaaatagacatgccaagtttgaggtcgttttgggccttaacgttttcactcttttgcattcggtatttttaccacggtttggttattgaaggatgtagtaataaattacattgtccgaatagtcaagtcaaatcaacgtatgattgacagaacgagaaccgtgtcaatggaattcaatactacctccgtccaaaaataaatgcagccatagatatctgtgcccaacgtttgaccatccatcttatttaaaaaatttgtgaaaaaattgaaaatatttagtcacacataaagtattattcatgttttatcatctaatagcaataaaaatactaattataaaaaaaattcaaataagacgaacggtcaaacgttgaacgtgaatagtgtaaaactacacttattttgggacgggggaatagttttttttgggtgtgtgttttaagggcaagaatgacgatgtggtgtcaccatttggaaaaagatgtcacgtagagcttttatgacgacgaagaaagagaaagatgccacctagagtattaattaccccctccctccatcctgtaatataagagcgagtataatagtagactataaaccggctaaatactgaggtggaggagaaatagaggagaagcgggttgtcaacttacagccggcttggacacaaaaacaaagaaactctgtgagagagacaagtgggccatatattaattgtaaagagctattccctccgtccaaaaaaaagacaaaccctagtttccgtgcccaacgtttgaccgtccgtcttatttgaaaaaattatgaaaaaaattaaaaagacaagtcacgcataaaatattaatcatgttttatcatctaagaacaataaaaatacgaattataaaaaaatttcatataagacggacagtcaaagttggacacggaaacccagggtttgccttttttttggaccttagggcagtcccaaacctccaactaggatggtgtctatagcattaactatattgccatgtaggacttttaacttatgtggcactatattaattaagagagagagtgaagagaggaagaaactgggtctcatgcaagacacagcttcaacacgagaacctatgcgccaggctcttcaatagattgaaccgcaagaatacccacgatttttcggatcgggaaatgggtcgaaccgcgcgaaatggtcgcctcggaatacagggcgcaacgaaaccaaggttctttgttggcgtgttgcgaaagccatatgaaccgctatttagtccttgaataaagaaaggtagtaatttcatctagttgcattccatcgaactaaggtgggattgaagaaaggggtcttcaacttatcttgagccatcagtcagattaaaagcagcgccctgccgccagctcctgacctctgttcctatgggaaaaagcattttggagatttgctcagttgataccgaatttgaagataagcccttcccccgaacaggctttttatttggtgggtaacatcgatgaagctagcacgaaagcgacactattaagttttgcattgggagataatagtgtcttcataatagataaagaataaatattattggtagagaagagagatgttgtatttattaatggtccactttaagaaaccatgggttgtggagtatagtttctattgtgatgtcttattaacatagcaccatagacactacttatggacactatgggttgggactgcccttatagctaacaagctgagagaaggctacaaataaccttatagccaacaggtcggttgtattattagccttgttctaagggataatggatggatgtgatacattctagtacaatgaatttgaacagataagatacatttatccattatctcttatattatgggacagagggagtaacatatagcttaatatcatattatcacatatagtcaaaatcattatttcgtggcacctaaatttacgctttctgctagaggacaccataagaatgtgtttatactataggacactataaaaatatgttaattaactgttgaacacttacgatattattttattatatgcagaagaaattgagcgagaaacaacgacgaaaatacgaatctccacttgtggtcgggcaaccggcttgcctagccttcgtggtgctgtggcgaagcaggaggtgtgtctccgccatggcaccatctctcaagcccgtgtccatggcagcggctcgcggcatgctcgacaaaggagccctgctggccctaacccccgcgacgtcgcctccaacttcgagataaccaaacctcaccgtcgatctgttgatataaaaacacgagatatgagagatctgcttaactccagtgtatgtccaaaagcttgtctttagtgtaggtgtaaaaacttgtctttagctaaaacttcttaccatattgttattatgttatactctatgcatacataaaaagttgacgtggagttatttcgttggatcagccattcagtgtcaaattagatctcataaactttctttattgcgattggatcccataaactttgttttattaacagtaattttcataaaaccaagttatatacaaaaccacaacgattttatcgtgggacacataacttcagatattataatcccgtttgaatccgatgaatatgaagattaagtacagccacgcaaaataaatcattaacacataattaattgagtttaaattaattcaaacctaaaaagggctttatctcatattttaaaatttttaataaatctatatgattttatacaacttagcgtagataaaatttacacttctattaattgatcatcccctgaaaccaacaggtggcaatattctcacgtgtcccatggtatcattttttctgaacgaaactgttcctatcattatccttatttcacgtactgttctcaaatgcgcaactacaaaagtatcccacttaaaaggcaaacagatgcgtctaaaggacacgttttaagtcttacctggattatccatttattcttctacctaaaagttgatgatttcttcatgagatttaaggcaaatatatgaattatgtccacttcatttttttattggctcaattctgtcaattttcgataaacaatgaacaaacattttgtgcgaatatagccaacgtgtcagcccatcagtccttttcatgctgtgtaaagtgattcttacacacgcggctgtgtttagttccttccaaagttagaagtttgggttgaaattggtacgatgtgactgaaaagttatgtgtgtatgacaaattgatgtgatggaaaaagttaaaagtttgaatctaaagtttggatctaaacacagccgaaaaagtaaaagggaataaaggcaactagagatatatgcttagttaaatatatctttttggtgcctggattccttgtttggtacacgatgactcatcattatatttagcttaactaaataacaatcaaaacctaataggagaatcttgtttgtcgatcgtaatgtttatcttgaaacttgattaaaaacataacttaggtgtaatgttagagtctccagatcctttttgtccatgccatgagtctaaaacaaattgaagttttcaaagaaacatcacttggcccttttaactccctttaatttgccatcataacattaattagtttgttaattttttgtgcaattgtaagaggatgtttggttgccagccatagtttaccacgtctaaggttagacagatttgatcatattggtagttgtttggttgtagtcacaattgtggcaaaattcttttccaataaattgagtccacatgtcattaacttagggaagtgtgacatgattctcttagacttgctaaggtgtggttaacaatttgatcgcctaacttaagcaagtgtgatagtatttattgacaaatggtggtaaaatatggctaagaaccaaacacaccttaaatttcaatgagtttaaatatagttaaagacgttaagtacaattaatagggcaagttatagtcagaacaaactcaaaaacggtaatttaagaacatagaagcaaggactcctggttgctgaaaatgatccttgctttgttacgtgaatactccatcagtatatatatgacactatcaactttatttggttaaaatttttaaactttaatcatcattttattttgattaacaatttattgtttggaattgttcttctgcttaattaacctagatgacaggtaaatgaatggtgacgacaatagccttcaacatttcagggtgactatactttttagtcatagacaattatagtgcttatatatggaagatttatctctgttcttgaggagataccgtgagtaccgtgcagggggaacagttaaaaaaactagatgaatatgatttgtgattattattatattcgatgatacaaatgaatgagttaaccattacaaaggtgaaaaattgtttcaaaagggtattgtaaaaaaaaatagtatacaaagtagctcgtccgagaagcacttaagccttataaaccctaaagaacaaacttgaatactagcactaaactacaaatttacaaaaccaacactgttcctttacagctgggagctagctagaagcaatgcctggtctcaaccataggagaacctatgtgtgtcctgcaatggcctgaaagagataaggggaccaatagcacagtgcatgcatgcaaatgaaatataatgcaatgcaggcaatcaggaaggtaccatccatccatccatctgaaaacgatgagaaacctgactccaaattcacagaaccacacgtagaaagatctgcataattaagcaagcaggcatgcaagatgtttttctactatttgtgttttgaattattgtggcctgagtttccatggcatcatcccctcttatccatccaagatcacattgtatggcgcttggcgtttttcgccgatcgatctcttaattctctgcatcctgatcttttcccttctcagattggaggttggtagtttcagacaatggtagtatgattgattgggacaatcatctgttcaatggtcctagctgaacttcttgttcagatgaagctattagggcacccataatagttatctataggctctctacaagaaatccatgtcagcatatttttctacatggaagatattaaatgaagagagagagagcaaagctatctactaagttagagatagtctatagagaaaaacgaggcaatgcatgagagagctatagatacccatgtagatatactattgaggcggtttactattaatctagtctattgctgagatgtacatgttttatagatagcaccttactttaccattgcgggtgctcttaagctagaagatttgtgattttttgtgcagttcaatggcgttcaattcaagctatgtattattgtagccagcgaggaattttacgcatttcgaaaagttcatctcatcggaatctgtatatgtgcccttttccatgttggaatatgttcttggcaagacgagaatattgaaaaggtgaagctcactgggttgttaagaacctaagctagctaaggttaatcattgtggcagggagaagaagacaaagcgaccagttgagctgtggttgtcagctactattgttccttcagagaattcagagttcaggcatgctgttcttgatgattaatttcaggcatggaatgatggaaatctaatttactcatgtgaagtaacagtgcagttatgaccgaacttcagaaactaaattgtctggtctagatatataagtatacatggtggattttgtgatgataatgtgatgcaattgttgtttcatttaatttggtattcccaggttgtaatttactagttgattttatatttgtagcagtgacactacgaatctacagaatttacatgtcactttcaaattcttatacaagtctctgaatctctctcttttttttttgtataaaaaggatcactgtcaggaagactggaagagtatcttacctaccattgcattaggagcatcaagaaaactgaaaagacatcgtattgtacaaaaataacaatggaataattcataccaaacctgtgtgatcatatcgaaaagaaatcttattatacaaataataataatggaagaattcatactcaatttgtgtgatcatatcatatatactatgtacgtttaagcttagtagacttcagtgattaattgatgatctgtacgataaatttcgtctaaaatctacctaattggcagtactgttgaaatttagtgacgattacggcaaaaaaaaaatcatcaatacacgagaaatggatgaaattactgcataacaaactcgtctgtttttttttggaacaaccaaattagacaggtcatctcattggcgaaaagcttaagaacacaaacaaccggagtctcatcggttgcccatattccctaataagccagaataaaaattaatttacagggaaaacttttacatatttgtttatagcgacttaaaagccaacgctaaaaagaaattacgttgaaaatatcctaaaatcaagtttaaaatcaaatttaaaaaaaaataaattttagcttttgttttgacttattaggacaactgatgcggctcgtggtgattttttctggtgtggttggtgtggagaaatcacttcgcagagacaaccacctcgcttttgacatgatcaatcgatgatttgctgatgaaacagtgctggtttttttcccccgaaaggtgatggttaccgttgcaattgtagagtagagatggatacatagccacatggcgtggacaacgattcttcgcgtgatataaaccgcaaactgtcgatatcactccatggtcccttccatggtgaatgtgatgtcgctgccatagtcgatctatttttctctggaaaatctgagtattattgttacaaatgaaagtttttattttaaaaataaaagtgttttatatcttcggctttttaagtatgctttatagtctaattaatcgatttggaaaaatccaaaaaatatcattaacaagatccgatttttaaaaaattgtcatcgatgagtataaattttatgaaatccattgtactgtcctagaaatgccacggtgttatggttccattagcaacctctgttaagtgctataggataaacaatgcatttaatggtacgagatagatggaaccctaatggtgatggtattttgaaacaaaatcgcttgtacaatgatattttatgaaacttgcacccgtcgatggtatttcttgaatttgggtgtttgtcaatgacattttttggattttctcgattgattttgtgacaacatgttctttttagctaacagataacaaataaccacgaacatattttttaacgaatgtgatgatgttttttttaagaaaaactttctttatcaatatttcttcataaactctttgattcgatcttttgatttttctaatatttaactatttatttgcgccatcaagtaattttcataacatagtttcatccttcggcatttcagaacacaacttgagttgttctgatatcttgtttttatcaaaaaccttgctttaaatactttctccatcctgaatatagtaatttctggcatccaaaatttatataaaaaaagtataacaacttatataccaactctctcatcttaacccaccacatccatctctcattaatttatctacatgctttattgtctcagctgatcacaaccataactgatttagtttcacctttctctacaatctcaacgaaaactctaaaaatatcttctctgtcccaaaatagtatagacatgccccacaatcaggttcgtagtattattttgcgtctaatctaacactatatcaatattgttatattttaagacggaagaatacctatattttataatggagagatacattatattttacagcctaacaaaactaaaaaaaacaacttgatttgttgcaataaaaaattctactgtaatttttacaatatattgttaggataaaaaaaaccattttgcaataaatccacttttttgataaaaaccaaaggatgtcatgtcagttaaagctgaattagtaattttctgctgcttacaacagctcaagccaccaagaaaatccccaaaataccctccctctccctctccctctcacgcagctcgctgcctcactctgctgcgtactcctcttgctccgctcggcgcctctcctctcctcgcgtcccctctcctccattctcatccacctcctctctctctctctctctctctctctctctctctctctctctctctctctgcgatccgaggcgcgaattgtgaggagagggggggagcttagctgcggagatggcggcggcggcgatactgccggagctggcggcgcaggtggtgatcccggtggcagcggcggtggggatcgcgttcgcggtgctgcagtgggcgctcgtctccaaggtgaagctcacggcggagccgcggcgcggggaggcggggggcgccgccggggggaagagcgggccgagcgactacctcatcgaggaggaggaggggctcaacgaccacaacgtcgtctccaagtgcgccgagatccagaccgccatctccgaaggtgagcagagcaaccctctctctctctctctctctctctctctctctct

SEQ ID NO: 74434 - DNA, 535 bp, Oryza sativa
atatatactcctcctgctgctgttttatgtcaatcatgcaaattctgtacccttgctgctgctgttttttaaatttgcatgattgattcagtggttatatacctctacacttgttctttttttatgcataaaaacagattttctgcacttgctcttttgatgttatgattttctctttttatcccttcatgccaatgattgtaattgatgcatatttctcaacaaaactgaggccatatctttcatagtataccccgtattacattggatctaatgctatttaatctaatgggaggaaatttataatctttttcgggaaagttaaaccatgttaacgcccggggcaaacccgccctccccaacacctgcgaggatccaggaagaagcaaacccagccacagaggcggttgccgaaggtcatcccgcgaccacggggggccaacaacccgaaattcatggtaatttataggataaattttcaccacataaccacataaattttagctagcaccccttagcaaatattgccttctgt

SEQ ID NO: 74435 - DNA, 6938 bp, Oryza sativa
gaatccgtgggaatgacgggcgcaaaaccggctagggatcgggctccggcggcgcggcggccggaggtaagggaaggacctgacaggtggggccccacctgtcagcctccggaaaagaggggcgcgcgggcgcggaccacggcttgggcccagctgggccgagcgcgggagagagagaaaggagggaggagttgggccgaaatcggcccaacggcctaggaggggagattttgaacttttttgaataaaacaatttgtaaaatgttgtttcaattattaaaaatacttcccttgctcaaataattcccagaaaattctagaaaatagaggagcaagcatagtatttaataaaattttatctagctcatttttatgttggaaattttcctagaaaattagggtttagcttgtaggcttttaaaataatttctaaaaattccaattaaacaccaatttaaatatttaggatttttgggatgtgacatgccatacggtagggtcgcttgtacagaggagtggttcctggagcaagatctatccggaactcaatctctcgcttgggcggcataccgggtagttcttccggaaacacgtctccgaactccctgactatggggatttctgacagtccgatctgatgcagttctgaacttctgacagaagttgggggtgcaaagaaaacaacaggttgttccggccctcggtacagagtgacagtgcgtctcgcgcattccactactccttggaattgagccaaccaattcatcccaaggatcacatccaagttcttggtgtctagcagaatcagatccgaggggaaaggaatcccctgaatttctataggaacggcagggctataatactttgctgtcataacccctccaggagtggtgatgagcagggggttcctaagcctttctacccccaactgatttctccccacgaatggcacagatataaaagagtgggaagctccagagtcgaacaaaatggtagcagggatggaatgaatgaggaacgtaccaactatgacgtctggagttgtcagcacgtcctcggccgtcacatggttcacacgaccccgaatgacatccttcccaccgttgttggagcggggaggcgcttggccttgctgacgcctcggctttgggcatttatccgcaaagtgcccgggctcgaagcagttgtagcacagacgctgcggaccttgagcgtccctgcggccttgaccagactgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctgggtagggattggtgtagcggaccctttggttagcaccctgttgattgcggaaattcgccaagcggcgcttgtgcgactccagctccttgtgcttggcttccaagcggatgctcttgtccaccagacgttggaagtccgggtagtccccggagactagatggacggacagctcagggtccattcctgccaagaacttctcttgcttctcctcatcttcccgcacatcctccggggcataacgggccaggttgttgaactcatgcaaatactccatcacggagcggttgccttgcttcaactctcggaattcccttttcttaagagccacgactccggcgggcacatgggtcctccggaaagcggcggtgaaacgggcccaagtaataggctgcccctctggctgcgtagcctggaaatggtcccaccatagagatgcgggcccctgcagctggtgggcggcgaagatgactttctcctcatcgctgcactgcacggtgtctagctttttccccacggcatgcaaccaaaccaacgcatccacagggttgttggagctagagaaggtgggtgggcggatgcggaggaactcggcgagtttagagtgttggggaggtggtgggggagcattatgttgtggcggattttggaggtggtggaggaaagccgtcatcatgttggcttgctgtgcgaggatttgggtgagaatggcgttggtatctggtggtggtggtggaggcggaggaggaggtggaggtgggttgccctggtggttgtggttgctgccttcgggttggttgccatcaccggtattagcatttctcctggtcgtcaccatctgaaaaccccacacagaccagcaaacagagagagctgacaattaaaactaaccacccacgacttccataattcttgaatttattactgctattaaattggttcattaaagttcaagttgcttaggcaaataaaataaagacaggctccgacatagttatgccacacactggcataaccatgcctcacacaactccaacaagaagacaaacgagaaagaacacacgcgcaagcctactaactgctcgtctaccgctgcgacgggccagggcggaaggtgagcaacagcgcatcctccgtgctaccaacgccggaggcttccccctcctggggaaccacgggcgcgggctcggcacgaggggtctcgacgaagcaagaccacaccagggactgacgaacaagctcgggcctggaggtgctcttgcgggcggtgatcttctggctgcggcagacgcggcgacgcttggggcggcagacctccccctgggcgatcttgagctgatgcagctgcgcctccaccgcgtctaggtccttcttgagctgcaggttctcctgacgcagctctaggattttcaagttgttctcgaccatcccacggcgcaccatctgatggaagtcgatacgagccgcgtcgtacgcctccaccatgcgcgctaggtgcacgatggtagcgtcatcctccgagctagcatcccggaaggtggcgtagtcacgggctcctccgcgacgagggtggtagcggtagggcgagtgctgcaactcgtccaggtagcgctggtgaagagtgccgatggcgaggagtgcggcgctctggcaggcggctgggaaggaatctccacccgcggtgactgccagcgaagtccgctagggagagccagagaggatcactgcagtgacctcccaaccagcatggggctctgcatcgtcaccctcctgctccggaagcggcctggcctggtagtccactccatgtggataccccaggacaatgcacatgccccgcagctccaagacgaagccagtcatgtccaaaccacgatgggtgacgctgccggccatctaaaaaaaacaaaaaagaaaaacaacattttagagatcagattttggcgataaatgaagcagcaagacagagagagactagaggattttcacaaataacaaaggatttttatttcgaaaatactgctaaggcttgggatctacggctcgtcctagggtcaagggggctttgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcgacgaaggcacagcacacacaaagacaaacgagaagcagcggaagactagggcgacgaccacaggcgcttgacggcaggcacgagctagacaccgaagccttcatcaaccaggaactcctcttctggggttgggaaaaattgagcaagactgagtacaaccaccgtactcaacaagacacacccacaagtgcggaataaatgcaagggagtacaaaggagtcatactataaaggggtagggttgcagtaaacagcatttaaagacatttagttgcccaagttattttgtaaacacgattctagtactatacaatgttattaatcaaggccgtgaacccacacgaacctgccttaacccaaggcctatgatgattcggaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctggccatagacaagagtaccgaccaaatcccacctacggccggaacccccgggacaggcaggcaggactgagcccctagcagcaggacaccggccctgtgccatgacatctcgactatcgggccacagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggtcgaggtgctactatcaaaaccatgcaccccgagcccagcctaaaaccattttggggattttgaatagagggggcggtgtgaagctaattccacagtaaccaaaccattccatagtgaccaggtgatatgaatattcccaaagtctagggttgaaaaaccacctaatgttacctagttaaaagcgaagcatctacctaaaatcatactagggataccataagtagagtgtccactagttggggttttgtttattctagggtgaacaagggaataataacaataacaataataataaggtcataacaaaggtaaataggcatggctaaataaaacagtgataacgcgggaatttaaataaagcgataatgcaataatttaaatcaacataattttacaaactggggttcaatatgttcaaagatgatgtgacttgccttgctcgctttcccaaacgtcggcttcgacttccacgaagagcgggtcttccgaagctgcagcgtctacacgaccaacggaaaagaaaaggctattactctaataaactccatataacaagcagaaacaaagcacaaaaatgggttcttgactccttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagtcgggagagagggcgcgcggaccgggtccacgggagtggggcccacgcggcagcctcacggtccacggtggaccgggtgcacgcgtcttgcgccggccggcggcgtgggtcccacgcgtcagccgcacccgagggcgcgggcggctgacggccgggcccacctggcagccgcggggcgcgcccgaaggcggcctcgccggcacggccgacgggaggcggcgcgcccgcgcccctatggtcgccggcggcggccatatgcacggcggagcggcggccgagagaggggagggaagggggaaacgaaatggcggtcctcggctcaccccgggtcgacggcgacgacgggaacggcgaccgaagcggagagaggcggcggcgcggctcgggtcgacgaggacggcggtgctccggcggtcggcgggcgaaacggaggagtggacgaggtcgacgagaacgcggcgaagccgaaggaggcgatgccgaagcgggaggaggtccggggcgacgacggcggcgaaccggagctcggtggcgacggcggagagagaggacgacggcgcgggctcgattccgacggggagagacagcggcgagtggcggaaacggaggagggaggcacggggagcgtttaaatagggacgggagtgagagagagcgggcggatgagggggaatcggccgcagaagatccggccgccattgatgcgccggcgaagttcgcgggagtaaatccgaacgaatccgagggagagagagagggaaaagtggggggaaagagggagggaatcacggggagtgatttccccctctttatggcgcgcggggacggcgggatgcgacggattcggcggcggcggcggcgctagggcacgggcgggcggcgggagcggcgcgaggtaggggatgacgggtgggccccacccgtcagcgagggtggcgggcgggcccgctcgtcagcggcgcgcgcgcgggggaaggccgatgggccgcgggggagaggagacagagggagggagctgggccgagccggcccaagaagggaaggggggaaaagaagactttttagggtttttttttttataaaaccattttaactttgtttatttcttctcaattattatttgtgctctgaaaattccactaaaatttatttacgcattttaggtttttaggaaatatacaaaaatcctccaagccttatttgacttttaaatttgcacattttaattgttggaggctttcacatggattttaattattctcggcataattttgaggatgtattttagagtcgttttgggacgcgacattacgttcagcagatctcgaggatgcccttgcgacccaagatcgtcgtatccaatattggaagacgaattttgaagtggcggaactcgagagagcaatgctgtccgtaaagaaagatcaagctgtggaaacgctccgaggccgcgaggtgtggttctcgtcttatctgaagagttgttgcacctcgatggccagggtgtgccgggagttagccgtttgagttgtacactctccctagccctcagccttgtcgtcggagggatgtcctcgggtgacaaggcttctggacccttggcctgtcttggttgaataagctctgatcttagcctccagccgtg

SEQ ID NO: 74436 - DNA, 1826 bp, Oryza sativa
ctgttctcccactgtgtgctactgccgccgccgcgtcgtggatttgtcgcgtggggtgaagtttttgggcttttgtgtgtcgctgacggggtggggcccactccgggttggtcccacgtgtctgtcgccgtgtggcgggggtctaatcgtgcgggcgtttttttgtgcaggtctctcgccgttgatgccgccgccgccgctcgccgccccggttcccgcggcggtttctccggccccggcgacgcctcccgccgtcctctccccccgcaagctcctccgcccgcaaggtaaaagcaagcttcctatccccgattccctcggcgatgcttatctcgccgtccgattgaccgatcggacggctgctgcttggcccacgcggccggcgctttctccgacaagcctctgacgcaggccgtgggggccagaggggggggagcctgatatgtggggtccacggagacgcctcctgttttgtcctcggagacgagacgatccctttggcgcgccatgattccgtcgccctcacattccattctgtcgtatcggagcatgacatgtgggcccgtgtctgcggtgctctcagtttttcgtcgccgcatgcatgcagtgactgaccggtggggcccgcttgctttcaccctttttgcaggcgcggacgtcgtcggcgtcggtttcgtctccggcagcggcggcggaggaggaggagacggagtacggacgcgccgggtggacgacgggtgcgcgggggcggacgacatcgcgatctaccaggggagggcgacgccgctgccgagcggggtgccggcgtacacggtggacgtgatgaaccggtgcgccggcggcggcggcggcaacaaggagtgccccatcgcggggatccacgtgcggtgcgggtggttcagctcggtgagcctggtggacccgcgcgtgttccgccggctcggccacgacaactgcctcctcaacgacggccgcccgttcctcgccggcgagaccgtttccttcgagtacaccaactccttcccctacaagctctccgtttccgtcgcaacctgcgtcgtcaaccccgccgccccatagccgccgtcaatcgccgcaaggaaaaggtgcacaaaacaaaggaaccgaaagagaaacggtggtactagtgacatctcttgccttactagtttttttgttcatttctttttttttgaccccgtgtcagtatcactcacagaacaacagctcaccatttgctacgcctcacgcagtgcgtactcctccaacatgtttgaaaccctcattatactactactagacctgcagtatagcgttagcagtagttcctgcttcttgcatgcagcttaatgttgttgttaagttgcctgtcaggcagaccaaagtgtaattaaccctgttttactcaaatctctcgggtggttttggcgcggatggaacaagtttatttttgtcactctttggttgtgcttccctctcgtggtactgtgctttgaggtggtggttggttgtagcaaaaccgggaatgaatcaggtcacgtgtaagtacaatcggtgcatgcatgggtgacagctcgtcggaagtggaattaattgcacttttgaggctaaaatggaatcttctctttctctccccccctctggctcgtctcaggcccgggtcaagttaacaactgtagacatgtccttcaaccttcgcccttcgtcttgttgcttctgctacgattgcaggtttgctacactgttcgttgcagcaacaaagcatgcatgcttgcttgctttctccttttggctcaagcttttgcatgtggtttggcccctgtgct

SEQ ID NO: 74437 - DNA, 7873 bp, Oryza sativa
taggatatggcggatatcgagtggaatttcctctcctcgtggtgatcacctttacattttctaaggaaggttcgggttgccccgaaatccttcccgtctccttagcaggaactagtgcggctagctgcgcttgctgagtttctatcattttattaaacctcagctggttttggaaagcggcagcaaagccttctaacttaacatttatattttccaggattttatcattggtggcaagcttttttttatggcatccatggttttagcttgcgcaaagactaaatccttcaaggagggctgattaaagttaccgttattgccgttgttgcctccttggtagaaccggggaggggggggggctggttccacccttaacgatagccattgttccccatgaacatggcttcttcacgagtctcggggtagtcattccccatgtgtccggtgtttccgcagacctcgcaagtgatatgtgaatccaatgctttgacggcagcctgtggtttgcctttctcctgattgtctagcttcttcactaggaggtccaactttgtggtcagcatttccgtctccttgacggtatgcatgccacgttgacgggtctggagtcgttcttcgctccagcccatagtcggtaccatcttctcaaaaagatcaatggccgctcggaccgtctttgagaagaatgcaccaccagcatagcatcgaggtgatccctggatgagggagtccattgtagaaactctgtaggatgagccagtcgtccatcccatgatgaggacagcggccacgtattcctgcaaatgttatcatgctacgggaatcgtctcatctctggtctgctggaaacttgatatccttccatgaagggcatttgtcttgcccatcgggaagaactttgagaggaacgcagtggagcatctgtcctatgtgttgactgttgaccagttcacgtagaaccactgcttcgccttttccaagggtgagaaagggaacagacgtagcctaacggcatccggactgacacccttcattgtgtaggtgctgcagatctccaagaattgttgcaaatgagcacttgcgtcctcatttggcttgtcaaagaactggcttgcatgtgccatagtgatcaggctgctttaaaggtcaaagtcggagtcttcgatgttgacagccaggccaacaggtacgttgtcagcaaacggtgcagcgaactcgcgcaatgtcttctcgcccatgttcctgaaactatgtgacgcttggatggctggtttctaggccgagagctttttcttcggagggacaacatgtggtttgacgctctggaagaaagcttctgtgtgttcgttgaagttttcttgcagattgaaactagacatgcattaccctgttttcatgacacaagtgaaaagaatcaattttagcctacaaaggacagcaaccatgcagacgttattatatatgtataattcgctaatagtaatctctttgctaatcttccccggcaacagcgtcagaaatgcttgttgatattccttaacgacattactagaaatattcattcccaataatggcgcagaaacaatcctcgtatatttatggttataaaagtaatccgcaagcgcacggatataccattgtaacatttcacccggaaatattcagaggtatcgtatttattcaatcccaagggaagattgtgaaagagagaaccatgctctctctctctctatatatatatatatatataggacactcatatggggcaccatggtgcccgggcaccatggtttcaaatgcacaaaatcactcaaatttttcaaaattttctaattgtgagtatatacctagttataagaattcgattcgtacctatacctatccatgattacatacctaactaattatatgtatggatgctatatacctagaatcaaaatctaacaaaaataagttcaaattcagttcaaacttgctttgaactagttagtaaaagtagttaatgttaatacctaaataattaaaaaagtttcatactcattcgaattgggtatatactcaatttcaacaatggtgcccgggcaccatggagcaccaaacaaatttactacatatatatatatatatatatatatatgcactaaaccgcaccaagggtgcgctataactaaactactctcctcacatcacccccttccctcccccaaccccctcctcccccccaacattttcaagccttccgcacttcccaccccgcaccttttgaaaataaacgtccaataaaatgattactaagcctctgtatgtgacataatatactgtaagtaaactaattactatgcatacgaatgggatggtgtacccatcccacaccttttcaaaataaacgttcagtaaaatgattactaagctattttatgagacatagaactctataagtaataaaattactattcggggaggaggggttaatatgctcatccccgcaccatttttaaataaaggtccagtaaaataattactaagcctttatatgtgacatagtacacaataagtaaaaagattactcataggtcgttgtcaactctcctcaattgtttcctactcttagtaaatggattactctcatgttgttctcagcccttctcttagtaatttgccagtaaataaattactctcatattgttctcagccctccttttagtaaatatattacttagcatatatagtactactcccaattggttctcgtgccttctcgcagtaaataaattactttaatattaacacattgatattgctgtaagatcaaagtgtgttttgattcttattctttgatgaataattggcatatgtgattattggttttgatatttggagattatcgtcgaagtggttttggagataatcaattttcaggtgatgatcagattcactgttattttatgtgaccggtccgaccgggcggaggttgccggtcagaccggcgctatgtgagcggtcagaccggcttgcccgcggtctgaccggccgacgttgtgtcggtttcagtttcgggttgtttgtttttatatccgtgattgtttcatgattatggcttctagatggatactatacgtatgtaatactgttgtttgctaacaatgagtcaagttggagatagcttggtcttggaatatggtttctttgtttgtttcatgtgtaggtgactcgatgcctcgggagagtatttgcggtgatggaccgggagtcggcttggtggtaagacgatgtccgtggtggtcagatatcatgtgggatactaaggctagagttgatgcacgtggttgacggagattccatatggcatacgatggaggtattgtgtacgtatgggatgcggagtcgaatttggaaggagtccaaatttggtatgattggttatgtaaagtttgtttcttgtactagagggtttcctaaggtgtttaggactcttagtatgagtttggttcgtggctttaggctgccaacatcatgtataaatagagggggagcgtgaggcttcccggtatcgcttttgtatcgcttttgagagcaattgagttgctagtttagttagggtttcgagtttagtcgaaatttttgtaaggagtgctgttggtgcactttgtaaacataaagagaagcaataaagttgtcatctactttaagagttcttcgatttgtgtttcaccgggtttcggcggtctaaccggcaactcaccggcagtcagaccgacggcattgcggtggtcagaccggtgggagcacggtggtcagaccggtggcggcgacagcgagcgacaggcgactttggcggttcgaccaatcgttctacatctgtcagaccagcggcatccactcggttagactgacagatcaatctcggtcagactgatctccgtcgatttcgagggtaacttttatttccactaaaagtttttggtttttgggtataccaaccattcacccccctctggttggcttagttcttgtgattcgatcctacaatcgccacaagatttctcttagtaaataaattactattatcacgttcttaacatactgatcttgcaaaaaaaattataatcatcgtaatataatcaacatcaaggtgatatcatgacaaattgtatatgataacaagaaaacaaatgagaattgagcatgttagctagctagcttagacaaaaagattcagcagctcgggctccctcttgccgccgccgcacatcgtgacggatccatcggagttcatcgatcgacagcgtgctgccccgccggggagccacaggccgaggtcgaacgacagttccgtctggggcgctgccggcggcgccatacacaccggggttcttggtcgtcgtcaaacgcttcgccgtcgagaacatggaggacccgcccacggcgtgcctcgccgtggacgcaaacacatcgcggccaccggcaccggtggcttcgtctcccgccgcgtagccggcatcggtctgatcttgcatgcataggtgcagtgtttgttggtgaaacttgtatgcttaaattgacaaaaccgaaacaaacttttcttgcacaaaaagggttgaaaacgtatatgtcagtgctgtacctagcaagaaacaataactgacttgctgctctcatcatatgactaaatgagttgactggattatatacatgaaaatgatgcaacaaaagttaagatgcaattaagaagggtgttgatcatatatatctacaaaaattgtgattcatgaatgatcatcatcttgattaagttgagattgggagcaagactacaagaattaatgtcatgtatgtatatcaacaaatgctttgtgacatggaaaagaaatttgacataacttttttgagatgtctaaactatataggttttgtcgtatcacccagcttagcattgcatttcttgcctgaagggatgatctctggaacgttctgaatcaagaacacatggaattgaacatcaaaaaggaaaaaaaaactcatcgaatttaagcatgggaaattaagaagctaatttagttaggggtgagaggataaatgagcttagcagtcccactgcagctgctccatgccattgccggcagcggcatcgccgccaccacagaacatcccacacgactcgccatcaggtccagatcgaacgccggcgccgtcgtacacggtacaccgccgacgagatgtccaccatctccacgctcgtcttattggagaatactttagtaagacggtacacgaaccatagaaagtttgggttcttgagacgtgctcaccatgcgtacgcaactatatgatgcagcaatcagatgtgtctcgatgttggatcctagaaatgccatgaagaaagggatggggggagggcgatagatggcggccggaggacggggaggcaatgacactgttggttggtcgccgttgccgtccttggtcgccgccgccttggacgactgggatacgccgcctcctgcctctgtagatccaaaaaaaatcgggaaaattgatcagtggttagttacgatgtggaacaacgacatatatgtatacgatgatttatatactgctatcagtaaaacaattacttacggtagaattcgatagtgccattagtaaaacaattactggaattgaggggggcaggggtgtgtatgtggtgggggtgaaaaaaaaaagggggtgttgcgtgcggtgtgtggggtgggttgtgctacagctactacaccctaggtgtagtgtgtgtatatatattacttgctttcatcgatgttttggcaggggttaatttaatataagggtagagtgtcacgaagcgaagcttatagaattcctgaagtaaataattctaattaggtggaagaagattccctatacttctaatatacacccaaactctaatctacatttgctagtatacaatcatgtggccaatacccctaacagtgccctcctggtgtttcaagagaccaccccgggttgccgagtttcttacgacaacctgttatggtcgtccaaccgggactaaatacggaggagtaccctccccagaaatttgtcttaggttttctcataatcgctatgaggatcatccctgaatatgggagcacaacccggagcttgaatgtctttggaatccggcgatggcttcagggaggactctttagtcagacccgaacatgttgaaggctcggtttcaggcttggcaaaagaaggttcctcacttcctgacacaaatgcctctggatggggttcaacacactgcccgacaaaggaggtattttccgatatgcgatcgagaatttccttgccttcggcgggagttttgtgcatgaatgaccctccagcagttatgtcaaggtagaatgcagactccctatctaaacccgtatgaaaatgctgcaatagcacgtaatcgggtatagacaggggtgggctagactgaactaaattagtgaatctggaccatgctgcaccaatcgattctttatttatctaccggaaacttagaatttctacacgaagagtagtaatacgggttacagcgaagaatgcgaggcagaacctgtctcgcaatttctcccagttaccgtttacacactcgacggtagatgtgtaccattgtttcgctctctcatgaagagagaacggaaacaatctccactgaacaacctcttgcttcatgcctcgaatcttaaggcacgagcaaagctgctcgaattcccgcagatgatggtaggggttttcctggcctaaaccagagaaagatttctccctaaccatactgatgaatttgggacgaatttgatagccaggtgataaaatatgctccgatgaaggaggtggctcgtaaaattcgccccgaggaacagataattggaagatagatagtggctccatcagttgagaatgtttttttaggaatacttctttggggtacgggtgaaggtagaagaaaggaaaataaaaaggatacgaggatgaacaaggttcggagataaatagcaaccgttccccggcaacggcgccagaaatgcttgttggtatttcttatgatcacagatagaatccgtaagcgcacggatataccgatgtagcacttcccttacggagtattccaagggtatcgaacccaagggacatgtgtgattatctcttcctccggttcatccaaggacacaagataaatatgggcaaaggatagagaggatttcctagtgagaaacagtgtcaaaggaaagcttaagtttaatcctaacgcgatacttcaggcactggcaacccgctgttcccagatatcgctctactacgtaaccggacagggaggacttaagtgctcttgagggctatcaccacctctacacgcacctctaacgtactgcgggatacgcagcaaccaccagaaattaattacccagacaccgcgtctatgcaattaataactactctagcactaaagcaatcacgatatattactggactatagtgaacaatgatcccatatgctaattaggaactaaccaagaataattctcactaagcaaatcttaattactcagaatgatatttctattaaagcagagtaattaccaaagtacaagaataaggagaggattaccgacaactccgggattccttcgacttcttctactttactctctccctattctaaatatactatagaacatataaagtagctaaagtatacttagagcctcttgtaattcagctctacatcttggtgtgtgtcaaatgagggagaggagaggggtatttatagtgtggagccttcttgggagtgtggagatcctccatggaatcctatgagcatcttcactctcctcat

SEQ ID NO: 74438 - DNA, 1224 bp, Oryza sativa
gcccaaagggagcacaaacgcgggccgcgccccgggttgcgccgaaccctgggggctcggaagggcctacactcggccgtccccgaccccttgtcgttgtagccccggtctggcaagtcccgctgggcggcttcctcagggcgtcggttttgcctttcaccacttaggtaccacggaccgagcgcgggtttgccttttcgctagaacaagcccgagggggggggggaggatggggtaaaagcggcatttcgatcacaggcagattaattatatacttttgctcttgttttttcctctttctatgccgcaggcattcaatggaaaaagcaaaggggtaaaaagtgcgaaaaggaagttttaattgcagaacaagacaggaagacacgatggcctaaatacaagaagtgtctgctacaggcacacaacaatgggaaattgaaagcgcgggtaatcacggagtgctcgggcccccgaggccggtgccgctaacgacgttgtaatgccccgatttttgttcgggaataaaaatcaattaataatgcattttctagaaattaaataaaagttaaatcaatttaatcaagtgaaattatagaggaaattaaaaatttcctttaaaaatcattggccggaaatattttgtaatattctctttgccctaaaatactctccggatttttcagcaaattttcggagctcaaggagtaattataataatacaaagttcatttaaaccaattaaattaaatgaaaaacaaataaaatccctcccctccttccttgggctcagcccaatcccttccccctccttccccggccaggccggccttccccctccattcttgggccgtcggcctgttcccctttccccttgtaaaagtccgcttcacgtcctcctcagcctcctctctctcactccggccgacaagtaggaccgcagggcccactcgtcagcttctccccctacctccatccggccggctgaaactgccatggccgctggttccgccccacgacgccgcgcctcccgcgccccaccccgtcccgtgagcgcgtggactcaatccccacctcctcttcccccactctccccacggaatcggcaccgaaccgctgccaccacccccacgtctagctccacgtctccggccggtttccacctctctcaggctcaatcccgccttccctcccatcttcccctcatccgtttcctccatttttccc

SEQ ID NO: 74439 - DNA, 12883 bp, Oryza sativa
attcctcaggctgcagattctgataagataacaagcagccggtcaagaatctatttatctcttgggatccacatttgcgtttccatagtaatttcaacgagctcaccagaatatttggcatgatgtgagtgtggttcatttagtgatccatgtagacactccacaaggttgttgcattatggaagatacctgctagtaaaatagtttggcttgtgtccccagttaaaaagaaaaaaaaacttagcttgtgggtgtcagcaactcagtaccataccaaaattatttgttagtgtcttagtgatatctgtttgttggaagatagtatgttagtattagctttcattaaatcactatgaaaataactacaaagacgtgtcagatgctgtctctggaaatatcttggcgcacaggctgtgctggctttgttgtgatgttctacatggaagtgactaggagtacttggttagatggagtttccctgcattagtggcaggcatatgattccccgcaaaaaaaaaaaggtggcaggcatatgattggttttacaggacttgccaaatagtttagcattttcatcgcgtcctttgcttggagctcctttcaataggctgagccagagttttgtctctgcagttgttagttttgacggttgtaagttcagtggattatatccggttggttgttgttgcagtgccagttggctgaattattgaatacctctctagatctactagattttagtggataggttttgattggttctcatttaaccaatcgattcatctttttagatgaccttctttgttaccattcgtctgtagttcagggttgtcattggtttgatgtagacacacgcctatgatgctattctgactttgcagcaccaaaagtgggaaatcgaaactgagtaatgcaaaaacttattctaaccttttggatgaactagtaccatttaccttgatataaaacagtatgtttgtatagaatttgttgaccatgctctttgcgatttgggcctacttgtttgtgggtgtcacaaaactttcattagcaaacataagtggtgatatactgatattattcttatgtgacatttgttcatttctcgcatttactttgcaatcatggatacaacctgaactaaactcaccttccatcttttttttcttttttttgttaataggagcgacatctttccttttcactgagtacaagtatgtcggattattcatgagcatcttcgcagttcttattttcctcttccttgggtctgttgagggcttcagcacgaagagccagccttgccactacagcaaggacaagacttgcaagcctgcccttgcaaatgctatctttagcactatagcttttgtgcttggtgcagttacctctctggtatctggttttcttggaatgaagattgcaacttatgcaaatgctcggacgactctggaggccaggaagggtgttggaaaggcttttatcactgctttccggtctggtgccgttatgggtttcctgcttgctgcaagcggtctcttggtcctttacattgcaattaatttgtttggaatttattatggtgatgactgggaaggcctttttgaagctattactggttatggacttggtggttcttctatggctcttttcggccgtgtaggtggtggtatttatacaaaagctgctgatgttggtgctgaccttgttgggaaggtggaaagaaatattcctgaggacgatcccagaaacccagctgtaagaatctttcacttgaattctaaagattcccataaatatactgttaggaaaatctcactttaccaaaactgcaaagtggctaatcttctctctggtcaaaccatcatggtataagaatgacttttgttctgcttgcaggtcattgcagacaatgttggtgacaatgttggagatattgctggaatgggatcagatctttttggttcttatgctgaatcatcgtgtgctgcacttgttgtggcatcaatctcttcttttggaatcaaccatgaatttactcccatggtgtaccctcttcttgtcagctctgtgggaattatagcgtgtctcataaccaccttgtttgcaactgatttctttgagataaaggctgtgagtgaaatagagccagctctcaagaaacagcttataatttccactgcttttatgactgttggcattgcccttgtcagttggttgggccttccttacaccttcaccatctttaactttggtgcccagaagacagtgcaaagctggtacggtgtttttacattcatcattgggctatataattaactttatgattcatcctcattctgctgttaatttatcacttatcaggcaattattcttgtgtgtggcggttggtctttgggctggtctaatcattggatttgttaccgagtattacaccagcaacgcatataggtatttacgatttgctcatttatgtggtgattatttttatgtttattcttcaccttttgacatctctgttgtttaccctttcagccctgtacaagatgttgctgattcttgcagaactggagctgccactaatgtcatttttgggcttgctttgggttacaaatcagtcatcatccctatttttgctattgctttcagcattttcctcagcttcagccttgctgccatgtatggtgttgctgtggctgctcttggaatgctgagcacaattgccacaggtcttgctatcgacgcctatggtcccatcagtgacaatgctggaggaattgctgaaatggccggcatgagccacagaattcgggagagaactgatgctctggatgctgccggaaacacaactgccgcaattggaaaggtacatatctgcctacccatcccattcttaatttccaggtcttgcaccgaacttagtcaattcttcctgatgatctccatgcataactgtagcataggttcacatttagttgaaatttataccaaggtttttatccctcaagatgtcgatcatgcctagaaagtggttgtttctaattatgatgatgatgttataccacttcagtatggtaagcttccttgattaaaagaaaagtttatatcgtaattttgtatttgcagggttttgccatcggctctgcagccttggtgtcacttgcactttttggtgcctttgtgagccgtgcggctatctctacggttgatgttctgacaccaaaagtgttcattgggcttattgttggtgctatgctcccatactggttctcagcaatgactatgaagagtgtaggcagcgcggcgctaaagatggtggaggaagtccgcaggcagttcaacaccatccctggactcatggagggcacaactaagcctgactatgcaacttgtgtcaagatctccactgatgcatccatcaaggagatgatccctcctggtgctcttgttatgctcaccccacttatcgtcggaattctgttcggcgtcgagaccctctctggagtccttgctggtgctctcgtctctggtgttcaggttggtaaccattctgaattctaggattacaattgcatccaatggtccgtgctccttatccgtttcaccttctctcagattgccatctccgcatcaaacactggcggtgcttgggacaatgcaaagaaatacattgaggtacaatatctaccagtatccatttccttttcttttgggttcaatcctgcatgttaccttaactttcttttcattgttctgcataggctggagcttcagagcatgccaggacccttggtcccaaaggttccgatccccacaaggcggccgtcatcggtgacaccatcggagaccctctcaaggacacttcaggaccctctctcaacatcctcatcaagctcatggcggtcgaatccctcgttttcgcccccttcttcgccacccacggtggtatcctcttcaagttgttctaaaccggcgacgttgggtgtaacaaaggccatagttttttggggatgagcaaaatatgtagactattttgtcatgatttgctccttgagttgatgactccattgtctacttgatttcccatttttgttctagttccaggttccaaccttgtgttttgatcccagaattttctctggtcctctttagcttttgtctccagctgcataagtcatcctgtggcacagtgaacaaggagcattggaaaatttgccattttctagcgataaaatgatgaggatgatgatgatgattgatgtcgatgatattgtcttttttttaaaaaaaaaatcttctaattttgcagcaatgggtattgattgacgtgaagcatccaaattgttgcgctgttacaaggttctccccactcattctctcaatgctttcctaaatgtaatttttctttttatatccacaaaatttttctccttttcttccctatttattcttgacaaataaatggcacatcttataaattaaatactattcttacaaatgaattgacttttgaacacaaaacccattcatagtggcaacccaattaatccattcgagcacgaggaacacaagaacgaggctgtcttacttgcattgctgcattattacgtacatccattcatgtctaatgtctggagggtacaacaacaatgtaaaaagggctaagcaaacacaaatcggtagcaaatcagaagagagacatgataaaaaagaatcttttaaatagtacatgcacaactaagtgttcttttttcctgttctcaaactaggctatggctgacgaccgagctaaaacccctacctgctaaccagtaaccagtgaaccactaagcacaggatgaacagagccacgttcttgcttgtaaggtagggctgttactcattgatcatttcctctttttggcaggtggttgcgggacgtcatcgtcgtcatcctcttcctcttcttcctcctcatcctcatcgtcatcctcgccctcgccctcaccctcatcatcgtccccgtcctcatcctcgtcatcgtcatcttctccaccatcgtcgtcatcactccctccttcaccattggcttcagggtccccgtcctcgtcctcatcattcccttcctcttccgaggcatcttcatcaccagcatcatcgtcgccttgattttcagcatcctcgtcatctccctcctcatcgttatcatcatcagactcaccatcatccttgttctcaggaaccgtttcagttttgcttttgctgagaatcctttaggagaagggtcaaaaacaaacctcagctttgagatgagatattaatatgtctacagtcatggatagaatacatgtattcaacactaatgaattcagaactgcagttgcaaaggggtataagacatacctattaatcaaatcccggtctccaccagatgtaatgaagatttcgttttgcaatgacaacatctggataccatagcaaaaaagaaaaggaaggggttaaagctgatgatggaggattggtgtatagcagagttgctcatcagaccaaagcagaggtttttcccaagggtaattattatattacacaagtagcaaacattaaaatgaaagatactacgtggataaacaattcctttttggaatgaaaatgacaaggctatatagagaatattttaacttcaatatggtgttcattccagtttagctccaagaatggagtatcttaatacaaggccattctggtgtgtcgtccaggcacaaatataaggagaaaaacacaaaacactagcttacaatgcatttagtgccaaactctgaaactcttgcaacaaacttacacatcaatagctctaacacaatacatttgtaattttgtatgtgaatagtcagacaaaactcggtctaatccacatcccctagccataaaattatcctacagcaatagctaatgttactccttatatgggtactaatttcatttacatttaccgaatagaacatatgactgacatagtagacagtggtaatatggaaaggccatagggcgcatgacaggccattgttgccatgcggggggctgctaaatgcaccaaacagtgaaatcattagaaacatggaaaccacttgaatatcccagttaaagaattatacaaggcaatctctccgttccacaaagactttaatccagcaattatagggcaaattagaagtgtggtgaaaaggccaaggtgcccctcattaataatcacggttgcaatttctatgctccaattaaatgtacattgggagtaggtataactcagaagttagaaataaaatctttgtgggacaaatggaagcctatttgggatggagggagtttatatagtgatggatgattggtcataaaacaaagaacatagcagccaatacagtacaatagagtaaacacactttacttgctggtctgaaacaccagttcacctggttttctcttcagttaaggagaaaaacaatcccagtaataccttgcagaagacactattggcacagaaaccatgtaaatacatgtatacatcatgcacttttaggccttattctggacaacactcgaaatataaaggttcctaacaagcacgaatttctggaccataggttttcagtgaatggtgctctgaacatagacatgataaatccagcaagggcacgcacaacatcaatgagacccccatgaaccaccaagtaatttactatcatataacaatagagcaccagatgcggaaacttctccaaattcctctgtgcacattacgttatcctattcgtaagaacagtacacaaaagtaactccttaatcctagatacttcctccgtttcacaatgtaagtcattctagcattttcccattcatattaatgttaatgaatacagatagatatatatgtgtagattcattccattcgatatcaatctgggacatgttagcgctccccttacattgtgaaacggagggagtacaacacaatgcaacataagcaaactgaaaagggcgaattaaatctctatgaacaaactgccaagaattccccctagtgcccctagtcgtgagttaattgactccttaatcctacaaatagcacaatgcaacacaataaaatctggaaagtatgaaccgaattccaaattccccaccaacaactaccaacaatttctctagcaagctaaatctacccatcaagttaaacacttcaactcaacagataacctcaaatttgtgtcaccacagtgcgtgaaagagatccaacacagagaatatggcttaatttctcgaaaaagaaaataaataaattggatcagcaactagacgacaaaccgaaaaaaagggagttccaaaagtcgggatggatctccaatctacggcggctcaggctgccaggtacagcgaaggaagagaagaataccttggggtcgagctgggacggggtccagcggaaggcggcgcccgcctcggcgacggagaggaaccgatgggaggcgaccgcggcagccatggcgttggggtggggaggaggaggagagagaggaagggtgagcaggatcgatgagatgagagccaatccagtgaggggtttttttttttttcgcccagagcagcagctgtcctgtgctgcgacagatcaggccgtttggaaggcccaagatggcccatttgcgtatatgggccggcatttcagcaacaggcttttaccatcggataaagtccacttggctccctttaggccgaatataattcgtacccctctaaaaaaacatcggataggacgactctcgaactattgaaaccagtgtgatttgactttcctagcagttttgaaggacggttttgctaatgtggcgttgacatggcggtgttgacctggtgttcatcccatgcgatacttatgtggcattagaatttaaaaaaatatatgtgagacacatctatcattcatacacaaaaatatatcgtaggccccacatgtcattctctatctcaaacccttcttcctcctccctctatgaactttctgactataaaatcacaaggaagtattttcattaactttttcaattataatgtattataacgattttaatattttaatttattgctcatcttcttaataactgttgtattattgagaaaacgtctttacctgttgtaatgctcatacttttttttctaagttaattgtgataagtgtataaataaatgattataaaacttcaacaatatagtagaattacaaccttatttatgagaggagtaacttaaatatgactgaacaaaagctacattcgtggtaactttccgaaccgagtaaagcaaaggaaatctgaaaaaaaaaacaaaaaaggcgttgccaagaaggaatcatcaatcgccatttcggcatctcgttcttccttgaacccgcttgttcgtttcccacgtctccctcttgcggtattggccgtcttcctccgcccaaacaacaaaacagaaaaaaaaaagaaaaacccagtcaaaacgcccccgagaagaggagaccgtcgctaagccaaagccaagccacgcgcgacccaatcccccgatccctcctccccctccctccctccctccctccatggcgtcggagatcgaggtgctcgaggacaccaccgccgccgccgccgccccggccgccaccatcggaggcggagaggtcgcgggcgcgggcgcgggggaggagggggaggcggcggcggatgcggaggcgctcaaggacgacgtgtacacgggcgcggcgtacggggacctcgagaagctgcaccgcctcgtggagcgggagggccggccggtgacggagcccgacgccctcggctaccacgcgctccagtgggccgccctcaacaaccgcgtcgccgccgcccagtacatcctcgaggtatgatccatcgccgtcgcccaatccaatccgccccccgagcttgggtaatgctagtgtgtcctcgagcttgcgcgtttaggaattcggttttcctgccctttccccgatcagcaacggagctccccggtgatgtgttgtttgaggtgcagacgaagtgtagctcctgctgggaatgcgctgtgggggatgggcacgagttgtttagttgttgttgcgaatctcgtttggttttttggttggatcgatgaggagagattttggttcatgtggcttgtaatgacaggaaggtatttcgcttttgctctgagggtagcggttttgagcttagttttggtatgtttgtgtttatgtgttggatggatgttaatgctatgttggttgaatggtggctgttggataggtctaggcagggccaatctgcagctcctttagtgttaggaaaccctgtggaacttgcctcttgccatatcttaccaagcgagcaagcatttccaagaatttcgctgaaccataaatgggatcataggaagtttgttcagttaaatgtcatgtccagctgtttagacaatgaagccaacccctttgaaaccttgcttggattgatttgagtatgcctatgctgactggtctatcccagtcaacatgttatgcattgtgtcttttaaggccattggtttcacggttttatgttgaacagtgtagttatatagtacttcttgagttgcatggttttctttgctgctctatagtatgtcctatccttttcagttgtttgctttggtgggatgacggttctcagcttgttgtctggacagcatggagcagatgtaaatgctatagaccatacagggcaaacagcactccactggagtgcggtacgtggtcatattcaagttgcagaactacttctgaaagaaggagctaaggtggatgccgctgatttatatggatatcaggtttgtctttgacttatctattgcatccatggttccttaacacatatatattctctttctgttgtctaatgtattttgattaattcacctggtgaccaactgtttcttactcaagttatgttgcaatgtctctataatgattatgtggtacataatagtttaccattgctttgctgtataatccctatatcagtcactaagatgcttcaaattgtaatttcatacacattgatgctaggttgtatggcttcctgcaagataatgaaatcttttctctcgtcagataccataaaactattacttcctctagtaccccaaaagcatgttgttctagtaagtggcaaagagattaggaatttgtaacattgccatttttggcctttataataaatttaattacttctatctctaccataataatggttaggttgttaggatgggattaaaatgcacaagtattttacttctgtaatcagatcctatattttatcttttaattcttttagcatacagtcattttgtttttgagtttgagtgatctgcagggtttattaccgccttaagctagtcgccagggttgtcaacaaggtactaagtgaagtaggctatagacaaaacagagtcattacaaggataggtttcgaaaaaaaaaatttggcatattcactttgattcggaattaggtctttaattgaaatgtcagtctgtatttttttcctacatatgcagattagttcaacaataaagtaagatatctgcagtagataaattcccggtttgatcttaaaagttgggcagaaaaagtcaagagtcagtcagttaccttgtatttgaagtatttctgacggaatccatctgttgttataccacagactacacatgttgcagcacagtatggtcaaacatcatatctttatcatattgttgcaaaatggaatgctgatcctgatgtccctgataatgatggaagaagtcctctccactggtttgtacctttcccctgtacattttttttcaaagttcaaacacaagccttgtggtattctttatttttgtcacttaatgtgttgtctaacatggcttcatggtgcccctattgatgattcaatattgttcacatttccagggctgcttataaaggatttgcagattctgtacgcctccttttgtttttgggtgcatatagggggcggcaagataaagaaggcacgtgtttagttagtttttctagctcttcctaaaccctatctttatactgatcatgacaatctaacctacaacaagcatttaagcacgcttcccctgcattagttttgttggatatcaaatattcatttccagctcaaatgcttttcattaggttgcactcctttgcattgggctgctatccgcgggaatttggagtcatgcactgtgctggttcaggctggtaaaaaggaggatcttatggtgcaagacaataccggcttaactccagcccaacttgctgctgataaaaatcatcggcaagttgcctttttccttgtgagtgctatgaatattcaccattttttgtttatcatacatgagaatccttctagcttcccaagagtatccttttagcttcccaagattccatcataccgtaaatgttgccatctgattgggaatttaatagttctgttaatatgctttttggctgcttttccatttgtgccacctatttttggcttgttcttcattgacaattattttttatacctaatacgtagtagtaagcattactctcatgatgaatggatgtgctccacggccctgctatttcccaatagactctgtatattgcctgccacagtgccacttaccgttaattcttttactatatgaattaaaatgttttcttaaaataatatgcattgttaataacatggaggtaacaaagtaaaagtttttggataatcactagcatttgtggattgtgaatgctcttgtacttgttctggatattcttttaactattccccagtatagattatcttgcttaaaggtataaaacatttatcgttagcctcagcatgtaatttattcctggcaaatgctaaggattgatttgatgatttgattgttctatgcaggggaatgctagaagagtacatgagagaggatgtggtgggaacagttattttgggaaactatcaaaattaggactcgcccctcttctttggtgtattattattggcttaatttatatatatgtatattcagttatctcaggtacattactgatataatgtcttttcagaaattttgatctttcatactgtggttgtggattactgaatttgtttccttctattcaggacaatatagcagtaatatgacattactatttgggttattttcatggttgggaattttccttgctactgccggattggttatgttctataagtgtagcaggtaaacattcgattatattgtaccaatattccaaaaactggaggaaacatatagacagatccatgtcaattgtgcctctttagacagctcttttcttaagggcctttttaacaaattaatctcactttgcagaaactaatattttcttcatttgcatctagtcgttccttagaagggttttttaacatattaatctcaccttgcagaaagtaatctttctttgtttgcatgtagcctggaagtacaaggtcactttctttatttttaaagaaaactgtgatttctttgctggaacagagcaatttggctatttatcaattaataccacgttttagtgtgctgtcctgaaacattgaggatcttgttattttgcctacactctttaatgcattatgttctggccttgcacatctatataaaattgtaacatgcccaccacatactacttttatttcacattaaagatatttgattcaatcatttaaaaatttgtttgaagaatggccatactattttgttatgcagaaaagatcctggctacattgacaagaatacaagagatgcccaaaatcaaagagat

SEQ ID NO: 74440 - DNA, 3156 bp, Oryza sativa
tctggttccttgggtttttattagagttttcctcgttttgcgtgccaaggtgtagtttccgttgtttcggaagttcgtagtcgcgaggaaaagagttcagaagatcaaagtgaagaagcaaggcaagtcacacattccccttgagaattttgatcctaatttacaaatgttttatcgtttacaaataaaattgcatgtcttgctaattacatgggatccgggtattacctatctgcttgcttgtgccatatttacttgatatctgtcctttgtcaaccttgggtaataaatcaactagctcatgttacttatgtgacctagctagaactatatgcttagccatgcttaattaccactagcccggttgatgggataattatagtattagacctttttagtgtcagaatgagctgcatgctcgagacatctggccatgcttcatggtcgtaattaccccactaaaatgtgacttcatggtgggctgtgggtgcatggttttgctagtcgtgcccatggcaattaagaaccggtcacgggaaaccctggaagaatttatcgtgcttaccacaagccagcgtgggcaacagctgggcttgtagtgtagctttcctctagccgacgcatcaggcaagggtgggtgtgatggaatttggatgggccctgcgacggcctatgcggcttccggattcacctaggcacgagaggggactgcccgctgccttgcgaggagtggggtgaaattttaggtgtggtgtggttgggtaaaagggaggttatgagaagggtcctatcacgacctctttccagtatgtcgtggtggcatgtcagcgcacggaaacgtgtcgtggggctatgtcttgtgggtacagttgtacacctctgatcagagtaaaactattcgaatagccgtgcccgcggttatggtcggtcgaccagattcaccgtgattagtctcacccctaataaatcgacccaatgcactgtagttcaggtgggttggttgggcctgttcaacgtggtatagcgttgatcagtggagatttaatagtaccttaattactcaatagttttactgttttgctcaataaaatgttttacaaccgcctttatacaaatagccacaagccattcttgaatcccgttgcacgtctgcatcattggtgtggcttgctgagtatggtggttgtactcagccttgctattattccccttttttcagaagtgtagtgcttctgagctgaagacgaagttagaagaccaaggttcagaccccagttaagttttgcctgtgagtggagctgaagccccgctaggatcgccttttcccgctgttgtcattttctttcggtgtgaggactaagtgcctcttctgtaagtatttacgctttatttatgtttggaactgtatattacttgtcgttttgtgtaccctggcttgtcctggacagggatttaatacacaaaatagtccggaaatttgggttaaatttctgggcgtgacagacgtcgtcccagtcctcgccgccgaagtcgtcatcatcgtccccgctcccgctctccttgtccgaggcaagcccgaaggtgaaccggggggccgacccctcgaagttagagacgatcgcgtcggccgcctcccggacttgctcccgagcccttgcctcggtccctggaggaaaatcctcgagtgcgcgccatgggacgaagtcggggtcacgcgcttggtggctcgcgaggaccagttccaccgcgtcccgcgccaagaaagccgacgacgatttcacagtctcgccgacctccttctccagcctctccagatccgccgccagcccgtccagccggagtgcgactgccggcgtgtgggcggaagcttactatcccggtgcacggaaatgccgactcggcgccccgcgcgctccagccggtcgacggcgtcggagagcttcccgggtccgatcccgttggtgaggcggagggccgcaatctccctggcctgatcttgcaccaagcgctctatatcggcgagagtgctctgagccatggcaagctggctccccaactccgcgccgccgggctgcccgcccgccgccaggtccttctcacgggcctccagctcagaagccctcgccgctatcgccgcgcgctcggcgcgagcactctccagatgccgagcatcgcgcccggcaacagcctcctcgcgttttgcgagctgctcgcccagccggcgcgaggccacctcatggcggttcacctcagcttcgcgctcggcgagtacaacgtcccgttctcggcacgcctcttcccagagccgtagctcctctgcgtggcggtccactgaagctttcgcggcgagggtgatccggtcacgctcagctgcggcctcttcacgaaggtgaagggaggcctccacctccgctgctgttctctcgtgggcggccaaggtggactcccgcagatcgagcagacgcgctcgctcctccagcgcctgagtccgcctctacagctcctgggctcgctgcgcctgctcctggccacgcgcgttttgctcacgctggctctgatcgaggacctcgattcgccggcgaatcgtggtctcgaactcctgcgtggagcggacacgctcatccaaggccctgcgttcggcctcgagcgccgctgtccgagcccgcagcgaggcatcggcctccgatacccgctgctcttgggcagcagctgcgtcgaggataccgcgggcgtccttgatcctcttcgccagatcctcggcatgggcctcgtactgaaggcgatgtcacccagtgcttcgtccaggacgctcgaggcaatcagcgccgcctgccgctcttcctccacctctcgcatgacggagtccagcgactcctcgcgcgcctggattttggctagttgggcttggcgcattttgcgtcccaccctcaccatgtcgtccacggcgcgacgcccctcgtcaactcgcacgcgagctgtgcccatgcagcctccagggccgctcgctcttccgccagggcttgaacttgggcgttgagcccctcccgaacggtggaatcggcggcagcgagcacctgcaggagcggctccatacttgccggagtcggagaagaaaaagttgcggcccgcccccgggacgacggaggggctgcagga

SEQ ID NO: 74441 - DNA, 710 bp, Oryza sativa
ggcgttcacgacacaaggaggaggagctcacccagccccgccgccgcaaccgccgcggccgccgcggtctccgacctcctcgccgccggtaagaagaagctctccgagcaggccgccaagcgcgccgaggtcgcaaggtatataggcaaacccttcgaaaaccttaacccatgcatcctctcctccggccggccggacaccggccggctggccggagacggagaagacgacgactgagccggcggctgttgcatgtattgcagatcgactcggtggtgaagctgaacgccggtggccggagagcttgttcatgttgccgtaagcgtacgtctcgtgtttgcgtggttttgagcgggaatgagcttgtgagaaaaacaaaaaaaacaaaaaaaattcagtccatctgctggtatatacatatttcatctgttcagtttttcagtacatatatcttgtcaactgtgtatatttgtgcatgtctatatataccctatatacaagtgttcagttgaaatttgcaaattgtgtagatatactccctctgttttttaatagatgacgccgttgactttttctcacatgtttgaccattcgtcttattcaaaaattttatgcaaatgtataagatataaatcacacttaaaatactatgagtgataaaacaactcataacaaaatctatatacctaattaaaaaatacgcaaggttt

SEQ ID NO: 74442 - DNA, 26048 bp, Oryza sativa
gcccatttggaggtgtttaattgggtttctgagtccaaaactccataagttcagatacgagtttgattctcatcctccttcatgtatatttcctctcaactttggtagtttgtcacctgcatatgaatatacaccaacactcgtggaaattgttagaaataagccctaccgctaagttggatgttccacgtttatggtcttatgcaggtattgacggcgttaatttcgtacttaacggccgtcaacatccacctctactgtcccgcagcatatatgcccagataatgatatttactaatttaagcaccatgcttacattaataaatactactctacacctctacagatgatataaagcaaccgataaatcggacattaaatccacaccattgcacctctctggtaggctacccacataattatattggcacaaatataaagtaagagtagtattcatactaggtaaagtactgagaatataagaagtatttcattaattccaacagtattacggaagagaatataaaagctactagagccataccgaaactcttccgaagactccgaggactattctattctactccacttagcactaaaactactaaaataaagtatgaagaggaatcttgaacttgcttgagtatgttgagaatgaagtgagctcctccttttatagggtcggtatgatggttgtagccatgcgaattgtccattttgcccttgcaaccgccatcagcaagccatcccgatcgtccacgtgcagagccaacctgagcagacgcagccagggtttggccgaacctgggctggcccagaaggcctccacacttctctgggtcactgactggtgggtccttatgacggttgtggtagttaaagcggtttccaggacagttacacctagcttgtgggtccatcttatccataagcttgcttaggagtgaggtttcctcatttcttcattattttatttgctcaattcctgcaacacagtattctccaagtacaagtgaaactatattattgtaaaacaaatatgtattataagcatagctagttctcctttattattgtcatattgacggtcgaaatttgtctgtaacgaccgtcaacatctcacaacttcaccttctcttgccaaccgaagcttttatgtttccctgcaggttacataagtatatgtgtggcggtaaaagtgtgatggttaagcgaacagaagaccaagatgacgtaaacgatgttttctttttggagcttggtgggggtaaaccaacactaagcaatctgaaatctagttgttgtaaagataagtaacaatccaaactagaagttcattgctaagtgctgatccataatgtttggaatagaaacaccaactcacgcacaagagaaagatattttgatgcaaaacaaaggattacgctagtgatagatggacgtcatttcaaacctagcaaaatttgcaccgacctctaattttgcagtatggcgtaaacggttcagcacatgcaacacaaatagatcgttctttcctcctttctcttctcacaattttttcacctcttttttaactatttattttttttcagcacctttttttttctgcaatttttttctttgcacaaaaaaaaagactataacatgtataacactctcacaaatgatagactaaaaccaaaaatatataactagcaattagagcataataggatcaaggtatacacaaaggatagatatggttttactatttttttgtggggattttcctagagaaaacaatatatcggctcaaaggacacgcgaaggaaaatagatcaacaactaaacaaggactctaatgaactgaaacttaaccaaactcactagaataacatatgcaattataggctatggaataaatttttgtaggctttttctggataagaagaaaacaaatatatatacatagggataaaaaatcctaccgtgacaacgaaagctctgataccagatgatacgacccaggtaggggtgatgtcccgatgttcacggcgtaggatgaagaaccgataactagcctcgaagagatcgagatagttagttgcaagcagctaagatatcggtgcaacctgacgatcgtattcgaagccaaccaccgtgtctattacggcaagctgaatcgatggttcacccaaccacactctaagttaccaaccaacacaacctggaatcaatcgaggaaaaatcctcaaaagggaccaggagcaccaatttggggcgttgaacaccgcttctttaatcccacaaggaaatcacaagagcaaaggattagagatctctctctgaatttgttagcacacagctaaacaaagggggttcatattctcattttcaaaagtcttccaaatgataaaatataggagatatttatactaggaacaaacctcataaatgggaatgaaaggtcttgagagtttactgaacataggctagctcaaaggtcacaataagtgaattcccaaaaagactcgcgcgtctgtttgctttctgggcagtcctcaatgatttatccattactccttattgggaagtagaaatgacgacccgtctgttggatgtgaaactagacttaaatggtcgcacatatatattaagcatggagattgttgattggctgggtcacacatcccttgatgttggagcaaatgtttggagacagtgtactctaaattcagtatgacataaatggtcattatctttacgtaaccaatcatcactttgaacttctagctcttcgtcgatgcccagcaagtcttgtgcatgtgtaaacctaagtaatagcaaagtacttgatttaggtagtatataattcttgtcaatattgaaatatgtttcagatacgagtgagttcacctcttgtttgtagtttctttgcacggctacatgtaatcagttcttgaaatggtgtaacggattggctctcatcagcggctaagtcagatgattgtcttgtatgttcatgtgacgagggctggggcatatcaaaaatcttattgtgggtgataagaaattgatttggccaggactatcacggtccacagaggtaatcagattcatttccctggtttaatccagcatttctcaacataaaaactagggaaataattttttatataaggctgaatttggtgtagaaaattgtgaaggctgggacgtctagcttgtatatacttataatttataaaacacatagtcgtaatttaaatcttacgtacagatcttaaggcgacgttgaattgttcattgtctgctgatttggtacagtagagcaaatggacccatcagaaaacgacgcaaccattgacaaattttatttttaagccacggtgtaaccatctatctatctatctatctatctatctatcttctatctatctatctatcttatatctatctatctatctattatatctatctattatatactaaaagtccatgagacttcctacaaacgctctcaagccgccaagtggcgctctaataaaatagagaaaatcctagaaattctaagaaaaaagcaaaaaatctacccctttcacttaaattggtgggtccaatattatacaccattagataaaattgatcttaaaacaaactaaatactatgggtcccacctatcctcctcctgtgcgttggcaggtggcaggtttgtacgtacatgtacgtatgcttccttcctttcttttcctttttttccttttttttcttttttccatatatatatatatatataaatatatatatataatggatatttttttaaataatcataattttacaaaacaaaagaatctaccatcatataacaaagaaacttcctttcaaatattgcactattttaaaataaattttacacatttatattctatacatattaaacgcactcaagccgccaagtgatgctctaataaaatagagaaaatcctagaaattctaagaaaaaaataaaacatctaccccttgattttcacttaaattggtttgtccaatattatacaccgttagataaatcgatcttaaaacaaactaaatatcatgggtcccacctatcctcctcccgcgcgttggcaggtggcaggtggagtatatacgtacgtacatgtatgtatgcttcctttcttttcctttttttcctttttacatttatatatatatatataatggatatattttttaaataatcataattttacaaaacaaagaatctaccatcatataacaaagaatcttcctttcaaataatgcactattttaaaataaattttacacaattatattgatatgtacctattaaataaacaatatctatattaattaatttatacatgcacataaattgatggccccattacataaatcattagatctacttttcattaccttggtctattattccctgtttcaaaataaggtctacaccattatattgttacccattaaattaacaacttaaaatctatattaactaatttaacttacactagaactggtggacttattattataatcatcggatctattgtttgctaataaataaagcgtccaaaattctctttttgcccactgcacaatacacatatgcacctttgcctttcgcatgtgtgacaaagtgtagtgtctgagacatataaggtgatcacaaccgctgtagagctaccactttgccacaaatcaaatcatatatggagatgattaattttgttaataacatgaaaagaaaattaaatatgtgatgcagtgagagaataattaagtaccatggattgtgtttttctcaacactaattagctctgtttaagttgaaaccgagagttgattacgtaataattataatgtatctatgttatgtcgtatttggattttgtactatttgttcgtataggtgaaaggaatcattatgttataaatgtgagcgcaatattgacgaatattgatagaactcttactacgacaagggtgataaaagggaatttaaggccctctctttttttcccgattccatattttggaattttgtttgcatgctttccaagtttctaaatagtgtcttctttaaattaaaaacattctaactttttagaagtcaattcattcatttataccctcaaaaaaatatcacataaattatataattcatccatttcaaaaaaaatatcacataaattatataattcatcaatttcagctatcctaaaccttaagtactacatttttttttcatgcgagtcatggtgataaattattaaagtcgtacgatgaatatgtaagaggtactttgaacaattgtaaataggtgtcaaaattaattgctattaattagacatctaatggcttgcaagccacaaaattaatttcactcaacatgtatataaacatggacgaagctggaacaaatattaccatatgtcccatacatatatattgcacagttaatattctaattacatgtgttaagcatttaacattccttaaaatgctctcaagctgcgacgtggtgctctaataaattagggcaaatattagaaattctaagaaaaaaacaaagtatctatttcttgattttcacttaaatcggtaggtccaatattacaaaccgttagattaaattgatcttagaacaaactaaatagtacgaggtcccatctctcctcccgcggcataggtacggacctacgtgcatgggtacgtacgcttcccctcccttttccattttttctctttcttcctttttttcccatgcatatgcttccctctctttattactatatcatgcgccttcatgagacgatttaatcaaaagaattttgagtatcttgcactcgcatttttcatttgcggtcatactacacggtatgcgtatagatggattatatgataattaactagcaatagttttttatttactcaagaaaaaaagaaacatgattcaaaatcgtaagtacttaatccatctcctacttaagtttgtgaatggttttttaagatacgttaagaaaaatagaacccttaaattattataaaataatattatccaaacttatttagtttgcccttaatctatgagacaaaatttctgaacaaacaataatcttacctttcaataatataagtgcccgtgcatacgcgcgggccacctttctagttattatgtactaaaagtccattaaacttcttcaaaacactctcacgtcgccacttggcgctctaataaattagtgaaagtactcctagtaattctaagcgaaaggcaaaacatctagccattgatttttatttaaactagtgaacacataattttgcatcgttagattagattaatctccggggcccctctcctaccaaagccctctctaggaacctgcggcacatagctgccacctcccgtacgcccctatttcttttccttttcctttttattggttgttaagatatttaatggcctattttatatagaaacttaaataaattcacacttctctttttttaacgtgaaggatgagatcggactatgcaccgcttgcatccatgcacttggcatgcatttgtggtttatactttttgagttggtccttttaaaaataaataaacagtatttttagtggttacagcttttaaattgtatataaccaatttgtgatcgatttgaaccattcggtatttctttacttaaacgatttcagctgcattgaactatatttcagaatacaagacaaatattacatgttggacccaagaccactaaattaaagacaatcattaaaaattctcaaacttttttttatggaactgatcttttgacggaaaatcatggggcaaaacatgcaaattttccaccgttggatatgctttaagatgcatgcgtggaagtgagaaaaaaatcaaatggcgcatggataccaaggatcgaactggcgatcgacgcacaaaacactagagcatgtgttcactgccaagctttgtaacattttctattttacattactccctccaactttttctattttacaatactccctccatctatttttgatagacatatttctaaatctaaaaaaatttacttttgataggcatatttcaatccaaccacctatcatcttattgactttctcggatttaatgcgtgactctctattattccacacaatattggctacatgggtatcgaggaatataaatattaataaatcacttgtttacgaggaataactagtagcatgtttaaatggttgataagtataattacttatccttggtcgttatgacaagatgaaatatggctattaaaagtagatgaagggagtaataattacatctttcttgtactgcagttacatacgagttacaaatgtaattacactgctattttatgataattacatttgccagatttttagggggattttctaccgaatgttagataggcggcggttgcgcggcgtggcggcagctctagcagcggcggcgcgcggccagagattggctgcggtggcggagctcgggtgtggcggcgagagcgcggtaaagggcacgggagaagcggggcaaaaaaaggaaataggtggaggaggatgagggtagctttataggggtttgggaggggcggacgtggcagggaggtggccggattcttcgccaacgacgtggggaggtggagagagagagagatgggggatttcgaatccccgccatttgcgggcgcgtgcacgtgcgggagaggcgggggagtgggcgggtgacgtgggcacagagcgtgggcgcacatgtggaagaaggggagatcaactccggtcagaccggcggatcaactccgatcaaaccgatcgacattgattcgagggtaacttttaattccgctataaatttggtttttggtactataaccattcaccgccttttttggttggcttagttattgctgtttgatcctacaaacacctggtgacagcttgccctcacaaaatacaagatttcgtgaccaggtgacagaaatttgatgactgaatgctgtcaccaaatctctttgtgaccgcctttgggcttttggtgatggtgaggggcagtcgccaaaaaaccattctctggtagtgaacgacgtactacagtatacagactatacctaccgtttgatgtttcaacgagcacactttgaattttttatgggcgaaccggcgaagtcaaacgtgtgaacatgtgagctagtcatcccagtatatgcatgatcacaaattcaactgctgagcaacctctaccacttgaaaggtagaattcaaagtgtgaacaatttcgtcgcatacaacgtccacaccatatacagactacatcaatattgtaggagatgaacaaattttgtcgcaataaaacgtgggaacatgtgacctagtcacctagaattaatcccagtatatgcatgatcacaacctctaccacttggaaggtagaaatttaaagtgtgaacaatttcgtcgcaatataacgtccacaccatgtacagattacggctttgtttagattccaaaaaaaatttagctaaaaatatcacatcaaatgtttatacacatgcatggagcattaaatgtggacgaaaaaaaccaattgtatagtttgcatgtaaattgtgagacgaatcttttgagcctaattacgctatgatttgacaatgtgatgctacagtaaacatttgctactgatggattaattaggcttaataaattcgcaaagcagtttacagacgaaatctgtaatttgttttgttattagtctacgtttaatacttcaaatgtgtgtccgcatacttcaaaaactttacacccaaataactaaacacaccctagatcaatattataggagatgaacaatttggtcgcaataacacgtgcgaacatgtcacctagtcacctagaattaatcccagtatatgcatgaccacaactactgagcaacctctaccacttggaaggtagaaggttcagcgttgtactatgctacacttgttatagctagttgccagtagtatattaattattgtatgagttgctgatcgtgtaacttctgtagtacgttacgactgtcatggtgtatatataaagtcgccggcttcgaggtcatctgcgaccgcacgttcagcccgccgcgcgccttcctcgcaggcgacccgccattgttcggcgacaagtggccgccggacgtgtggacttgtacctttacttaattatttccaaactggggatgccagccaaagaagatgcggatgacagcgcagagacgcagcaatatgtgggcatgaaggggctataaatagatgagatggacatttatgatggatcatgcataaacacgtacacagactcaaatatttatgcctagctgctgtaggttatacatatattgagcaaaatgttgatgatcctgccctgtagattgctgctgcgtctagtcctcgcaacccttctgattttggctgctagtacagatcaacatgtagccacgctgccgccgataacacttccaggctgcatcgacaagtgcggcaacatcagcatacccttcccgttcggcacgaagcagagcagttgcttccttccaggcttcgaggtcacctgcaacgacacattcagtccacctcgcctcttcctcggaaattctaatcctggagacaggcaaaactatcaggaatttgaagagcgctactacttgacgacggaggaaggcatgccgacacatctcatgactgatgattttttgttcatggagctgatgagcataaacctcacagagggcgtagcacgggcatatggccctgtgagctcggattgcagcctcaacgacacatatcatttggtgaagaggcagatgacgggcttggccgggccattcctcatctccacgcgcaatgctctcacagccgtcggctggaacatggaagcaaacctcgcgagatcggtgcgtggatccggcttcctcaagacctgtggtgtgcggctcgggcaacctgaatttgcaacgaatgggtcatgcctgggaggaggctgctgccagggtgaaatcactcaaggcattggctctatcgcggtgtccttcctacggcagaacaactctttgtgagggattactccctgttcctacggcatggtggtggagaaggactggtacaacttcacttcgccggacctctattccgacaacttctccaagaaatatccaaagggtgtcccgctagtgattgacttcgccatcagggatggtttttgcccagcggcaggccaggcgccgccggcgaactatgcttgtgtcagcagcaacagctcatgcgtcaacgtgaccaacggtgatggttacatctgcaactgtagtaagggatatgatgggaatccttacatacctaacggatgtcatggtgcgttctcctcctctctgtaactctacatccatatattatcgttcttgatgacattgatgtgatatactcactccgtattttaatgtacgacgccgttgactttttgacaaacgtttgacctttcgttttattcaaaaattttatgtaattataatttattttattgtgacttgatttatcatcaaatgctctttaagcatgacataagtatttttatatttgcataaaatttttgaataagatgaatggtcaaacgttggttaaaaagttaacggcgtcatacattaaaatatggagggagtataacaatattacaccatgagtacacggatatgtgaaaattaattgctgtttgcgcacagatattgatgaatgtgccctccgagatagccatcctgagctccgagtcctgtatccttgttcaagaaatggaatctgcatgaacagaccaggcggatatgattgtccatgcaaacgtggaatgagcggtgatggcaaagcaggaacttgctcagagaaatttcctttacaggctaagattgttgtaggtacgtgacattatattcgcggtgatatttttctgccatcatgaaggaactcataatgcatggatacaaatcccttcatcaacaacttcgtttcgaaaagaaccgttctacatatatactattgctttacagtcaagaaaacacttcgtttcgaaatacatctaatgatcctagaaaataaccattctactatgatctaagcatttataatgattatacaagaatgcaatatgtagctttgtaatagctctacttggctgagttagacaaactaagttgggaactcatctctcacgtacgcaaaacgaagcgactcattagtgcatgattaattaaatattagctattttttaaaatggattaatatgatttttaaaataacttttctatataatttttttaaaaaatacgcaccgtttaaccgtttaggagacgtacgagtgaaagacaagtgggatgaagttgagaacactgagtagagaacgcaacccgtaattgataggctcacaaatttttgggagcatatggtgtggtacaagggcacttgtcccgggtggactttattcttgtagaacccttttacagtactccaacatacctctagggatgtaacaggctacaattgttactagtatatttttcctaagaaaaatataattgctcctttcatttaatatatcacagaaaaaattaaaaagaccaacgctcattaattgcccttccataactcaattatgcaagcttgtagaagttaggaactatagatatgtattgaaatgaagatgagcacgtcaatttattcttaaaatatgtatatgtgaaatcatacatgaatataatttaaatactgtacatcacaatttttttactatacatttaaattagaaatcgcataatacttttctaagtgtctatatattttagtgttctcaaatcagattagaaaagacttgcctttatggtccagtcttgattttaaatatgattgagatttgattcaaacaaattatattcagggtgctaaacataattggcatatttgtatttcaaatttgtaaacagaaatatgtgatatagttttacaaattacaccacgtgtcctatgaacagtgttaattttaatggcacattaagggatatatttcattccttattctgaggtattacctccaaccagataagggcatgtaaaaagctagagttcgatttaggctcttagttaatacatatcacttagagcaagtcatatcagctcctatatgttgctcataaaatttgccacataggattagataatgacgtagaggaaagaagttaggagagaaaataagccattcctcatgcaagggataacttccacataattttcaagcaaagtgcacgatggtgttagggtttgtgtattagatgtgatacgttgtacttgttacctcttaattaatgagtagatgatatgatttaaattagaggtgacatcaacctccactgtaaaacttgcttttagagactttttctataataattaagacaacaaaacatcttacccattaatgcacgaaagtaagtttttattaccctagtttccttttctttaaccccatgcaataaaattttatctaataaatgctaagagtcgactaaaaccgttgtaatgcgtagcaactatgtttccctttccttcccctctctcttccacatcggaaaaagagcccgttattagataccgttatacttttttttaagataataataccgttgtgcatgccctaatagatcacacgtaccattgcttcctagtataatgaacggcgaaaaaaaaactgagctccttaaaaacttcattttattaagataaccataagggtgaattatatttttatataaactcagtcaaacgtttgatttacggccagacgtgcttatatggtcttcaaagaaaaaactgtgtactcggctgtactcgccagcatataccagaggatcccctcgacgaggctgctgcccaggttcccgtcgttgtggatagaactgcagcctgattcccacactgagcagatcagtcctctgtctagcataagattgatatggactgggagttcgtaatccagacgcccacaaagctctattacttttccttccctcttgtctcatccctgagttggtgaatttaatcaatggcagcacggtttagtaattcggtccgttgtgtcaggtttgatgtaggctacatataaaaacaaaacaaaaaaaaaaacagatcagcttacaaggatttgcttttgggaactgttctcttttagatcgatcttggaccatcattggcaagaatggattcagggactaattttagtccctatcacatcagatgtttggatactaatttagagtattaaacatatattaacaataaaactaattgtataaatgagagctaattcgcgagataactttttaagcttaattaattcataattaacacaagtttactgtagcatcacataggctaatcatggattaattaggctcaatagatttgtcccgcgaattagtccagggttatggaatttgttttatcattagtctacgtttaatacttttaattagtatcaaaaatccgatgtgacagagactaaaaattagtccctggatccaaacataccctcagttgttgactagaggtttttagtttgcgacggtggcgagcaggacaagttcccagtatgctttggtgtggcctccggacttgtaggaacggagattaactccctcaaggatgatgtttatactattaagtacctcttcttcaaaagttgtgctgtttttttctttgaagagcataaaagcacatctcgtatttgtagtacccttggtaaatgtaacgagcattttcaaggtgattctatatgatattttaaaattttaatgtattaaagatttatccatgtaccacatttagtatttacaagttaattagtcattgacatccaagcaatttaaaattttgttattcatttactctaaacagtatagaaacaataaaaatatcattgtaaaactcaatccgtcagtttaatatttatagcttcatgatacattattgtggttcgtttcaatgatattgagtactctattatatattccacatgcaggtgcaataggtggtctctttattgtcgcagtccttgtgttccttgcacttgttcacagagagaaaaggaagatgagagaattttttgaaaagaatggtggtcctatattagaaaaagtcaacaacataaagatattcaagaaagaagaactcaaaccaattctgaaagctagcaatattattggaaaaggtggattcggagaggtttacaaaggccgtcttgctgataacaaactggtggccgtaaagaagtccatcaaagtcaatgctgcacaaaaggatcaatttgcaaacgagatcatcatccaatcccgagtcatccataagaacattgtcaagctgataggttgttgcgtagaagttgatatcccaattttagtatatgaatttatcactaatggcagtctcgatgacattcttcacggtagtaacggagaacctctcagtttggatttacgtttggatattgctgccgaatcagccgaaggtctggcatatatgcattcgaaaaccaccaatacaatcctgcatggtaatgttaaaccagctaacatacttttggatgacaactttgttccaaagatatctgattttgggatttcgaggctaattgccgtagataaaaatcaacacacagataaagtcattggtgacatgagttatatggatccagtttacctacaaacaggactattaacgaagaaaagtgatgtctacagttatggggttgttctcttggagctcatcagcaggaagaaggccacatattctgacaacaatagcttagttcggaattttctagatgctcacaaagagaaaaggaaagcaactgagctgtttgataaggatatcacgctggcagaagacttggacgttcttgatggtctcgtgaggattgctgtggaatgtttaaaccttgacgtggatcaacgaccagaaatgacaaaagtaacagacgatcttttcatcttgatgaaatctcgagctaaagagaccaagcagtaaccagacaaaagttgcaagatgcataagatattctacatggttcagaggatttggggaggtaccatgatttctagcttatattttggtatccttgttatgcgttcttagtgttaagataccttgatgtatcataaagtgataaataagatgtcgtaccatcttaaaagtattgtaaaattactcttattgttgcattgaatctgtgtctgtaaaataagactgaggccaactatcagtgtggttgtggaaaaatggcactacgagacattgaatgcatcagtgtatataacttcagtggggttcacatcctatagcataatggcactaccattatagacattgacgtatggtgcaataggagggtgagaccccataccagtgattgtaatggtagtgacattatagtagaggatgtaaaatcaaagtgtgtttgattcttattatgtgatgaacaaaatgacatatcagattattggttttgatatttggagattattagtgaagtggttttggagatgattggatttgcaggtgatgaataggtgctgttggatgttaggtccggtcagaccggacattggttgccggtcagaccggcgtgtatcgagcggtcggaccggctagcccgtggtctgaccggccgactttgtgttggtttcggtttcgggttgtttcgttggatatccgtggttagttcatgtttatggcttctagatggatactatacgcatgtaataccattgtttgctaataatgagtcaagttggagatagcttggtctcggaatatggtttctttgtttgatatatgtgtagttgtcttgatgcctcgggagagtattgccgatgatggatcgggagtcaacttggagataaggtggcatccggacagttagatatcatgcgggatacttaggctaaacatcaatgcacgtagttggtgaagattccattgtgtgcatatgggatacgaagttgaatttggaaggagtccaaaattagtatgattggagtttgtaaagttggtttcttgtacgggaaggtttcctaggtggattaggatttcttgtatgagtttggttcgtggttttatgctgcctagctcatccctactttctataaagttaatgccattcacatcacctcaattgtttttagcctttgcatgattcatcaagagtgtaaattacatatcttcccccaaaagacacaccatacaacacaaccatttataacctatggataattgataaaggcacaaagatatataaatacatgaaaaaaatcatatagtaggtaagaaaattttttttggaattcatatctactatattatcacacagttctcccatagcaacgcgcggggtatccatctagtgtataaatagatggagggtgtggcatcccagtatcgcttttgagagcattgagttgagagattagttagggtttcgaggttagtcgagattttcgtgaggagtgctgttgttgcactttgtaaacatagatagaagtaataaaattatcatctacaccaagagttcttcaatttgtatttgctcgggttcgacggtccaaccggtgggatactggcgatcagaccaacggcattgcggcggtcaaactagcggagtaacagtggtcagaccggcagcgacaacagacattggtgacaagtttcggtggttagaccgagagatcaataccggtcagaccggcggctacggttcggtcaaaccggttaatctacaccggttagcccgtgattcatcgattcgagggtaaattttatttccgctaaaatttttgatttttgggtactacaaccattcacccgtctctggttggcttagttcttactgtttggtcctacggagaattctcacccaacttcactgttatacctcacgcttcaatgaagcattttcagaaataaactggagataagggtgaacattcagcttttaaagcattgcttggatagacgatgtctaactgtaccaaacagaccatacttgtgctacaattggagttccgacgaagacatggcaatcggtgaacatggggcatcacatttctctttttttccccgttaaatatatagtggcacattgcggagtgaaatggtaaacttaaaaaccagagttgaatatattttcccagcccatcaaacacatacgggtcatctcaacatcttaagcacgtgaaagaccggtgcctgctatagagggagggtgaatatggctttctaaaaatctttacccaaatactcgctcaaaattcttccacaatatctcccttagacagaagctatgtgataagctagatttagcagaaggttgagaaaagatacaaagaatctagttgggatgagaacttcaacctcccaaatagctcgaaagtcatatgaggttgcctttccgttcatcgctaggaaaacaagagccgatagaattagaaggagaatagaaacacactccacataaatctagaaagggagggggcaatacccataaattgatatagtataaatttaaattatacgaagtaaatacaaaatttaaattgcacaaaataaattcaaatcaactcataacaaaagagtgttcgcatgttagggttagggtttatgcgccacccgggtgaccgggcggcggcagagctctcgcgtgtggcgagatgggtctggatggagatctcctccaatatgctcctgatgtctccgggggttttacccgccgtgggttgttctgggggggatttcctccctgtgttgaaacgtgatctggtagggtggcttgatcatactcgtataggagataagttgaaggctttccctttaggcggattgatctatgggaagggttcgttctctgctttccatattgttccagtggatctgtggcccttgcgaaattctggaagggggaggagattgaatctgttttggcatccgaagttcgagttgtattggaatcctaattctgtggctttgcagtataaatacaaggcacagtggtggccgaaggtgcggttcaaagtttttccggagatagggctaggcgttgtcaaccccgtctctttgtttgttggatctagcggaagtcccatggcggccaatgtcggtgggggtgataaagggatcgtcattgggataatttcccacccgaagccgacgagcggtaatgagacggacgcggtgattctcgacaggattcctctgaagatgatcaagggagcagcgggcacatctgatcagggccaggaacacacaacggctgcgaggaggggatctgcagagaacaaccaagttgatgcaacacagggtcctacggtgttcaccgaaggagatctggtggaggatgatgaggatgtggttgtggtgaatattgaggatgatgaactgcagactgctggcctgtggacgatcttggcgaggttctattctctgagaactccgaaccaagtggccctgtttgacgacatgcgcagagcttggagattgagagcagatataagctacaaatcactacgtgacaacatgttcatcataaccttctcggcagagggagactatgattttgtcattaaagggggtccttggattcatagaggagatgcgctcctggtagcgagttttgatggcattacgtgcccatcaaacgttcctttggatgttgttccgatctgggtgcgcatatatgacctccctctggtgttgatgacaaaggtaagaggtgagatgtttgggagcaaactcggcaaagttcgtgaggtagacgtgggggatgatggacgcaacaaacatgattttttccacattcgtgttgatctccctgtcaagcgtcctctgaaatcacagatagctataaggatgactgtccaaggcaaggaggtccttcgcaggttcgatttacattatgagcgggtaccgcacttttgctttatctgtggttttattggtcattccgacagagattgcaatagaagatctgctaatgaggagcaacctttccaattctcagctgagctacgatgctccccccttaaaccttttgagaagaagatcagtaaagtgaaagctgcccaaacatcaagtgttgcacgtaacttgttcttcagaggggcaggaagtgctagttcgttgtcctccagacacaaacaagatggtcagatgcaggaagcaataccgcccagagttgatgcccatgatgggtttgagtttaaggaaagggaaggggacactgcaatcgatgagatgttagctcaacaggctgggaagatggatgttacgggggacaaaactcagggaacatcgatggttgtccctgctgggaagctagcccagcaacaatcggagaaggaagcacccaagaagactgatggtgatgaaatttctgcttctgagatgataccagccatgaggaaccttcaacagcaagcctcgtttggggaagtgtcatccgaggagatcagcgatgccaataggaagaggatgccagaccagtcaggactccagataaaagggagggttcagcaagcattgttggaataccaacaatacacaggtggcagcaattccatgcatggggatatcggcaaggcagctagagcagtgaagagactcaagaaggctgtagagggtgaggacacagacgatatggaggcaaccagccatggggccgctggtaaactgacgggacctgtgattgggtcccgtcaggagcaatgagttgcttggcttggaactgtcgcggtatagggaacgcggtgacagttcgtgacctttgtgccttagtgaaggaggcaggttcccatattgtgtttttaagtgagactaggcaaaagattgagaaggttcgtaggctgcggaatagattgggtttgaggggttttgctggggttaacagtgatgggatgagtgggggtctggctttattctggcatgagtctattcatgtggaaattataagtatgaatgagagatatattgacgcgtatgttcgtttatctgtgaatgctcctgtctggcatgctacttttgtgtacggggaacctagagtggaaaacagacatcgtatgtgggcgttgttaaattcaattaagcaagtttcggatctcccgtggttagtggtgggtgattttaatgagactctttggcagtttgagcatttctctctaaaacaacgaagtgagctgcaaatgcaagcctttagggatgtggtccagagatgtgatctccatgatctggggttctcgggggtgccatacacttatgataataggagagaaggacgcagtaatgttaaagtgcgcctagaccgcgcccttgcagatgatgggtggaggggactgttctctacagcacaggtgtttcatctgtcctctcctagatcagaccattgccccatccttgtcaagtgggaatcctgtgaagtgtgtccattatgaaatttactgggaaagagaccctgcaatctctgaagttatagcagaatcttggggcgtctccggagttaagcaggatttgagcgacattagtcaagctctgtttaggatgatgtctgatcttcgcacatggagtaagaaaaagttcaggaatgtcagccgggagattgagaaaaatagaaagaaactatctaaacttcttctaagtaatgccaacaacagggaaataagacgggtgtccgattaaatgaatgaacttctgtaccgtgaggagatgatatggctgcaacgatctcgaattgcttggctgaaagaaggtgatagaaatacacgcttctttcacaacaaagcagtgtggagagctaagaagaataagattacaaagctacgggatagtgacgatactgttcacagtacgacaaaagagttggaacgtatggcaactgagtatttccaaaggctgttcactgccgaccccagtattgatcattcgagagtcactagcctgatgaagccgaaagtcacagatgcgatgaatgaggaactatgcaaaacctttagtgaagaggaaatagcaaatgctctgttccaaattggtccgttaaaagctcccgggccagatggattccccggtcggttctatcagaggaattgggctatactaaaggacgacattgtgcgagctgtacaagaatttttctctttgggtaccatgccttcgggggtcaatgagactgccattgttctgataccgaaaactgagcaaccacaggaactaaaggatttcagacctatcagtttgtgcaatgtggtctataaaatagtgtctaagtgtttggtgaacagactaagaccaatcctggatgatctggtgtcacagaaccagagtgcctttgtccctggtagattgataacagataatgccctgatagcattcgaatacttccaccatatacagaggaataaaaatcctgagaatgcttacagcgcatacaagttggacttgtccaaagcgtatgaccgtgtagactgggaatttttggagcaagcaatggttaaactgggtttcgctcactgttgggttaaatggattatggcatgcataaccttggtgagatatgcagttaaacttaatggaaccctgttgaacacctttgctccatcacgaggtctgcgtcagggtgatccgctttcgccctttctattcctttttgtggctgatggactgtccttcctactagaagagaaagtggatcagggagctatgaacccaattcatatatgccggcatgctcctgctgtgttgcatttactgtttgcggatgacacaccgttgttctttaaagcggcaaatgatcaggcggtagtgatgaaagaagttctcgaaacttatgcttcctgcactgggcaattgataaatccttccaaatgctccatcatgttcgggcaaagctctcctactgctgtccaaaatcagataaagcagaccctgcagataagtaactcctttgaagataaatatttgggctttccgacgcctgagggtagaatgaccaaaggaaaattccaaagcctccaggagagattatggaagagaattatgctgtggggggagaaatttctgtcaactgggggaaaggagattttgattaaagcggtcctacaggccatgcctgtttatgttatgggactcttcaagctcccggaatcggtctgcgaggaattgacaaaactggttcgtaatttctggtggggagcagagaaagggatgaggagaacgcactggaaatcctgggactgtttgattgctcagaagttgaagggaggtatggggtttagggatttcaggctgtttaatcaggcgcttctagctagacaagcctggagattgttggacagaccggacagtctctgtgctagaattttgaaggccatatactacccgaacggttctctcattgatacaagttttggaggtaatgcctctccaggctggagagcgatcgaatatggtttagaattactgaagaagggcatcatatggcgcattggcaatggtaaatcagtcagattgtggagggatccctggattccgcggagctattcaagaagacccatctcagctaaaagaaattgcagactgagatgggtttcagacctgattgatcagtccgggtcctgggatactgacaaaatctcgcagcatttcctgcccatggacgcagaggccatcctaaacattcgtttatcttcaaggctggaagatgatttcattgcttggcatccggataaactggggagattttctgtcagaagtgcttatcatctggcagtagctctggcacatgttgatgaaggctcgagttcgtccgggaatggaaatagcagagcctggaatgccctttggaaatgcaatgcgccccaaaaggtgaagatttttgcctggcgagctattactaacagccttccaacattggaaaataagaagaagaggaagcttgaagtttcagacatctgaccatttgtggggtggagtcagaatatgttgctcacgctttgtatcgttgcccacatgcccggtaattctgggaagcgatgactgttgatatgaagcttaaccctctcagtaacattcgcaatggagatccgaaagtgatcctggacctgttggagcagtcgcagccggaggatcaggtcatgcttttaatggtactgtggcgaatctggcacacacggaatgaaatagtgcatggcaaaccagctccaggaatgctagtgtccaaacgtttcattgaaagctatgtgctctcccttgctgagatcaagcaacacccccaagcaagtcctgagaaggggaaacatgttgtggatgtggttcaaaagaagttgcacagcatcaaacggagtcgagaacctgttcctgacaaatggttgaagccgctcccaggaagcatgaaactgaatgttgatggctcattccaggagagtgacggcaagggtggtataggcgctgtgttgcgcaattgcacaggagaggttatttttgctgcttgtggacatgttgattgttgtagcagtgctttggaaacggaactccttgcctgcagggatggtcttgctctcgccctacaatggaccctgctgccaatagtgattgagacagactgcttggcgatgatccatcttttccgcgatgcaacaggtgctaaatcggagctggcgtttttaatcagggagatagattctctcttggtgggaaatagggatattagcttcagtaagtgtcttagaagtcaaaatcatattagccactatttagcaaataagggccgttgtgacaagatcacacagttttggccggacaataagtgtacttttatctcgcagtttatctgtgaggaggctaatgagtaattatccctttcccctgcaaaaaaaaaaagagtggaaccaacacactcaaagatacaccttcacattatatttgaatttgaactcacacaaaaagccctagatacactctcccacaaagcacaagggacacctcaaacctgcaaaaaagggcaccaaggggggcaggggtgagtttacctcttttccgtagtttctaaatcatcgataaatcgtctataaaaaatactctgttaacctggaggaaatcctattgaacattacggttaataattggaattatcagggagaattttttttgaaattctctatgcttaaaatcattaacaggactttaggggaatattcagagcagaggaagtaataatgttaatttaaaatgtcaggatttgaattaataattctttcctccccctcccgtggtcgtgaaccgttcttggttcactgtccccgtgcgcggttcgtcgtatccaccgacccctttgccgctttgctttcgttttatatgacgagccgagtcctattcctattcgagtcccattcccttttcctttcctgaaacggcactcccactttcctttttaggttccccttctcccgtattctttccctcctccccagccgtgcgcgcgcgcctttccctctcccactcgaccgaagccgcccccacctccctctcctttgcgcgcattaccgccggtcccgccaaatccaactccacctccacctatataagtcatcataccctctcttttttttatttctatcttttgccgtcaaccctagccgcccctctcccgtgtgccaccctagcttgccgccgccctagccgccgccgccgctagttgtcgccgccgtattgccggtgagctcacctccctattatccatctcaccggtatggtttattgctgaggtttttccgctagggtttaatctagtctagactaatctgttgttatctagcgtcatcgttgtctccgggtgttgccgccggattgccgccgtcgtctcccggtgaggactccttttcacgccatgttttagttttgtgcgtcgccgtcgttgtgtagtcactgttgcgttgttgccgccggcggtgccctagcggcgccaccatgccatgctgctgctgcgcgcgctccgttgccgccactactgcaccgctgccgcgagttggccgtgctgcagcttgttgagccaagccaagccatgccctagtgccgccggtgccgcccgcgctagccgcgccaccgctgctaccatgttgtgggcgtgtcgctgctaaaccatgtcgtcgtcgctatctcgctgctgctcgtcacgtggtagccaagttgtctagccgcagccatattcctaagcctctaccagccttgccacagctgttcattagtcgttaatcattgttagcacgtagtgtagccaaagtctcgttcgttcggtcgttttgagtcgttctgagctgccggttccgttcacctgttcggttgaccatttgagtggtcccgtgtcacggtaggttgattcgttgagtcgctaacccatgaggctcgcttaccggtgttatattttgtcacaccctaaaaatcttaaatatataaattgttgattaattggaatttttagaaattattttaaaagcctacaagctaaaccctaattttctaggaaaattttcaacataaaaatgagctagataaaattttattaaatactatgcttgctcctctattttctagaattttctgggaattatttgagcaagggaagtatttttaataattgaaacaacattttacaaattgttttattcaaaaaagttcaaaagttccccttcttggtccttgggccgaattcggcccaactctctctttcctccccctcctccgcgcgcggcccacgccggcccaagccgctgccgcccgcgcccctctcgcggaggccgacaggtggggcccacctgtcgggatcgtctccctcctccggccggcgccgccgcccgagcccgaaccctagccgccctttctcctctcaattcgtcctaa

SEQ ID NO: 74443 - DNA, 626 bp, Oryza sativa
ttcctgcagccctagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcatgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacaaaagagggcacgcgggcaacgaggtgcagcgaaaagcttgagggtcggcacatcataacggaagtggaagaagatggacgtcctagtgccccg

SEQ ID NO: 74444 - DNA, 579 bp, Oryza sativa
ttatatttctgtatagtcgatctgatcatggaatatatttcacgttgtgttatgcgatcatttgaaagtaaagtattcgctctgggtccttcggaacgacgagttgctatgattaatttgaatatgttctctgactaagtatgcacttaagctgcaaaaggaaaactttcatgaatagctatttactgaagatgagacattactagcattgccacgtgatcatatttttaatctacatagtctgcatgctcataggtggttgccattgattatctgagaatgcaaggaacatcgtttatgttgtcaaatacaatttcatcccactcaatgcaaagaaattcccttgatctctctccaactgtttcgattactttgttttctttaatggcctcaaatatcccacatttgcagatacggcacatttgcaactggtggatgtgacagttttatggcctttgggatggcgctagcaaaaggtaaattgtcttccgtgatatatttgttgaagaactatgtatgataacttcagcgtacattattattttttcttcttttaattgaagtgccccagccctcaaa

SEQ ID NO: 74445 - DNA, 581 bp, Oryza sativa
aggatccgcgacatgggatccacgagttacgggttcacgtgtcagtcagttagggcatgttattataaccaaaataaactagagcaagttaacaatattgtcaaaattttagcaagatttcttatgtatttatcaaatttggcaacatttttttaacttttctaaaaaaaatagtatagttgaaaatagcatcaatttgaacaacctgaatagtaagttaaatgatctatttttaaatttcacgcatcatgaaacataatgttatttatctatacttcatcgtctcttagcttgtgacatcaacgatttggcagagacagaagaacaatccaacaggtgtacgtgtcgtactacgaaatcttggaacttattatgagagaaaaaccattgccaaacaggatggagctggaaatgtcgatctggcgaatggttccatggttccatgagcccacaaagatagcaaggccaaagtatttgagcggattggatcttgattatttgcaaatactacaaatgacagcagggttggcaattccggcactctaccagtaacaaatgaccctagtagaactgcatcctgc

SEQ ID NO: 74446 - DNA, 41814 bp, Oryza sativa
  unsure (1)..(41814): unsure at all n locations
aaagactatcgaaagaagagactatctagaacacaacacgagattaattaaaatccagaataaaaaataaaatcagtagtaatacaatttataaacaacaaaatatcaggacggaaaatatggaagtttgtttagaaatagtccatctagaacacaacgataacaaatggcgataaaaaggggagaaacaacaggcccgtaaaggagtagggtggtggctgtttatgggacatctaaaaactataaacaaaaccccaaatagaatcccaatgacgattaagaggagggacgacgggtaggccgttaagcagcatggccatgacggttagcgggacttctagaaagtaaaaaataaaccccaatgttaatcatgctcgttttttaaaatctcaatgataataaagaggggaggctgcaagcgggtcgtagagaagtataatggcggagccgctgacggtttggcgggacttctagaaagtaaaaaaaatgaaccccaacgacaattatgttttgttttttaaatcccaatgatgaagtgaggaggcagcgggcgggccgtagaggagtacaatagcggcgtttgacagggcttctaaaagttgtaaaatgaaagccaatgagacaatgaactctaaaactacaatgtccaatttttaaagattccaagaaggatgagtagaagtcatagtagatcaagcaaacaaataaatgggtgacaaaggagtaaggggtagcgattggcgtgacttaaaaactacaaaattagaaactcggagatgataaggcaatgagatagctatttaacaaaattttaagtaaaatcatatgtaaaaatagataattttgtatgagtgccattgagctagttgtgtttataatagaaaatgattgggcttctgtttgtcccattgagctatactgcaaatgtttttttctcagtccttgcaattatcattccctgcttatatttgggctctatttttaaattacattgtcaatcatttatttcttcttatcccttgcagatatccaggaatttaacaacaaatgagatggcaaatgccatgaggtatagttatctcagaggcccaggtggccgattcagaaatccatttgaccatggggtgcgtaaaaactgttctgacttcttgctgaaagggtacaatgaggatattgagagggtagaacagacattacaacctgatgaggaattgggaatgattcaaatgacaagaagtgcagtctcacagaatggcgagagcatgtcacttcatgctaatggcacagaccatggttgtgctgatccacaagggaactcaaaatcccatcgtcactcgcacggttcatcacaatgttgcagtcacagtaagagacctgacaagacccccttggggctaggattgggccttggtcgtaacaacccatctagccgctacacacgttcacttccttccattcattcggagagtagtgcttatttgcccttgtgattcttttggagaaggcgagctagatcgtatttcaacttgtaggtgtttattgcacaaccacagctttcttttggctatttcttcctgcagtatttgtcgcttggatctggtctcatcgacattgccagggtgtggtatatttggaggcccaatcaaccgactactgaaattgagaatatgaaggagatgcaagttttatgaaggcttcatgaacatccttagcctctcaggaacaccagcgaatgtctgtctaggcgtagcaatattttttgtgcaaaagtgcatctttgtacaatgtctcaacattttgtatgtacaagagggttagctgtccagatactatgatgttttcaagtacagctgtatattggaagaactgtaaatttatatagcgaaaccaaatgctggcaaatgtttgtttctctccattttaattttggcaacattagagtatagtcttggaggacttgcattgtcagcttgatcacaacttgtctttcaaacgtaacttagctatgaccgtatggataatttcgaagttttcgaatgctttaactttcagttccaaaaagaaaaaaaaagcatccgatatgatggatcatgattgtgatttgtagtcacattgtccaactgtgttatcgagttgattatatggggataaataaacttagcaaataaataactttaatcaagtggtgtaagtagaataaaggtttttattttgagcaaagatattttttaagcgtgaaacaaataatctatttcagaccggtgaataagctggaaaaaaacatggccttagttgcgtctctctgaaattgcggccaaaatttaaaatttaatagaacaatacatttttttgaaacaaaaaggacattttttacttgaatcgaactattgcttatggaactcatacaaaatttatgtggaatgtttgcttagtgcatgatctcagcgcccgtaactcgttcagaaaaacaaaggggaccaaaatacaagtcataataactcataagatcaaatggctccgatcgttcgagggcattgccttctcttcggctttgtgttcagtacattatcaaaatcgactgtatcaaattttagtactatcaaatgattcttttattgaaagtactgtcaaatgttaatcttagttttcgtaatgtttaggttttagtaatgtttagggtttattcactttgtagctatttttaacccttctaaaatttattagtgtcaaattttggtatattttaacattaccaaatcttggcagcgttgtatgcttttagtttaaagctttattaaaatttgataaacttttaagagtgaaaacttttagaattggcaaagtttaataaggtgacattggcaagtatatatgtttggtttgttgccttattaaattttggtaatattaaaagtctcatcggttgcctgttttctctaataagccaaaacaacttattaggaataaaaattaatttataggtaaaacttttatatatttgttcgtagcgacttaaaaccaacaccaagaagaaattacattgaaaatatcttaaaatcaatttctaaatcaagctcgaaaatttaaattttagcttttgttttgacttgaccacctgatggggctttaaatcttgataaggttgaaaaaccagtaataaagtgaactataaacccctccaggagtccaggagtcaggactccgtccactgcacctccccgcgattctaaaatagaaaaaaccgcgtgccgccggcgtcgcaaacttgagcgccacgaatcgccgcgggaaacaaatacccccaccccccgcctcgcctctcgatcccaaaacttgcgcgccacgaacccctcctcctcccctcgcctcacgcatttggtcgagcagctcacgcgcgcgcgatggacgaggtgtgcgaggggaaggacttctccttcccggcggaggaggagcgggtcctccgcctctgggaggagctcgacgccttccacgagcagctccgccgcacggcgggcggcgaggagttcgtcttctacgacgggccccccttcgccacgggcctcccgcactacggccacctcctcgcgggcagcatcaaggacgccgtcgcccgccaccacgccatgcgcggccgccacgtcgcccgccgcttcggctgggactgccacggcgtccccgtcgagcgcgccgtcgacgaggcccttcggatcgccacccgcgcccaggtgctcgagatgggggtcgccagctacaacgacgcgtgccgcggcgtcgtcaccaggtacgtcgccgagtgggaggccgtcgtcacgcgcatggggaggtgggtcgatttcgaggacgggtacaagaccatggacatcaagttcatggagagcgtgtggtgggttttcgcgcagctgtgggacaaggaccttgtctacaagagttttaaggtcagtacgtcaggtttttgaaaatcgctaattaatccctatgcctaattcccatttatgcacaatttagattctagaggtctttatgatcgatttagcccctcttctgatctcatcatggtttaggattattatatgggactattgtacgctaattaatcccccatgcctaattcccatttatgcacaatttagattctagaggtctttatgatcgattttagcccctcttctgatctcatcatggtttgggattattagatggctctaccgctaggactttggaaatctgtccgacagaaatgtatatgatcaagttggttactggctcactgctaaggctgcgttcgtaaaacggaacaactcattaacatgattaattaaatatgttagttaaaaagatttaaaaaatcaattaatatgatttttataattttctttaaaagaattagcaagcgtggttatataaaacaagtgagtagaagatgagaggaaggagtatcgagcacagaccgttcttccaattagagtttgggactatggggtttgggttttggtcaatttgacatgcttcggatgcattaatgctggaattatctttagttaataatattatgtgcaaccccccttcccctttttgtgtatttatttccctgtttaaatctctggagctgttctacaggtgatgccttacagcactggcatgaaaacaccattgtcgaactttgaggcaggacagcaccgccaggtcaattgttgttttctctcctctgcacgcccttgtttgacctgctctgttagttgacctgatgtttaattttgatgatgttgtagtttgttccggccgaaacagccatggtgtccttccctgttgttggtgatgtggacaatgcagctcttgttgcatggacaacaacaccctggacgctacctagcaacctagcactctgtcaatgcaaaatttgtttatgccaaggtttatagcgtatttaaatatttttattgctgtgtttgttaatagtacagtctgcatgtatggagtaatttgttggtgattttgggtacgtgaaaaatagtcctgaactacacctaaagcagacagaccatagaaaatggtggacatttgcaatttttttcctgtcatctggtgaacagctggggttatctggacttttaaactaattcacataactcaaaattaattcaagaccaaggctttactcttgccatgcattttgtaattgtttcatttgccacttctgggtacttttactaattgcctacctattctagagtcatgacagaaaacaattactagaattttcaaagatctgctgatctgcagctaatatgcctctgctttcactgcaacttcagattacccttatgtaaactcatactgcatttttttttatctcagatatatatagctgatacttcgattgctttgtaacttacacttgttttatttctgactgtgacttgctctgtttttttaatttatgtttactgtgaaatgatcgcaattttcatacaatcttaccgtgagaaaattatttggttagcttcgaatactaaaaattgtctcttgatcttgttataggtttaggctcatccaagtttatgatatctcatacaaagaaatagtcataaagcattatattttatatttctatagttatactgttcttagcttctatctgaagagctgcactacggtacaaacaggttaaggacaaatcaaatgggagcgtatatattgttgcagaaactaggctagaccaattgccggtcacggtcaaagttactggaaagaagccagggccttcaaaggggagcagtggagctgctaaaaatggactggatactgaatcgtatgaactactcgaaaagattcatggatcatccttggtaggccttaggtcagtgctactgctgttattaattggatcttatgattctttcttccaatatatccggtatcgcattcaaatttacttttaatatctgcaatcacctagtacgaactgatattacaatgctattcgtgtgactagagccaatgggatttcaaatccatccaatgtttcttatccggaaatcttcatcgttttttgagattctaatgcgtccatttccttttgagggttgacaatgttctagacttcataatcttggtttattctttcttttagttactgaatatattattgcagttgtgatcttcagtttattctaagcactcatgttttttgtttccttttgtgatacagatatactcctttgttcgactatttctcagagctgcaggacaccgcatttagagtcgtagcagataactgtgtagctgatgatactggaactggtgttgtacattttgcccctgcttttggtgaagatgattatcgtgtctgtcttgcttcggggatagttgaggtaagaattattcttcttaattcgaagtatagatacattttactcctacacactatcctaagcttaattgcagatgggaaaaatatttggacgtttctctctgtgaaggctaaaactgagatttacctcaatagttattttccttgaatttagcaaatgttgaattttgtcccgagctcatttttcttcttcttgaatattttgttctcaagagtcactttgctttgctatttttgttctacgatacttccattgattttcgccctatgatactttgcactactttatttaccttgatcgggtagaatgaatgtgataacgtttgctctaatcaacaagagtaacagagtacccattggaaattgaattttttttatttataaatttttttattaaaagttttacaaaaataattttccattttgaaaattgacggaagtagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggccgcgcctgcaaatgggggagggcgattttatactgtgctctatatttttttataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgaatcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggccttttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcgtacaagtatttaacagtggtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcactcgaaggcaaacgaggtcctgcgaggatggaacatcaagttacgacggggtgatgttttcgtagaaaaacagaaacaaaacttaagaaacctctgggctgagcagtaccgtgcgaaacaggtgctgtaggtcgaggtcctgctccgacggtaggcgcgcgaggccgtggttgtaccggaccagctggaggtacgacgtccacggcgctgcgacaggagaagacgtgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctagggcgtctggagtgaaggtcacacgcgcacgagtgcgaggaaggtaccagcgaaggtagtcacgatagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaacccctgctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagggtcagggtgcagaaggtccgcctacaattaagaatgaaattttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaagacctgccgcacgcaacctgtatagagcaaacttcaaacataagtacgacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatactaaacaagagtacaaacaaacaaaagtgtttagtccgaacactcatcaccaggtggtcacctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctaaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagatatcacgcctgctcctatcaacacacattatttcataccgatgcacttgtgtgccttgagcaacaactcgatgtctccgtgcctttttgattttatcttccatgtactttgtcactacgttgccaaacactatgttgttatcagccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttcttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtactgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactatctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccccagggcggcaagggggccgcctgcaaaattccatgccccccctcgccgcccatttgcaggcggccccccccacagtacaaaatcgccctagcggagggcggtaagggggccgcctgcaaatttcgttgacggccgtcgcccgagagcgaacggccgtctgccacgtcattttcgccgccctctgagagggcgatttttcccagagggcggtaggggactacttccgtcaattttcaaaatgaaaaattatttttgtaaaacttttaataaaaaaaattataaataaaaaaaattcatggaaatttcatatggtcgtgtagtttttgtttggacttcggcacagggcctagttggctaaaaggcccagggctgacggcccggtccatgtcatggggttttggcctagcccaagcatgacatggtccgactggtgtcaggcccgtgccttggcctttacctcgacacgatgggcaggccggctcggtatggcttggtccaacgatcaaggaggcaaaacagacgagggagccaaaataggcttattctagctctataaggcatggcccaaagagacgagtgattcaaaatagacttactccagccatttaggagacggcccaaatagatgagggaggaaaatagactttttccaaggaggagcatggtggctttcgtgccttcggtccggcccgagtcttattaggccgtgcctaagctattggtgcagtacattggcggcctgccccggtcggcgtgtatgtcgggctggcacggcccgactcttcttgggcctgggtcgggtcgtgtcgggtggcccagtttgccatatggcctagagggcttcaccgagaaagaagtgtttagttcacgttaaaattgaaagtttaattgaaattgaaacgatatgacggaaaagttgaaaatttgtgtgtagaaaaattttaatgtgatagaaaagttggaagtttgaagaaaaagttgggaactaaaccagcaagtctttttttaagggttacatgatgagagagaacactggtggtcgtctggtcgggtgaccggaggacaaagatacgatacatccagtcctcaccccgccgccgccatccaggcgccgacgacctcccatctcggagccggccggtgaccaccgtgccacccttcttccccccacctccaccacgccgccgctccacccccgcagatccagaacgcatcccccgccgccaccagccgccatcccggctttgacgaccaccatccggagcaggtgaccactgaccaccgcgccacgccgcatcccccgccatccaccacctgccctgctcgcgatgtgagctttcctctataaacttcaccttcacctgcccagtccagtggcggctcatcaaagattcacaggaacgatggcagccttcagatgtgttccgccatgcctcgggagcaatatccttgatccgggtaggggttttctttcggacaagtgcttcaactgccgcgaggttggtcatcgggtagcaacgtgtccggttgttcctccccgcccgcagcgtgctcgaccggttgccaccgggaatccaccacgctccttgtcaaagctgcgagggaagtgcttcaattgtctggcagctgatcaccgtgtcgcggcttgcactcatcctccccgttgcctttgttgttggggataaggccatttcgctcggtggtgcccttcttcaggccacttctcctcagcttcacagagggctgtccctgttgcctactcttcacagagtgcagggggataccagtcgatgttgatcacgttcaatgccgacgcgatttctacagctttgatttctcaagctattagcgagaagctttgtatcccacctgccgnnnnnnnnnnnnnnnnnnnnnnnaagatgacaaatgacaatgttggtgccgagtcccgggtggaggttcttccaaagatgacaaatgacaatgttggtgtccccaataaggtggttttggggtgccatttgccagatggtcaggaagtgccctcttctccacccgagggagatttggagaagcttacagcagcgccccttccttcagttgtatcgcccctttctccgagcgcacctaacacagccgtcgcattgactgtttcaacatcccatgggagtgttccttcatctctcaatgaaggacatggggtatctagcaagatagctgcaccaaaggaagagcatgttactccaactatggaccctccatctaggtgtgagcatcttcctcttgaggttgcaccaagcaacctggtgacagataaagcagagctacttgagatcacaaaagctccagcggtgaagaataggttggccaaaagagtgcggcaaaagattatcactgccacctctcgaagaagtgtccctctaccttcaaacatgaagaaaaggcgactcctcattgaccaaatgaaaacatatgtactcatgaagaagctaggcattatcacaaaggatgaggaggtggatgaagacactatggataggtgcattgcgttcctaaaagaggcatacccgggacactatgttcagcttgctgtaatcttatttgggctacacaacgtggctcgtgttccaggaccttaacctagattcatattagtttggtcagatgcgtgacttgtttaggtgttttaggtgttttgggtgctttggtgtgacttgtttaggtgttgggtgttttaggtgttttgggtgctttggtgtttgcaggtgtttagtgtagctttggggaatgtattatagatgttttggctgctttggtgtttgcaggtgtttagtgtagctttggagaatgtattatagatgttttggctgctttggtatttcaggtgtctagtgtagctttgggtaatgatcttgaggtgcttgtaggatggtgttttcagtgggaaccctttcttgggtcgatgtgtatctcttctttatcaatgaaatgaagcagtttctgcctttgtttttttttataaaaaaaagagcataaacttgaaaggcatagggatagccttcacattaaattatgaaatgcataagcattatctatttgctgtagtaaaaagtgataaatatgggccctacaatacttttttttttcaaatgactcttacaatgataggttcatgtgatcttgctgaccatgcacaaggttttagcagaaatattggcagagggtgaaaagtaacaatctaatcagcagttaaggttcgaattgaaaggtttttttactctatatatatatatatgtgtgtgtgtgtgtgtgtgtgtgtgtgtgctgctcatcttggaatatttgtttgttgatgttagtgaactttggcaaaagggggtgttggtgaattctgggggagggatgtgtgggtgggtggggaggtgtgtgcatgtgcgtgtgaaccatctacattactactatgggttgcaaggatatggtctgtgactgagtccaccttgagttgagtatctttaactttagtgcctttttgttttatgttgtgtattgacattgttgccctgctgcattctttttctttccttttctttttgggaaatatgcaaaaggttttgcatatcagcaggttagaaaggttcgcctacaaagatcagatgcttgaaggccgaagccaacaattggaaaaccaatcaaacatgaaagaaattaggtttacactcttgcaacacgaattagcatcctagagagcaaaatctctactgtgcgtattcttctttatatggtgcataatgaaataccttattgtatcatgttactaatttggttagcatgggttatttgatttcaaaatttgcacttgtactctttaacctgaagtatcaaaatggattttaactactctgtgaacaaaaggatggctcctaattcaggttttcattgttgtacccaacaataatcaccatggttttaaatcattagctactgtatgtgctagtaaaactcacttaactgattgtttctttcaaatgcagggtaccgatcttgttgttgctgttgatgatgatggtttcttcaaagacaagatctccgaatttaatggtctacttgtcacagacaaagaaaccaacaaatatgtaatcaatgctgtaaaggtaagtgttttcaaatgttcagttgccggtaacttatgctaactgtaagcagtaaatttgcattcagcttgttcagaaaaaaatcatgcgtttttttacttgatgttttgtatgctgaaattgtatgctacatgtaatattcagaaaaaaggaagacttgttagtcacggaagcgttatacataagtatccatactgttggagatctaatacacctctcatatatcgggcagttccaagctggtaggtattttctgctggtgtaaatttggaccatatactagcacattcttctgctggctttaaattgagctgtagtactctgatattcctgctccaataaaagtttttttttggcatgtttattcttaaaaaaacgccgaatgcttatctgaaggtttttaatttgattgaaaaattgaatatagggctttgaattgaaatatactgatagaaaatacatttccattttttttcacatttgggttacttctcttaccttttgtttataccttttgatgtaactcagaggaatgtagcctaaagatctttgttgtagtgtaggttcatcagagttgaaaggattagagatcagttgctggaatgtaataaggagacatactgggtgcctgattacgttaaggtatgctgaactttgtgttttaatattggctttcattatttgtattgttaacatctttgttatataaatgtgaccaaaggaaaaccctgtagtcaagtgttgtgctactcgagtgggctaccacctttgatgctagcctttctctcatgtaatctgtgtgactcctttcaaccttataaacattggcaggcagttattttccagcccagaaaaaagggtggaagacacgtagcaggaaatcttatattgtaaattctgaaagagctaaaatcaaatattgttcctagcttagcatgcttgttgaacgagttgtttgtccttaattcttaacttggctctttcttggatacagagacaattttcaaaaccacttgctccttcactgatatttccaatgacaatcaattagtagaaaatttcatccaaaacatttttaaaactcaaatttggccttttagccagaatttttatttttttgggtgctgggccctgattactcaaatttaaatgtaaaatgttccatctttttggcaagttagattggactgataaatatttttagaaccaacataaaaaagctaatgctgttttcccctgatgcaaaccatgaagttcagtacttcaatgctcattttcaaaggtgtgtttagttttgctctttgctgatacttggttgatttctattctgatgctttcatggtgtaattctgtagtactaaatttgtaggtacaggacattggttgtgctaacatattatgtatggatggacgctctactgctacttcattcatgcatatgtgcaaccaaatcatttctcatatcagagtttgcacgtgactttttgtcatgcgttttcagattgcacgtttaagactttccatgtggtttcttgccggtgtttatgctgaaatgtttcttgttacttccgagaagctcttgtgagagatttagtttgtagtaactaggaaaccacttaagatttttaataaattgttgcaaattgattttgtgtttcttttacctagatttgtggttcttgacaattcataatgcaggaaaagagattccataactggcttgaaggggctagagactgggctgttagccgaactagattctggggcactcctcttcctctatggatcagtcaagacggagaagaaataattgttatggactctgttgataaactcgaaaagttgtctggtgtcaaggttaattatctttgttatgagagttttttcccctttgctggtcaactaacgccggtccactataattttaatttgagagtagtactatttttttttcatatttcttgagttccaaaatttacatagcacttgacacaaacctgttctaatataaatcctctaaaaatctttaccagattagtgatcttcaccgacaccatatagatggcatcacagttccctctcagagaggggaagagtttggggcgttgaaacgcgttgatgaggtaagttgatcgcaactcataattttacatcaccttgtacctctcaatttccttgagtcttgattcatgtcccaaacagagaaaaaaattatttctctgttcttgtttaagatgtacttttttgatttggattattaggggacactctacctaaaaataattttctaacatagcatatgcaaagagtagagtagtgttcatattgtatgaaaataactgtaggtacatagttccacatcttattgcaaattcatgtttgtagaatgcttttacctaatcttgatcaacaattataaaatgcatctgtaaaatattatgtctaagtttagaaaagtttagattgattattctatttataacatcatagaagttcattgagatagtgtaatatcttaaattattagtaatatcttaaattactaggaaggcatatgaactgtagcgtggccaattcatgttcatcttttttccccttttgtttttcatgcacttttcagttttgagtattaatgtacataatttaaagagaaatcattcatccaagttatattgataattcagcatattgcaggacttacattatgagtctagatttgcttaatgcctgaacggataaatagctattgccgtgtgttttagtggcataaattttaatgctatcgggagtctatagtagaagttgtagcctgcaatatagggtattgaaataagctagcccaattggaagcatggtgcatactaaatttgatgaattcagcttgattactccttgaattatatgcaaatctaggtgttgtgaaatgatttatgtcaatttcatacaagttaaagcagtgatgttggatatcatgtgtataccctgtcttgtcttcactgatgactgttataaattgagaaagtatcttgtgctcaccattcaggtttttgattgctggtttgagagtggatccatgccatatgcctacattcattacccatttgagaatcgcgaactgtttgaaaagaattttcccggagatttcatagccgaagggttggaccaaactcgtggatggtctgttttatctcctgatcttttatttaacagctgttcttttttaatttcccttgatggctcaacattgtaccttttttcggagttcgttctttctgtagattcatgatcataaaacttgatagtattttgtgcatataaaattttaatcgttaatgcaatttaataagaaaaccttgtccagatgtgcttacctgtttacaaatgtgtcgaaggacctattcaacatataaaattttggatcttgcaggttctatactctcatggtcctgtccacagctttgtttgggaaacctgcatttaaaaatcttatatgcaacggtctggtcttggctgaggatggcaagaaaatgagcaaaagtaaaaataattacccttcacccatggaagtcattgataattatggagcggtatgttctagttgaagtcagtgatattggcttatgctgcttatcattttactgatttatgctgcgtctagattttttttatcttgattatacatatgattaattttataacttctgagctgcgattcatacgttcaacatccttttcttttccaggatgccctgaggctatatgtaataaattctcctgtcgtccgtgcggagtccctacgattcaacaaaaatggtgtccatggtgtggtaagtttctttgttccttgcatttatgtaattttatatgtttcattcatagctatattcatatggtcaggctactgatccacatattggttatacttctccagttatgaattatgatagtttttgagaaaaatacttaacattctttgactcaaccaggtgaaagatgtcttcctcccatggtataatgcttatagatttcttgttcaaaatgctaagaggcttgaagttgagggtcttgctgtattttcaccaatcaatcaagctattcttctgaggtcatctaatgtgctagatcactggatacagtccgctactgaaagtctagttagttttgttcgacaggagatggatgcatataggctttacacggttggtcatctttgattgatatttgttctcaacttctgtttcttttcatatttatgttgtgcttgatatataatgataattcattatcttacgttctcaacaggttgtcccttatttagtaaagtacattgacaaccttaccaacatatatgtgcgtttcaatcgcaagcgtctgaaaggtcgtactggagaagatgactgcaggatttctctttcaacactttaccatgtacgcagactttcagtgattttctgcttttgacaacttcagctgaacaggaaaaaatgcaagtcacaacaggatatatttttgggataagatggtggttaatgtttcaatgattatctccttaaatggttaactttgtgtttttgttttcttgattctcattccttcatgtcatggaattatcttgcaccgtttctaatccattttctcatgttcttctatatgactatatatttcattaagctactcctttttgttaatatagcacaataggagactcctttagtcctgttgtagtgctgtttacttgtaaaaaaaaggctactatttttgcttgaattcaacaagataagctgcctaggaatcagaagtttgttcccatggcatgtatttcacttatgtggttccttccagattatgcctagtatgtagaaataaaatttcttgtacttatctaagatattttgatgattaatttaggcgcttgtaacaacttgtgttgtgatggctccgtttactcccttcttcactgaagttctgtaccagaacttaagaaaggtgtccagcaaatcagaaaagagcattcatttctgcaatttcccttcctcaactgggcaggtactttttttaatcagtttaatactcctcttggttatatgctgttctaccagaagtcagaaaattgtatacagtgtgcaacttatttggctctatgatcagatagatgagcgtgttgagcacagtgtcaacaggatgatgaccatcgttgatcttgctcgaaatattcgggagcggcataacagacctttgaaaacaccattaaggcatgctcattatacaactatactatttacacaatttcttgttttatggtgaattgattttatacatatagaattgaccaacagacctagaaacaaaagataaatctgcatcatgaacagttccttcattttttttctttttatgtttgtcactcggtgacttgaatcaatcgacatatctaaaaatgattgcttattatttcttgtttcccaaggcctatctagctcatgtataagctctttaaatatatttaactgagtaactttcttgactttccagggagatggtagttgtgcatcctgacaatgattttcttgaagacataactggaaagctgaaagaggtttacagcgaaactaagattatctattaaaaaactcccagcatcccgttctaaatttatgcaaaattatatctgcgatcagctgatcacttcagaatattctgccttcttttctccatcacatagattttcaatattctgcatgttttcatttttcattctcatcatttggcgactatgatcatatttattgttcaatatttgagttattcctaattatggtaagcattatgtgtttatatattgattccattttctgctttgtagtatgtcaaggaggagatgaatgtcaagatggtcactgcttgtagcgatcccttagtgtattcatctttacgtgctgaacctaacttcaggtaattaatgcctatttgaatgtgcttgaagacttcctttcacatttgtagctgttttctaatattatttgtgtttctgtagtgtgttaggcaaaagattaggaaaagacatgggcaaaatatcaaatgaggtgaagaagatgactcaggatcagatcctaacatttgaggaaagtggcgaaatattttttggcagtcatctcttgacgttggaagatattaaggtaatagtattccttattatggtaaaaatgtacccaagtgtttattttgatcccactgacttgttctgttttcattcaaacaaatgtcagtgttaagggattatgcctgaacattgttgctagaggaaatctttctcccttaattaagtgatctttgacttcatggatatttgtgactgatattaatatagaataatatttatccgttccttcaatttcgttcttaggtttttcgagaattcaagcgccccgcaaatgtgtcagagaaggaaattgatgctgcaggagatggtaccttgcaaacatcttcacatagtttcagcatttatggaaccttttcttacctcacttgatattgttgtaggcgatgttttggttatcttggatctccaagttgatcaatcattgtttgaagctggagttgttcgtgaggtgattcaaaaattatgtcttatcatttggagtatatataatgttccatattgtagatgaatttctttttagttataatgtcaaatactatttggatgtttccttgttcataccaagccgagtagtgctttggaccaaggctggaaaagtccggctttgaaatgccaggcccaagtttggttcccagtcaaaagtatagtttttctatgtgaaatatcaatatttaattatttctgaagatttatgaataaatatcatgcctctagatgatcatgcccaaatttctaacttctcctagctattgccatgataatgtggtattacacatgatctgcaaatattacctgcaaatgtaatttttctacacatggtctgggttttgcgttatttaattacatttaaagttttcatcgctttgtctcttccattatatcttgttcaatttctgattactgtagtctaatgattatgaacatttttaccaggttgtgaacaaaattcagaagttgaaaaagactgctcagctgagactgaccgacccagttgatgtttactacagttcacaggatagcagtgatagctctctcgaaaagattttgcaatcgcaggttagctagttacttaagctaattatatgcgctttcatggtttgctccatgatatgcatatatggtggtgttggttgcaggatcaatatattagagatgcacttggttcccctcttacctcgaaggcacaggcacaacccaatgtggttagtttgaatcaacatactttttacatgacatttcctgcttgccttttgcatgcgtgtgggatatgttacatctgcagtttaaatttgaagttatgtatccaattttttatatacatgtaataaaatgtgagatttgcctgataaacagtacatatttaagaaggatttactattttatatgtttttagaagttatattagttggtataccgtggataaatattgtacggatctccggttgtctcaccatctcagcttttcaccttgctcgcagaattttaaacgtcttaaacatgcgaatattagttatccattgatcatacatattgttatggttttgcaggaagtaatctgtgaggaggcctacaacgtacgtggcatgtctttcgttatctacgtggcaaggtattgccatgtcctttttctgtttatctgaatcttattctgaatgtttgattatctgaagagtgtgtttcacactatcacaccttccgtttactacaggaaacagtgaagcttgttcatccttttatcaaggtatattctgaccgaagtctgtcgtccaagctagaaaactagtttttgcactcttgcattctatcccacataaatatatttcggctatgatatatgatttctcttgttgcttctgtagattgaagatttcccgtgagtagatcccttctttgaatttggaattttattcaaagaaatatgtggttaatgtaattgtagttgtgtggttaactaggaaatagcaccggctattttcgttagtgtccttcccctccctctctttgtaatatactccctccgtttcaaaatatttgacaccgttgatttttttaagtacgtgtttgaccattcgttttattcaaaaattttaagtaattatttattcttttcatatcatttgattcattgttaaatatactttcatgtacacatatagtttaacatatttcacaatattttttgaataagatgaacggtcaaacatgtgctaaaaagtcaatggtgtcaaatattttgaaacggagggagtaaaaggcaacttggcaagtctttgtaaatggggcaattacgtaattaaaataacttcacgagccttgctgtaacatatacaatcagctaagcaggcctgttcaaaatagaatgaaaaagttttcccacaaggattcggagctctgattttctggtcacagtttaaggttaagggagtaggttgtatagcagagtttaaggttaaggagaaactattttaatgccctaaataagtatagttttcttattatccctaaataagtatagctttagttagccagtgacatactaagaataatatgaccattaatatagagagaaatcgagaagaaaagaaagcaaggggggagtattattgattcaatgatttaaggaggaagcactgttgattctatgattaaaaatgagaaaaagatgtactattagggctcctttgatttggaggaaaacataggaattttagaggatttcaatcctataggaaattttttccctatgaagccctttgaaacaaaggattgaatcctatctaatcattcctatggaatggacaatcctatagagattttggaggaaatttagcaagagcttcaacctcttgctaaatttcctttgagtctatatctctcattcaattcctgtgtttttccagtagttcaatcaaacgatcattcctgtgtttttcctgcgttttgcaatcatctgttttacacttatattcctatcaaaatcctatatcgttcctattcctacgttttctcaatcctgcgattcaaaggggcccttaaagagttatagcgaacctctagaactacctatttagatactcctacatgcttgtttaggaatggagtggaggtagcagagaagatgactaacaatgataaatagtggccgggtgaattaaaaaaatatttactctaaaattatttatattgcaaattcttaaccttaaaaaaattccttatataaagaaggaaattgttatgcgtgacttaactttttagataagacgaatggtcaaatgttgagcacggaaacttatggctacacttataatgggacggagggaatactaaattactctcgctattaaagcatgtttaatagagttgttatttttatactcttcaaatgtccatttaaccaccttgaaaagaattcacagactcaaatatatctttcactcgaagaacaaactttattagtcacctggtcacgctcacggccatattcgtctgaaactctgaacaatggtccatgtgcaacaacacaaggatgacccaaactcaatcatatcaacaacaaaaacaatcaaagaaacaaaaaaaaaaaagagagcactcttcactcctcgatgattcctaatctagaagtcctaggatgaaagcacttgatcctattcctaccaccatcctgcctcgacttccgcgacgcccgcgccaggaacgcgcgcgccgccgccatttcttcgccctcctcctcctcctcctcctccgtcgccggcggcggcacgatcgccgccttcgccttcgccgtcgccgccggtgaccggtgcagcctgcaccggaacgagcccgggtgcgtcgtcggcgcgcacaggcagtacttggccaccgccgcgggcgcgccggcgttcttggccggagaagaagaagacgacgacgacgacgaggagttcacggcggcggccatgggtgggtgcagggtgacacttccagccaaccgcagtggcaagcgaggcgagtgattaattttgctactaatcgaagtgaatgtgaattaatgtgatcagttcgtgtgtccatataaaaggttgagaatgtgttcgctttgggacgcaaaatgtttgttggtgttgagcacaactgcctcctcgtttggaggcagaaaaaggctaactgaattggagagagatcctacaaaaaggggcgtactttacgtttatctggatgaaaggataagatgtcgattccagtgaggacaaatataatcgcggtgtaaagcaccgtttgctatcttgaagattgtatgatttgtctttgtgttccttgcactccggtatgttttcttgtgttttttttaaattacatatagaagagacacaccacacccacacagcttaaaaagaggcgaaacacattctccgtgatcctggtagtcgatcagtcgccaaaatggatcacaagacattcgacgtcggggtgatcccagtgacttggtttgtctggaagaaacacaaaagggtgtttgatgaaaaagcctccacgatataacaactttgggtggtcataggagacgaatggaaaaccaacatggaggacggcatgcattgaagagcaggtacaatagcatgctataaaccagctgcaaacatattttaagaagataaataaggagagagaagaacagcgggctacaaacatattttaagaagataaataagaagagagaaaagcagcgggctataaatttgtagacagctgtagcacggactacaaaacacagtgcgtatgataggtgggaccaggtattaatagtgtagtatataactattgtatgaatgagctattagattggctatagatgaattggagctagtagttggctatactattaaacttgctcttagcccgatagtggtggtcggagtgcagttaactagttctctaaagttttagagtgggtacaatagcatgctacaagttagctgtaagcacatgtggaaaagagaagagaagagagagagagcacggactccaatacgttgtatgtatgagaggtaggaccatatattaatggtatagtatatgtttataggtaactattatatgaatgagctattagattgactatagacgaattgaagctgctagttagctatactattaaacttggtcttagggtgtgttcggcatcctgttttcccaactctcccctttcgtttttcgtgcgcacgcttttcaaacggctaaacgatgtgctttttttataaaaagtttttatacgaaagttgtttaaaaaatcatattgatctatttttgaaaaacaaattagctaatacttaattaatcacgcgctaatagaccgtttcgttttccgtgcgtaccgttccttttgggaactggctgcaatgccccttttctcaacccatctctctcatttttcgcgcgcacgcttttcaaactgctaaacagtgtgttttttgcaaaaagtttctaaatgaaagtttcttaaaaaataaaattaatccttttttaaaagaagcaaatacttaattaatcacacgctaatggaccgctccgttttccgtgatcactctttaagatagaaacttgttctagcgaacacagcctaagtagccttgtaaaaatgtggttgtaacagcagtgcattgacgtattgcggaagagcatcgcagcgtccgcttttatatttccttcattttaaaatgcatgacttgttaatatttcatatatcgtttgatctttcatcttattttaaaaacatatatttcatttattttgttgtgacttattttatgatcaaacaaaatataatcttaacctatacttttacatatttatattaaattttgaatgaaacaaatgaacaagttatgtgaaaagtcaacggtgtcgtatattttaaagggaggtaagacattctttctaaactcttaatatactttggccggcgagcggcgagacatttcaaatattccagttagcagaaaagcaaaagtgttttgtgttctaaaaaagagagcaaaagtaagtttctatctgtacatcattctggggctcttcaagagcgctccttcctccaaatgagagtgatgcaccgtgtacggcgacgccgccgccctgagctccacggcgtcgcgccgccgccgcctctccctcgagtgcgccacccacagcaccaccgacgccagcgcggcgacggcgacggcgagcaagccccggtacacctccgcgctgtgcctgccgagccccgggcagtgctcgtcgccgaccacccggaacgcgcgccggacgaacgcgcagtccgccatgtcggcgagcaccggcccgtaccgcgacagcgcgtcgcacgcgctcgccgccgccaccatctgcgcgtacatcgccggcgtgaggcgcccgacggtggcgcacacctccggcgccgccgccgcggcgcgggtggtgcggcacacgcgttcgcgccacgcgcgcggcgcggcggcgaggtcgacctcgccggggtcgcagcgttcgccggggctgcacagcagcggcaccggcgggccggactggttgtagtagagcggcggcgggaggccggcggcggcggcgttggagacgttggcgatgacgccgttgaggacggtgacgaggtggtgcgtcacgtccttgctccgcgccagcgcgtccgcggccgccgccgtgtcgacgcaggggaggatgtcgtcgagcgccgtgcgcgcctgcgggcgctgcacccactcgcccatggcggcgcaggtgtcacccaccacgctgaaacgtcaaggaattcttttgctcagtgtcgagacagcaggtacgtgaggtcgccatggcagcaagcaacggtgaaaatgtagaagaaagtttttaaacaaaacatataccccatcacaaaatatgacttgtatatcatttaaaatttgtctaggaatattttgtctaaaaaaatttacagaaaatctcgacgggatacccttctatgagacaatacctgatacctgatacttgtagtggtactagctgtatggtacccgatacctgtgatacttgttacccggtacctatgatacctagaacctaatacctgtgatactcgtgcaagagaatagttaatatgtctattccgttgcaacaggaccctgttttgtagcagccctcaaaaaatttatcccacaatataacaacttctacacctacatttcattcttaatcaatcataatcttccctcattcaaattgactacccactttctcttcttaaccaattattatttttctccaatttaatatcacttatttttttcttaatatccatgtccagtggtaactttctcttgttcaattctacctgcatccttatattttggaacatatgtatcattttttgagacgtgaagcaaataaaaaatagttttttctagacatggagcaaataatttgtggagtgactaaaaagatcgtagccttacttgtgtagcagaaggaaggtgccacagagcaaaagcgttgctgcaaccagaatccacccaagaaacaccaacctgcatccaaaacaaccgtgtggctcaacaccagtaacagatgaatatttgggaatcttatgccaactagggcaattctttttaattttttgtaatttcagcatgtcaaatgaattagtgaaatcataaaactctaaaggagtgttttcatgcttacacatagacgagtgactccattccgcatattgagaacgctgagaaaaaaagatgcagaaccaaataagtcgcacaaacagattaattacaaaatgtttttgcaatttcaattcttcaaagaggaaaggaacttgttttctcaccgagcccaagaacagctaggatcaacatcgtggcagcaacaacaatcaaaatcttccttctgcaaacagaacaaccgaaataaaagaatttctatgaacatcatcaaggaaaatacttgttatgaacactcataacagcagtatctatactttctatataattggtacccactaactcctaaaactcaacatacaagtgtgtggtatgccacatcatcatccactagcaattactattatttagagtattttagatctcatacaaatatgatatatcatttgtaatttagttgtatttttaaaacttaacacgcaagcaatgtcaaatcaccatcttcacattatttaaacatataaatctatcatttttataatatataacatacattcatctatatatcccgcgctgcggggtgtagtttataaaatatagcaatctataatcgaatgaagcatatcttatcttagtaggacgaatctgaataagagaaatatctatattcgcaaactagaatacgttttttctgattttaagttgctatattttacgacggattaactgtttattttaccattcatcagtaagctttttacccacattgtctccaaggcgtctcggatcttggcggcgttgctcgccatgcgcgccgcgagctcgtcggcggcggagctcatcttgcgcacgacgccgtcgatgctccccttgacgctggccggcagcgacacgggccccacgccggccgccttggccgcctccatggagctcgcgaatcccctcaggctcgccaccgcgtcgccggacttccccgccacgtactccaccgtcgccgccgtgctcccgtcgaaccgcccctgcccgtcgtacagcacgccgcaccccacgctgcaaacaatggcggcggcggcggttagtttagtttactcaccggcggcgaggtgaggtgaccggagaaattatacgtacgcggcggcggcggtgaaggcgaggaggaggacaagggagacgaccagcgccgtgcaggagtacgagccgccgccgccgcggctgctgccggggcagcagcagaagcagcagccggcgaggaagagcgagacgccgaacacgacgaaccagatcgcggccgcggcgaacaccggcgccaccgtgaacccgaccgactgcatgcacgcgtcgtcacgaacgacgagctcagaataaaatcaagaaacggccatggaacaagaatggaggatggacatggatcaagaggaggaggaggaagaagaagaggagctcacggcccagtagtgctcgtcgctgatgttccacccgccggagtagagcctcagcccatcgagaggatccttccgccgcgtccgctccccggcgagcacgaacgtcgtcgtcgacggcgagctcctgccgcctccggccactgccgccgccgccgccaccaatcacatcaaaatttcacacttcttgccgcgataaatcagacaatgcacacgaaatctttacctgcggatgcatcggcggcggcggcggcgagcaatgctgctaagacgacgagagagagcacgatcagcaggaggagaagaggaggagcacgagacgccatgatcacgaacggcattgggcggcgtcaactactacatgttctacctgaatttcaaacgacggcaatggaggagatggcggaagtatcggcaatgaatttgtgagtatttttcggttggttgtttgttggcttcgaaatttgggcacgaacaggtcttcttccttccttccttcctcttgactcttgcaaatttaattccattccagcttgcatagttgcatgcaccgagcgccatggctaatttattttcagtaatgaaatgagttgtatcttatactacaatggtccattaaaaatctgctaatacctctacttttacagaactgtttcattttgaaaaaaaagggattaaattatgctttgacccttaattccatatgatatgttttactacgtcaaaatacagtactacctccgttctaaaatatagctatatagtataggatgtgacattatctgtccagattcatagtactagataatgtcacatcctatattagatatcaacattttgggacagatgaagtatcagatttgacacatccctaatattactatacatttaaacatatgtataatatataccaatattttaattctataaaaatatgttctagtagctgtaaataccaatattttgtgatgaatctgccattaaattttagtacactagatgtatgtataatttggactaatcattgatcaaaatctaacgagacctggtgatgaatttaagaaaatgaacatttcgccatgttcaaaacatagtttcgctagaatgtcatcccaaaacgtgattgataaaatgccaacatgaagcgtatgtctactgccactttgccattttcgccattttatttattttcaaaaagattttctctcctctactagatggtgagataaaattgccccttataaactcagagaacacggtgagagaggagacagagagaaggggcggcaacgctgcttgctgccggccggcgcgccgcctctccccattgtgcgcgtccgccgcggcggccttcgcatgctccgcccggcgatggagcgggtgaccaatgaggagatgatggcgaggaccacatcagcaacctcccggacgaccagctacgtcttgtcctgcgctggctcgacacccgcacggcggtcgccacgggggcgcttctcttttcttctcctcttcctctcggtttctcctctcgttccctttttctctcttccttcttcgcttctttgctcgacgcggcgagggggcgtggctggtgcagcggcaaggctaggtgcgagctggcgaccgggccaaggcgacgacggtcggcccagcacggtggcggcctgagggcggccaggcggcgtcgggtggatggggagagaaggttggcgtggcggcgtcccagcgccgatgaagacggccacgggggcgctcgcgttgctcggccgccaagctcggtctcgccccgtcccacactgccatcgacgccctcgtcagcaacagcgaccacctcgccgcgctcgatcttgatcccctttcagccgatgaggaggggcaatttggtctcatcaagccaaattccagcgaaaatggatttgaaaatgacgaaaatggagaaaatgacaaagtggctgtgatcgcgcgtttcatattggtattttagcgaaacgcgttttcatgatggtattccagcgaaaccgccttttaaaagtagccaaatgttcattttctcgatgaatttagcctgcaacggctgcaatatttgagaccagtggaaagtgaagctgaacttcggttgcatgcacttgcacatttgcgtggctagctgtattgtacgtaacttatgtagccagtcaacaacctagccataaattatactagctgcacaatgtatataccatcaactatacaatgtatatatagctgaaaaaataggcatgttctgatgtactggtacatatacaagcaaatataccgtcaactgtatatataaatgcaaaatagccatgttccatgtgcatgctaccacgttacaggctttgacaatagggcatatcatgcgcttattttggtgggtttcttttattatcgttttaaaagagaccatctatacatttatcaataaatcttctcctaaaaatttatgtgatgtaaatatagtactccctccatctacttttgataatcatattttatcttggcacacagaccaatgataagtaattctacttatcatctatttaaacatgctactagtattcctcgtaaacaagcgattcattaatatttacatttctcaatgaccatatagccaatcatatgtggaagaatggagagtcatgcattaaatccgagaaagtcattaagatgataggttgttggattaaaatatgcctatcaaaaataaatttttcagatttagaaatatgactatcaaaaaatatatggagggagtacaatgtaatttacattgtaacttaagtgtaactacaatgtaactggtatgtaacttttatttaattttgaaacaattagatttactttaagatttgtgcaagcgaaaaaaaaacacaacgcacacataagtgaggggatttggtcccgtgaccccatcctcgtgaaaatagcatgttatcgcaagatcttttaaaattatatacaagttgtatttatattgtagttacatgtaagttatgatgtaattacacaatgatcacattatatttacactatcaaatttttatgagacaatttatagataaatgtatagcaaaaactgctttagaatatagttataagtatttagacatttaaattttacatctactagtgtcatgtgtgtatgtcgcaacggtgttggaagaaatacgaacggatggttttaggggttttttttgcctgagctaatctttattttcatggcatcaattgctagccgactgtaaattatcatcgttgttagtcgcgcgtaattgccagccgactttaggattttcatcatagttcattttttttcccatggcttatcggcttggatctatctgaagacttaaatgaatagccattgctgttcagaatccgataggacacaatcgagcggcgtttgcttttgtttgtttttgtgcagctgagtttaaattcgaccttatcctcggtgaaaatcacaagccgtgccactataactgtatagaagctaatcggccaattaaatctagagagttactatacaactgaatcatgttaggacgtacaactgaatcctattgggataggatgataccggttaggtatcaggacatatatctctaaggtatactttttccgtaaaaaaaaaccaatcctatgtttgaatctagacacatgtattaggtttttttatttttggaacggatggagtatgtcctgatactccagacaccaaagcatcgtcgccagtggtcccattgtccacgtcccacgtcagagctcgtcgccgacggccgcatcctccattgtccacgccacaatggagctcgttgctaacgggccagcaacttggtccatttatatatggcccattcaattattgatctcattggtccagtcgcgttgcccatttcttttctaaatgggctttcacggcccattaattggcctagatgggcctcaactttggctaattggcacgggcaagcagggacacagcccgaaacgcagaacagagtctcctcccatcacatctgcaccgacaaacaaaatgaaaaaatgtcgaatttttttcatttttaaatttttttcttttaatatttacagaaataatctatcggcgcaactagggcggcaagctaacgtggcagacagcagctcgacggcgccgtctgccaaaaagcaatttttgcagccctgaagagcatttggctcgtactttttgcatctgggccccttgccaccctaccagaggacggcaagggacccagatgcaaaaggtaccagccaaaaagtactagtcccgggctagctttttttgcaaagggggggggcggcaagggttttcgtgcaaaaaaaaaaccctccctctcccgtctgccgtcaccgcccgtccctcccccatttgccacgtcagcttgccgctctagtggagggcggcagggtctggattattttttgtaaatattaaaagaaaaaaaatttaaaaatgaaaaaaattcaaaactgtctcgccatgaactccgaattttgcagatggtagtacctaataaatacagaagtagctaccaaattggacgacgaaatcctttgaattttggggctgaccggaaacgatagctgctgcagaagcaagtactaccaacataccttttgcaaatggtactcccttcatcaataagagttacttattttatattttagttttttccaaataagttatttctatttgcagtctctatacatccaacacttaaatgaagagataaattaaatgttttaaattaaatgtttgatcaaaatctgagcagctatcttaatactcattggttgcatgcagatatacactcattgatctttattatatgcaagatgagttaattttttttggttttgatgataataatgtaacttttatggaagaaaggagaacaagataccacattggaggatgaaatcctttaaattgtgcagatggtagtagtacatcaattcagaattgagtgtgatacaaatcgaaaatccaacaagctctcgagttcttcttttcgatgtgtttacacgtccttctcgggatacaacaagaaatagtctactactactcactccttttacaaaatttacacattcttttatcacaagaccaagaaaaaaaaactcatcttgcatttaataaagatcaagaagtatatatatgcatgtgaccgataagtattaagatgatttctcaggttttgatcaaacatttaatttagctttccatttaagttttggatacattaaaagttacaaatagaaataactcacataaaaaataaatatgaaatatatcaacttggagagagtacaaacgaatgagctaattaatcgtcgcattctctagtcccctcaattacgcttaaaatacatgcataaaaccatgctcgagattcgtgttctatagctccggatttcaatacaagactgaccagatctcaaggccttgtaaaaaaaaaaaaaaaactaaaccaaacatagtgcaattaacccctcgccgagccgatcagcaacagcaacagggaggcctacggcgatgaggcggccacacgagatcccatccaacgcgtggcccgacgcgcggcacgtgaccgcgcctccccgcattaacccccccttgtgtcagacccccctcacgtgaccggcaccaccctcatggcccaccgccccgccacgtgtgcgtgccttggattttctacgcaaaggtcgtacgcccacacgtgcgggggcgctgcacatgcgcagcggttgtagcgaaagctaaaaaaggagaaaagtactattataaaaattaaagatgtttttaccgatactttggtacgtcatccgtgtatgagtatatttgtaatttcgttcgcttttagaaatacgtaaggagtcatgtaagaaatctctttaaaaaaaacttgcatattaacgtgagacgattaaactcctaaccacagctcatgattttctcatgtgattcaaatcctaagacttcacccgttaccatgtacgggtattttttctataaaattaaaattaaaaaaaataaaagagaggagttggaagttgggatctcgtggaccatcgaatttttctactgtcaccagttaatcctggccgtacatcaccgaccacggacactggcatctggggccccgagacgtgggcccacttgtcattgggtggcggtaggttgagggtggagggatggaggggttttgggtggcctttgcagtccggtggagagatttgaccgtaagaccgacaaagtgatgtgttagaaccatgaaagattactgcgatttactaaaataatggcatgattataatattataatgagatgtctacttgggtgtagtgtgtgacccaacaagctatagctagtagtaaaaccagatgcatgatcaaataatagggtgacctacaaggaggctacagctagaaacaagaaacaacaacatccattgcttacccattactcatgggggctaattagcagctggtccttaatttgcttagacagattaacaacgtgatttttaggtcaaatcctagtagctggatgctaggggaaattaaaaggttgtaggctttggagctttgctatcacaagaaccgggttgttgttattccatggattattgataggtacatgcatgtatcccattccccaattcatgctttagccttgtcataaaaatataataatgtaaaataaataaaaagctttagcaaattccaatctctctctgaataaagcttcaggtttctttgcattttagaaaggagaatctcgatgtagctttcctatttatgcatgcaccactgatgatatatacagagcattggcaacgtattatgtacctcattcacatgtcatgttctgatgctttctttatctgacactttctcctctaatccccatttcatctgcattcaacaccatcattgtgcagagaaagggagtgatgaaacagctgttcctgaaacaaccaaaattaaatcagatacattcaaaattaaattttaaaacttaattttagagtgattttgatgttatttttccagcattggtttttaagtcgctaagagcacacacataaaagttttaagttttgtcgctgataagcgttacggtttataatcggctttaggcaaaacaataagactctaaagaaactgagaaagaactgtctttctttgtatctggagaccaggtgaacatggaaagattaagagaaaatgcatgaatggtacacaatatcaaaaggtatcagagatgaaaagtttttgcttttgttagagccatgatatatatcacttaatattccgtttgacttccacagttgaaagaccagtcagacattttaaggtgagctgtccatcaactcaccctttcagggacaatgggccaatctctgcaatgcagttcagaatattaggatgcatcgtcagataaatcacatcaggaactctgatccatcggtacagtccagaaaaatgaactctatgcatgatgcaaagttattcttttgcgaaccttgacagaagcacacctgggacagaccattgcagtcctcatcaaatccacacctggaaggctagaagtcaagccaaatcacagctgttagatttaagcagtagtagttatcttttgaaatcaggaaatcttgcatgtataaacaccaaaacagagacaatttatctatttagtgcaaaggagtagtaacttaggccaaaaaggttggatataccatgttagaaaggtctcacagcacaagtacacagtatataccccataaagaaaaagttcaaatctacattgtatttgtacctgtattatctccattgcatagcattcaaatttgtattcaaaacaagaactgttgaagagtaaaacagattgtaggttccaaaaaagtttaatcacagaatgcataacaggtttgagtttttgtagtttaccatttgagatataaaactcaagtaaaacaacagctagcctgtagcaaacacgatggggcaaagcccaaggcagtaatttgttagtggagactggtgatttatattgtatgcatgtgttgcccaagaaaggccatcctctcccccacacataagcctccaaacaaggaatcaaagggcttcttgggcactgcatttgtttaagagtggtgagctctatagccaagactagagattggagctttggtcataagttaaaaagtttggacaaggattgggaaacactagaaacagcatccacgttctcctcacctccccacctccctttctaccctttatataattgtttttgtatgctttgttggctcactatgtacaagtcatgcacattggtccaatccccaagagatgcagcagattttaatgttaaaacaccagacctttccatgttgcaatgccaccagaaatgagcatttgtgaacatttcttgtttattgttggaaaaaagagagacaatatatgttgctgaggagtaatatcccaagtgactaaaattctacataaagcctttacccacataaaccatgttaacagttgattgcacattttatctgtttgaatggtagtctgtcataatttctaaaggagaagatagaatggtaaattaattaataacgcaaacaataatttaccatgtcacctaaattgcatatgaaattgtatgattgcggtcaagcaaatctaaatggggcgaacttgatttatgcttcactagccaatcctgaacagtcttgtaaaatgtaaattctttgaatttcagtactgttttgagttgaacctgacaaaatcatgatagattagttgacttttctctaagaggaaaaaaaaccttttgtggcaatttttctataatctcagagaattttattggaatttttgaatcaactctaacctcttaagataaatggtccaataaaaaactaaattttgtaaaatgtagtatttgattatcataatatcacatccagcacctacaacggcaattccggaacatgttcttaataagatgcacaaagttaactacacatggctatcactaccctttcataaagcaaggtgcattccatgatagtgccagagattaaggagtcaaatgtcaaaagccctagtggtgcaaatatatagccccccgtctatggttgaatctttaatccttcttatcccactaaacaccccctcctctcatccttcataagttgtacgtatcctccttcctcacagcacctcaccctcaccctcacccagccaaaaccacacacaacaccaaaggatttcacatcaacaacacacatgatcatggtgaggattccaaacttcttcatactatcatgaaaattctctctatcaattgaaaatttacttggaatttcgcaacctcagcaggctatgtggaagccagcatggttagaggccctgggctgcaggaat

SEQ ID NO: 74447 - DNA, 710 bp, Oryza sativa
cgctgcaaatccgacagtggccaaacaattatttttaccagctctactaaaaaaaccttgaaacagctcagcatcaaatcaaggactgcattttcgtatgccaaatataggagaaaatcatgtaaaacactgagatgtgatgctccaagcatgtacaacagcgatgaaacctagctgaattggtagataaaagggacaccccaaggtgaaaaacacaagacaaagatgataaaagagtggcatgagagatatggtgtgaacagaacaaaagagtggttcataacaaacagactgaaatgccacaactaatgaccaggaatccaggatcatatgcagcgccaaggatatcattagaatttcccaatagatcgacataggcgggactattctgtttgctttctgtttctttttcgttttcaggtctcttcacacttggtgatgttgtaaattatttataccctactttttttaacattaaataatttctatcctacttaatataacaaaagacacaaaccaaaattagggcgaaacaggaaaataaaacgattggtcttaaccaaccagaaaggataagaaaatttatactggaaagtagatgtgatggaagaaaagaaacagaaaaggtagtaaaagtttttataattaaagagtttctatagtaaagactaattgtgatcattgtttcctatttatgtttgagtgcaaag

SEQ ID NO: 74448 - DNA, 505 bp, Oryza sativa
ccggtccacctgggccccacttgtcagcgaccgtggaaggggaagagcgcggtggactcggttcttggatttccggctcgagtcgaaggaaaagatggttgggttggaccagtctgtcaggctagcgagaggtctcgcgtcgtcacgacgatttgatggttttggacagcctctgcgtgagagtgaaggggtgtaatggcatcatccggcgacagtatcggcagattagataagcatttgacttgagcttctgtaatttgacctcacttgagtgagtgagttagttaatgagacgtgctcggacgagcggcgatggataaaagcatgggcgtttgtactgcggagccatccaataacagctgctattgcttctgagcccaacaaatcacacgtgatggagccaggttgtacagtggtaagatcttgagtgttgatacgttgatttcgacggggttaagacttaagaatatagaatactactgatgtttttagatactcatgcacc

SEQ ID NO: 74449 - DNA, 719 bp, Oryza sativa
tccccctcttttttcctcccctctctccctcgggcccgttttattctcccttcttccctctcggcccagccacccggcccaagccgtggcgccccctggccgagctgctcccctcccgtgccgcgcacgtgcgcgcactgacgacgcgcgccccacgtgggacccgcctgccaggcgcgtcttcctcctcccgctcggcctcttctccctcccgtgaaaaccctagttcgttcctccttcgaatccgcgcaatttaagcattggattccaaaattgattagggggaattaatcccctttccctcctctctctttcccccttaattcccccttgattcgtgcccccaatcgccgggaacggacgcgccaaccccggccaccttccatgggcgccggccacaaactccgccgccgttccccgctcctcccgtggccggctccctctcctcccctataaaatggaaccaactctttgcgttctatcgttttagcctcctcccgcgtcttcccgtggccacaccacctctccccgccttctccttctctctctccggcgccggccggcatccagccgcctctccctcctcgcctgagtgccgtccggccgcaccgtcttctctctcggcctcgtaggtgcatcctcttccccggcgccgcctctgattcgtggggaaatcaccggagacacgcccccgccggctacagtggcggcaacaccac

SEQ ID NO: 74450 - DNA, 615 bp, Oryza sativa
aaaatcagctacaaatttaaggttgaaaatttaaaatttggttgataaacataatgaagccggacgctttagtgtgcgcgctgagacagctagaggatagaaacaaccaagcagcaaagctaccttcctaccgcacactagctacctttgaggcataggtcgcctctcgcctttcagaattttcagggcctcatgattctgccatggatgtaacagcgagacgtcgatcccgatcgatcgacggtgtaacttccgatcaaatctcagcagcacgcattccgttctcgagtagtaggatccgcgagcacggcgacaacggacggacggaagcttgcgttcttgatttccttggcgccattatccttgcttgattagtgagcgtacgtgcgagattagttgcattgcacaatcgcgcatatgcaacgggtgaagcgacaaaaaaaaatctgcgtgtcaaaagcggaatgaattgatcctgaaaagtttcaggttcacacgtgaatcatgaacggcttggccattttcgtatcccactggattgcatgctggcactcgcacgctcgtccatcacaacgtcagatagcacgctgcataggggatcctctagagccgacc

SEQ ID NO: 74451 - DNA, 2120 bp, Oryza sativa
ttggccatttgaactcggaattggactgttcaagtctctaattttttcttaagaagtcaagaacccatttttgtgctttgttcatgcttgttatatggagtttattagagtaaaagcccttttcttttccgttggtcgtgtagatgctgcagcttcggaagatccgctcttcgtggaggttgaagccaacgtttgggaaagcgagcaaggcaagtcacatcattctttgaacatattggatcccactttgtgaaattactttgatttaaattattgcattatcgctttacttaaattcccgcgttatcactgttttatttagccatgcctatttacctttgttatgaccttattattgttgttattgttattattaccttgttcaccctagaaaaaacaaaaccccaactagtgggcactctattcatggttccactagtatgaagttaggtagatgcttcgctgattaattaggcaacattaggtggttttataactctagactttgggaatattcatatcacttgtaccttatggaatggttgatttattgtggaactggatgcacacctccccctctattcaaaactctcaaaatggttttaggctgggcttggggtgcatggttttgatagtagcacctcggccacataaggaccggtcttcgggcctcggttgcaaagcactaccatacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcgtggcacagggccggtgtcctgctgttaggggctcagtcctgcctacctgtcccggaggttccggccgtaggtggggttgggtcagtactcttgtctatggctaggatgggttggaaactatgtcatgtcttccgtccatatgccgtggtggtatgcggcacgtggttgcacgtgaggaagacgtgtcttgtgggtaaagatgtacacctctgatcagagtaaaacctattcgaatagacgcgccctcggttatgggcaagcctagcaatgtacccaagttagtgttttaaattcttaaaacctgtttaacaactaaaatgtggaatggttggcctgggttggcttgggacgagctgggacccagggtcgggttgccagttcggtctgaatcatcgtaggccttgggttaaggcaggttcgtgcgggttcacggccttgatttataatactgtgtagctctaggatcgtctttttaaaatggctttgggtaactaagtgacttttaaatcctatttactgcaaaatttaacccctattattagctccttgtacccccttgcattaatcatgcatctcccggtgtgatttgctgagtacagtggttgtactcattcttgctctatctttcccccccttcagtaagagaagctttagagaagaagtcttaggtggagtcctggcttataccccagttgagcgcctatgaagatggagccgtaggcccgctagtccgctgctgtttatttttgtttgtcaggcctgaagtgcctttgtaataatgtaaatattatcgatataataaagatgtgccttttgtatcatgtttgtttggtgtaccccggcttttcctgggacggggattaatacactagctttcgggaaaaggcaattttctcggtcgcgacaaatcatattgtcggaattggcttgatcggctaacctagtccgactcgaactttgtcgattaaggtcgcagccgattcggacttagccgattcttgctccgtttccacaacgatatttgtcttggattccgcttcgatctaatcttcatatccgatactcagattagcaaatttggttgttaacagtaaccaaagcaagatcaccccagaagtgatgagccatgatgaactatacaaggaaaattgatgcagtcagaatcaatgaggggtcagccaaacctccagttcggctgaaccacctctaccatgaatcgtcctctgttttataaagagcgcaggtttgcacgattggggatcctctagagtcgac

SEQ ID NO: 74452 - DNA, 2072 bp, Oryza sativa
acattatggaatggttggattattgtggaattggatgcacacctccccctctattcaaaacccccaaaatggttttagtctgggctcggggtgcatggttttgttagtagcacctcggccacataaggaccggtcttcgggcctctgtaacaaagcactaccatacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcgtggcacagggccggtgtcctgctgttaggggctcagtcctgcctacctgtcccggaggttccggccgtaggtggggttgggttggtactcttgtctatgactaggatgggttggaaactatgtcatgtcttccgtccatatgccgtggtggtatgtggcacgtggttgcacctgaggaagacgtgtcctgtgggtaaagatgtacacctctgatcagagtaaaacctattcgaatagccgcgccctcggttatgggcaagcctagcaatgtacccaagttagtgttttaaagtcttaaaacctgcttaacaactaaaatgtggaatggttggcctgggttggcttgagacgagctgggacccagggtcgggttgccagttcggtctgaatcatcgtaggccttgggttaaggcaggttcgtgtgggttcacggccttgtttaataatattaaatagtcctaggatcgtgttttaaacttagctttgagcaattaagagtcttttaaatgctgtttattgcaaaacctaacccctatactataactccattgtactcctttgcatttatgctgcacttgtgggtgtgtcttgttgagtacggtgattgtactcagtcttgctcaatttttcccaaacccagaagaggagcccctagatgatgaatgctttggtgtctagctcgtgcctgccgtcaagcgcctgtggtcatcgccttagtcttccgctgtttttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccgttgggttatttccggtcgtgacacctgtggtctttgtagtgtctaccatgtgatcctgagcaattgagaaattgaacaatcttgacttaagtcagcctaacttttcatgaagaacaacgtggggttttttccagtaacacaaaattacaactttgctttactccaccaatgattctctcaatcactcaaagtgtatgattcctcacaaaggcatatgattgtgccttttcttttcctaccacctaataaggcatatgtggagctcagggtatgaaaaagagtagagcattacttgcaccacatatattgcaaagtcaaataatggatccgcggaaatagaagacatactttctggttaagaatgtgcatgtgtatgtgtatggtgaatttgtaaaagaaaaataagaataactccttttgtatacctcctctccatttatttattttttttgaaatttcgaagagtacatggctatctttttttccctttttttcttttttttctcatcatcatgctccatacttgtatgagcactttttttttatttctttttgctaagccatgcatctctcactctttttttttaaagaactttggaagaagaggcataaatttcatggagtatttattttgtggaatgtggatgaaatgaatgataaatgaggaatgctaacttcctgtgtagaagtcaagcattggtgggtgtatgtggagtgtatgtgatcttgaccataaagtatgaaaagcatatcactagggtcacaaaacttgacaacgctcaatgtattgacaagcagcgtatctagcaagctaatcatgaacgatcaacctatggctctagtgggaataaaaatatcaatgaggtatttaacatca

SEQ ID NO: 74453 - DNA, 24528 bp, Oryza sativa
  unsure (1)..(24528): unsure at all n locations
atctgtctgtcacaggaccagaccacttctcactctacagcaacacagtctatgatactacgcttctgcctcacctgtcccgcgactctactgcttctgctcactttgtccaacttgacaacctctgtcagaattttggtacgccaggcgcaagtattggttcgcttgatgatgctgctgatgtcgctgctgacaacactcaacactacggcactactgctgttgcttccaagaggaatttaagcagggaactccctgatcagctggaggtacatgctcagcaccttttcatggatgccggctggaccatcaagccacggaaaaggaatgacagggctaagatggcatcctatttcactgcaccacacagggaggttgttcatacctctctaactcaggcttggaagttctgtggcaagaaattgtatgaagctaccccgtgttcacaacgcggaaagtgtcctaaggagtggtcagatgtcgatacattttggaaggacctcacagatacaatggcttatgtcgataagatgctcgtgaaccgccaagatgcacccactcttcttcatcggtgggagcttttggatcctttcatagctgttgtgttcattggtaggaaaattactgctctgcaacaacataaaactcttagagctgttgatagttcgacctatgttctcaatgacagcaggaatgtcccctcagaaagtaagagcatgctgaaatccagtgatttgttgcccactcgcatgattcaacctactccagtgatcacggactctgattgtagcacactagcaactgagagtggcaacgggaatcatgctttacagagctgccatgacttggaggatggccacaacggggatactaacctgagtactctctgcacacagagccagctgtattgcgcggcaggtgacacaagtcaaagaacagaaaatcccatttctgaaagtaatggacaaagggaactttggtctggagcaacacttattaatagcgcagtgaaaaagactaagaagaaatccaaaaggatatcagatattgattcaactggactagatggactgcattctgaaagttttatgcagcctgctgtggaaattgtgttaaaccaagaaaccgaactagcaagtgtggaattgtcttttgcagaaacaatatgcgctctgaggaacatggtatctgttcatctgttggcacatcgaaaaggcacttgaaagctgaatccaaattagcaaagctaaatgcaaacaaccaaagcaacaagctcgacgtgctcttgccttcagaagtcatgcaaaccagcatattacagggcgaggagactgttgagcaacctgcaggattcaacatactcccagaaaatggttctactccaacggaatcaggttccagcaagttcatccccataggaaatgaagagaagaagttgctgtcgctgaaggaatcatccattggaattttccccaaggatgtacataatcttccaacggtcaactctgttcctgttaacctatcctacgaatctaatgctgctgtcctgaaaactgatttatctcaggagtcaccgacgtgcaaggcagttgctgctaaaagaaaacctcaagcttgggagaagtatgccaagaaaaggccccgtgtgttacgtatcaatgacgatgatcttttgatcacagctatggtgaaaaatagggatcttggctcctgccacaaatttgctgcagactccatttttttggatgcaaagaagtttacaaagtttaagagctcaaagaaatgtggcaggctacttgctcgaatgtccggaaaaggaggatcaaatctgttgggtgggaagagagtaagtttggcacggaaaacagttctctgctggttgattgccactggctttctgaccgtaaaagatgttatacagtaccagaatctgaagagcaacgaagttgttaaggatgggcaggttacctgggaaggcattctgtgcaattgttgcaccaagaccttttctatatcagacttcaaggttcatggcggttgcagtttaccaaagtcctcattgggcctctttctacagtctggcaaatcgtacactctatgccaggtagaagcttggtctgctgaatttctaagtaggaaatgtgatgcatctggtagaaaagttgaggcgatggatgaaaatgatgatacgtgtggtttctgtggagatggtggtgaattactttgctgcgacaattgcccatcaacatatcatcaaacttgtttgtctgaccaggtatctagcttctctactgtgtcattgtttgtatattcaataactccccttcatgtttcagttagagtacacattgtaccactttgttccagaaaattaaaccgatctgtttcataaattatttccttcctgttgcatttcaggaacttccagaaggcagttggtactgccataactgcacatgccggagttgtgggaatccacttagtgaaaaggaggtttcaacattctcggctatcttgaaatgtttgcagtgtggagattcatgtaataattatgatccctcctgttttgtcttgtccttttacattcttctgcgattgttgggctgtgctgctgtggtagtcagttagtgtgtattccacaagattggtactaaaacactttcaattaccgtaatttggatgggtattttggtattatatgttcattttcactgaagttgctttagagagtccatcttctatgtataattagggcttatgcatccaagagcccatctagcactttagctgcaccctatttgagagtgcttaagcttctagtagccatttaattttggccattatttataatgtacagcagatgaatttgatctttcaatttttgtatttaacttcgtttgatgcattcttgtttttttgctggcagaccatgatacttgcattgaccaggagatgctcccctgtggggataaacaatccaacatatggttttgtgggagatactgtaaagaggtaatgttttttatttataagatgctgcagtggaagattatttagttagtcactaagcctagttcagttctggctctgcattctttgttatacacaatagtttcatctacctcatgtgctccaccagaatcaaaccactaaacagtagaattttagcatgtgttgcatatattgttcctaatgcttggaaaagaaaaactttaggtgcagatctatggccacaaagaatcaaacctagtttttctttcatgtcactacaaattcactctaccttcgcataccttagaaaatgcagattttagttttagatatttcttggaaactggttttgaatgttgttttcttactattcaatatttcctcactaaacatttttgtgttgttattggtaacagatatttattggattacacaatcacgttggaatagagaattttcttgacaacgagctttcatggagcatattgaagtgcaacactgatgggcagaagctacattcttccaagaagattgcgcatatgacagaatgcaatacaaaattagctgtggctcttactatattggaggaatgttttgttcgcatggtggatcctagaactggtgtagacatgataccgcatgtcttgtacaataaggggcaagtttcttatttactctctacctattatcatttttcccagtagtaagctaagatagtaattggcgagagttatatgcatctatagggacaattgaacatgcgttctcccaacgtatggcatgctttcaattctctgtcttgtaaaaaatggatatctgactatcatcatatcaaatgaagtaatgaacaagagggccaagacaagaaaacccagtttggtcactgcattttcactgccttttatcctttttatgtgaattaaagatgcaacgtttctgcattagtccattgaaagattacattgcctattcagcagttcaaaatggaagtattggggtattgcacattgcttttgcatgctaatctacacagttgatatcatgccatactggagagacaagcctgtactgaaaccttatatccactaattctttttagataaaggaagcttttatttatctcagacgattactgaaaccttttatccactcatggaactgccagtatgagtaatatcaaattagtatatgaatgtgtccatttcctgttatattggaatttttttttgacatgttatattggaaaattgatttaccagtacttgcaccatttatattttagtgaacattgtaaagtttactaacattgagcacatttcaccagatcaaacttcgctcgcttagattaccaggggttctatacagtaatcctggagaaaggtgatgagattttatgtgtagcatctatcaggtaatgcctttgctgatcggtttttagtttttctgggctatacatttttttcttctttgccctgaagtattattcttgaaccgaggtgatttttgtgatatcttatgctcatgccattgactgttgtcattgttttccatgtaatccaaaacttgctaagagtatgcatgtgaacgggaaagtgcatgaactttgcattacctctgtaccaaaaatgaaatatgggcacctgcaacaggtggaatgcctacggtcccacctgtcatccatgattcttttgctagtttgtacattcacatgttgttaaacaatgtcgctgtaatgctattcccctttcccgtattccgttaaaaatccacgtttaacattttccgaagaatcgcatctcgcagttgattatttttagaggagcgcatacttatctctccacttcgtactggttatgcgtagctaatcagtgatgactttctacaatggagatgtctaacatggaaacctgcagtcatgtcatgtccattcattgtagttcttttgatttaatattgaaaaaaatcttggaaccctgaatggttagataacatataatcactagtgcaccgatattgttcctctagagctaattgccaattttcatatgatgaatacgtcagcaaagtgcgatggatgaaaacaatgttgttggaaattatttagtagacaataattgtgattgttgtttgcctcagttattttgactatatgttttaaatttctctttttccctgatacagagatggttatgatatttctgtttctatcttattcagagtacatgggaccaaagcagctgagcttccatttattgctacttctgtggattatcgccgccaaggaatgtgccgaagacttatggacaccattgaaatggtacattacactttggaaatgagatacaagtgtactaatcaaattatggacttatcatgataatgcaccatgacaacttcgattaataggactccaactgtgctatagattttaggatgtgtttttcttctaaaatacttgtctacttcagtaactgttagcatctaatcttatttgcatgtcaagatttgaccatgtgaattttcgttccattcaatgcagatgcttagatcattccatgttgagacattggtcctttctgccatcccagagttggttaatacatgggtgtcaggatttggtttcaaacccattgaagataatgagaagaaacaacttcgtaatgtgaacttgatgttatttcctggaacatccttgctaactaaaagattggatggaattacagctgccaaatcaggttaactatcttccggttaccattggtgacatttgcgttctctgctatatatttttggacttctctgcatttcttccatctttttttatgtgtagtaatactgggtgtttgactatgcagaagaggacaaggatgcatacaatgtttctggattacctaatggtaagtgtttgcctagcaggaaaggaaacgggcatcttgaactccatgatcttgacttgttagaggccgagttgaatactgaggatgcaaccaatgcttctttcagagcactgaaacatgaatgtggtcctgcaacatggtttaatcatgccaaggtttggtccatcaacattataaagctttatattttccttgatcaattacgcctcggatggagcattacgactgcatgattgagttgtttagtcagcaaggttaaaccacagcactttaaaatgcacctaatacaaagtgctaactcaatcaatcataatacagatgcgttgcaatttatcatagagaatctcttgggtctatcccaaacataatagctatcatggtcctatatttatgttgaacgtcaagaccatcatagtgctttcttctactctgggagaaatccatatgaagagattatatcttgaggccgtatatatgtagtctaaatcagttattaatatatttcaaaaattacattcctaccatggctctacatgtgggcataaatgcttggattgtgttcaaatgctctccctttcactatcactcatagcagcttcatgtgtgatgtaaattcagtgcaaataagcagaactttttgtgaattttgcatatgcatacagcccattttcgttataatggcttcatggtcaaacataaatgttttttctagctgtgcacatagtaatgttttatctcataactataactgattcgtgcattatgtatttatgttattgtccagctagctgttggggaagcgtgattttattctaaatcgaatttctgggctgtctctggctgttactctgtgttgggcaactgttcaggctactcatccttccagttccaggtattccccattgacttgtttgctagaaatttgggcacctttatttatcgcattgcatgagtttggggtagacgtgtgaaagttttggagtgtgtctgtgttggttgtgatattcctcccctttctttctttttatttttctgtttgttccttttttggaagattgagtttggaactgatattttattggtgggtcaatcccccagagtctaggctatctccacagtccataatttgttttagtatcatttgggttaattttaggtcctcaatccatcatcaaaagaatcagcaaaatagaacataatgtggggtttgaacttgatatgcatatgtaaaccttagtacactacatcaggtttgcactggagctccctgaagtgtcataactttcatcttgttaattgtggtctcacagagatccaggcctaccatttgttgcttctgatacccatttgatctggaaattagttgcattgctgaaacataagtggcaatctaaatggtattggcaattgtttcccatctaaaatagcaaaagattaccaagtaccagcatatgttttgtttttgttgctaatgttatattaacgtatttttattttctatatgactgtgttctgaagatcaaaatgccacacaagcatgccattgtagctttgatttgtcccttttcccctcttttcggatggcacttgaatctgtatcaatattcaatacatagtccacacatgttcatttttcaagagaccgtagtttaacaccatgtaaaatcattcatggaacaatagttcaaccactattcctcaattagaattcaatcgattcaatgacaccctacaaatctttagcgacaatatatactgtcatcattctttagtcataaagacaatcgtttcatcaaagatattccttcatttgtataaagtctcaagtaatgaagccaaaccaacttgcctgtgcaagtgggcagactggtatagtcgttctgtagctgatccatctccattttttggcctgataatcttgacgttctttgctctgcagtccagtactatgcaatgaattctcccggatgcaatttaccggaccacagctcttttattgcaaaacagaaagacatcttccaactgcagttcatgattcaattccctcagaggtgcaggttaatggatcaaattgagctggtcgagctagattttatattgaatacagtgaagctaagaaatctgagggacacaagatggcatcatcagatactcaaatgttcccgcctatcactgaaatatgaaaaatgagggtatcttccaactgcagttcatgattcaattacctctgagcagctggttaatggagcagatagtcatgcaagaaataacaagggatggatagatggtctcatctatccctgcaatatgaaaaatgaatgtttgagatgcaatgcgaaactgtatttttttgctttactgagtgaagcacctgagtcgcgatcacttggacaaaagcagaaatgactgacccttttctgagtgatgttgataggatttacctaagctgtatgcagtcactgttgatgggtcgtataagctgcatggtggccagaagggttacttgcagaaacatggttaacatttaaccctgcggaagatatgaatggttgcacctagcagccattgaagctcttttgagtgagcatggtggaccatagtggatattgtatgagtgactattnaatggggatcgcgtgcaaagttttaatgaaactgagcggagaaactaatgcaatttcgtcctcgaaacaagcacagataccaagctatcgagtaagctcccttcttttttgaatactacaatggtcatttgatgcattactgactccactgtaggctcgcatcttttctagttttctgtgtgcagtgtttgagaatttaatataagtctactaaactcttactccctccgtctcatttaagtgcaaccatgagtttctgtgtacaactttgatcatccgtcttattttaatagtatttttattgttatgagacgataaaacatgaataatactttatgtatgacttatgtttttaatttttttaaaaaaatttttaaataagacagacgatcaaagttaggtaaaaaaaaaatatggctgcacttaaaatgggacggatggagtacatcctcagtgttttgtttggtcagaataattaatatacctgtggcagaattaccgaccagatgtaactattatactcacgcacttgcacttcacaatctcggtgcattgcccatctctactgatttgtttgaccttgccaaaatagtcgcctccctcatctttatctgcctcgcttcagcatttgcattcgtcatcagataattgatcttcctattttgtcccaaactttcaggacaagtatcacaatgctggtgatcaacagatcatttgtcagatgtttcatttgagtcttcctcttcctgggtgcagttcctgcctgcctggtaattttgatcagctgctggggctggcgcgtcgcattgcagtggagattttcctttgctggtctgcagccagagattagttttctcacacctgatacatcccgggccatcaaatcttgcaagttacttacagtagtagtactacactagagaagttttccgaaccaaagaatactactatttagattgttacaaggcaagtatttttttgccaatttaacatgcagctgttcatgcgtttcttgcacattggaaatcaaaacgttgattcgtatttgtacttggatgggcaacacgacaaatgctaaactgcagaatgcaatgtctttcaataacgttgtaaaagtaaaatcaggaagtgaaacaaaatacagtgatccttcacaggaagagataattgcttccattagccttgggagactggggtggacgatgcaagcaaagtattcaggctcttcctaaccaccgccttttatttttcacgtgcatgtttttttaactattatatatttttttaaaaaaaataaaagaaaattgtttaaaagaatatattaattttttaagtttttttaaactaatgcttaattagtgtactagtccatcatttcgttgtgcgtgttgggagagagcgcttccaagttgttccaaccatcacaaagaacacgcccagcaggagcaggcgatgactgactgtttctcgtgttgcttgaccgtgcagcataggtcaaggggtttgtttctctataattaatttaagcggacagttatgtagtagaattctaccagtatcatgtataaacaagtttcccggatggtttaaaacaaatatcaaattgaaattctcgaatcatattaggaaccatcacaatgaaaccgggaagcttgctgaagaccgggaacgtagttcggaggtgttgtatcactagtcgaaggttattgagttcttttagtctttcgatgctatagaagccctaaataatttcttcgatgggatgggggctaggataacagaattacacaagcacattctactctagtagcattatattggtagtatggtttcactgagtaacaacatgcatatgagcagatgaaatgaaaagggaacatagcattgctgctggggaagttcgaaatccagagcaaataaaaatcaatggagtacatagtacagcacagattattacattacgaatttacgattacgggagaagaaaaatccatcaatcggaggaaggaggaggcgtgggtggctggtcctggtcttgggactgggactgggactggagaggcgggaggagctgggacttgcggcgggtgtcgcgcggggggagggggacggcgaggaagtgcttggtcttggagatggggcgggagcggcggagctcgacgacgtcgccgaccttgaactggttgtccgggtcgtgcgcctggtacttcttcttgatgcgctcccgccgcttgtactttgggtgaggagccagccgcaccacctccacccccaccgtcttgtccgccttcgtcgtcaccacacgccccgtcagctgcttcgccgcctggatcctcagcgccgtcgccgcgcccgcccacggcgaggcgccgctgcccccattgccctggaccctcacaggggacgacacgaacggggtggtcagcagcatcttcaacgctctctcttccttgctatcgtatccttggctgcctctccacccgtggaagctcaagaagaagctgagcctgatggacgggtaggggataaggtttccggtcggacaacccagcataatgggctggctactgcaacatcaccggcccagcccatttgaaaacacactagctactgtatgtatgcgtgcgttcgtcttgaagccggatggaaatggaaggtcagccaaagcaagacaaatgtgctcataactcgcactacccagacgttaggagtaagcgatatgccgctacataggcctacgaatctcaggcttggatgatcaggagtattttcttttaccatataccctctcaactcaccttgaacatcaggctcaaagcttgttcaatcttccttttgtttcagtctcaatgtttgttcaatactttttttttattggggaatgaatcaatacaaccctgtcgagcacaaaaggaaaaaaaataaaataaaagagagaagaccctacacctaaactcttggacccataaaatacacgctacaaaacctttccaacaactctatgttgctgctggggtgccagtgccagtgccagtggagtgacaaaaaaacagaaccgagtccactgaactgaccagtacaatagaacctacaatcaagcacagctcttcgacccaatcgactcaataaaccaaaagggaaggtactagccttcattctgtctgtcgtggtaattctttcttaccactcacttgtgctgaggacaacgcacatgatgctctcagacagcagtcctgtgcgaaccaatatatcactagcagtggagcatacaaaactaaccggccagaatccatcacatcataaaaatcacacactggcgctgcacgatgagttccctttcttctctttgcttccgtcccaacgtatagtaaagaatagacaaccaaaacaaattccgtcggtatcctcatactccgtatctgcctaatctctgaacgaccgctggctctagggtggacatgcactgttcccaacccccacttccgagcatctatggaaaatgttttttgttagtttgttgcatgtacggtaccgatacagaaccgcaatgaggaatcgttttacccgccctaagaaaaaaaaatatatacctgcttgtatccattcaaaatctggcacacttcattgtgtaaaccttcactctttatctcctgtataaacaaatatcgtgagcttcggtgcagaatactggtgcagaaagcatgtctaatatgacaggaatctcacgttccaacttgcacaggcctggcagataaaagttagtgaacccacagctccagttgggtttgctgctacctagtatagaatgacagtattttgtgtaagtcagacagctttgtaaattgtaacagtaagcaaaagcgtggatgtaccattgcacatagaccatggaatgcatcctctttctcaaaatcatctcgtatcctgtacatgacgaaaattagatccataaaagggcaccagagagcttaaaggacagacacttacatgcacaaggcattgcaccaggcttgcatgaaatggtccatgtggggggccacaatgtctggacagacccagcaaagcctcccaagagtgattgcgctattttcgagaagtgacttattcaagccctgtaatagtatgtcaggacacacgaggcatttagctgaaatgctcactcgagtaaaagacgtgatgagaacaacttaaaatgcaattacctcaggagattttaaaataggcaccaagcaagaaacaacagtgataaccacaggtgaaatttctttgccaatctggaaaggaataatcagttagacatacccacaacaattttacaaaataccaatgagtactagcacgtcataggcacagaaataaactaggagtgcatgttgctggccaagtttagtgtcaaagttgccatgtggcaaatgtgattggcagtagaagcagtaacaaaggtttaaggtatatcctgggaaacaggtatggtactagttgctcagaaaagaaaggaaacatctatgtgtatcaatctagggttgcaatatcttttgaaataaaaaaaactagggttgcaaaagtggtacaaaaccttgattgctaattctccaattgcccaacaggcgttgttagccactgacacagcctccttcacacattgcgggttctgcagcaacaacataatgtgaggagtgaatccgagatgttatactataccagatagaaaatacttaccagttgcttcgcagcaacattaaggaattcttgaaggcggggatgcagatgtatagggcaaacctacatgaatagttgttattttttttattggctacaaagcaacttaaaacaataaaaggtggactttggtggtctgcagcgaaccctagaaaggtcccccaggagggcgagagcactctgtcgaacatccgctgcttcatccatacaacattgcaaaagaatatctctcaaactgctttgtgaaacctaaaacaaaatgaagatggcttacacagatatcgaagagctacacacatcacactttgaagtgtcttacaaataataaagaaaaggcagtatgaagcacaatcttttctgaaacccccaagttttcattcaactaatgccctctttggttgggtttaggcttttaagccgacttttcagtttatatggtttataaccgattgacttttaaaaaagccaaacggaaaagctacatgtttgtttaggcttagactttttggcttataagcctataaacaaagagggcctaaaccatagttagtagcgtcaagaccaatttcccagtcactttgtttgataaccatcatctcaactatgtaccgacatgtaccttattgcagctcacattctaacatattatggacaacctacagaacttggatcctctttttttggagaagcatgtcttagtatttgtaaccctaccttttctttcatctattaatcagtatagccaatacaggaaaggaccaaatattacccacatgttgtctatcacttcaagctagacatgtgcaactagctcctagagagaaaagggtgatggggatccacaagtctaacagcttctgtgaaacttcagcctggaacatccataaacagtctccattcttccctgttgatatactcattgtgcaccccaaaaactatcatttattaacagaggcagaatgtctactttaatgtcatgcaccaatgaaacaggttggtttgtctgctccgctcatatggtctaaccccttagtgtaattctattccaagaaattcgtcacataatctatgtgcataaagaaagagtagggcttggaaaaggtatggatctcctacagattactgaggtcgataggtaagggaacaaagagtaattaacaaaaaaaaggaaatatcattggccatatagttgaatttaccaggctttcaataccagcgccaagtccttctgcaagtcctgacaacagatccaatgcacacacaatgaattccttatcatataatgcaccagctgcagcaggatcaacctgcatgtagaaaaagtgatcccgtataagtttctttgatgcagatggagtcagcagcatccagattccagtgaagatcaatgccgattgaattgactttttgtggaattgagaggaacagcgacaaccccaataaggtgacaagtcctgtctcctgatattcttctattttgattgtatccctaatcctatctctaggtttgttctttcaaaatagaatatgtaaaaaatataattacattaatgtgtacagtcattattcctgtatattttgattgtatccctaatccgatctaggtctgttctttcataatagaatatgtactaatataattacattaatgtgtacagtcattattcctgtatattttgattgtatccctaatctgatctaggtctgttctttcataatagaatatgtaaaaatataattacattaacgtgtacagtcattattcttgcagggcatgtaagtgatgggaagcaaccttaatgtggtttaacctttaatgtggctttcaagtttcaagaccataaaaatgatagatgcattatttattagatttaccgattagtaataaacagctacaaattaataggtttattacttgggttggaaataaccaacttgatatcagctattaatttatcttccactaaaataacgaaggagaccattaagcatttgatgctaaccgatctgtggactgtagtcacatgccagaaaaatagagttagctgcttggataggaaagatccagcatcatatccttaagattagagtggcaatgatctcattttttcctatcattaagattcagttgtaacagaaagttcccagttagttctacaactaaataatttcgttagcgttattgactggccctccaaatcaaagtggatatgtccagtgcaatgctactgttagaaggtgtgtaattgtgttttgtattgaagaatagtcagtcaagtttcagttccactaagaggccttgttcggttaatccctctcataaggggattgagggggatttggaggctattgtggtgtagaattatttcccttaaatcccctccaatccctccctctcggagattaactgaacaaggctaaagatcaataaataccacacctaaaaaaaattgaattctaaggaggtagaatacttgaaatagagaggatcagtggaccaatcaactaaaatccataagtataactaaaaaaagatactgcagatagctatgcttatgtgagaagcaaagaaactgtattttaatataagagggaaaaaagatttcacagacctttgccaggtgctgagattggataagattgatgcatctctgaaatactggctcagcaaactgtgaaaatcctggtcccagggcctgaaataaataaataaataaataaataaataaatcctgatcatgttgatgccagccctgattgacatatcagtatgtttcagacatctttacttgcattattggttaaatatttgagttaagtattgatgaggtaagaaactcatggtggatcacgatttgaagagtcagcttctatcctaattgcattattggttaaatatttgagtaaagtattgaggtaagaaactcatggtggatcacgatttgaagagtcagtttctattctaacttgttttctctattgttactgcaaattaaaatcttaagttaacacaagacaaaatggaccaaattttcatcaagaacatttaacatactgtctggagattataaccacgaatatcgcaaaagatgctctaaaatgggtatgaagggaccttcaaatcaaatttagcatgttcaaactagagaaggtaagcacagacaaaaactgtaagtacctgagcgatagatgtaaagcattcgagcagtgggaataaatctttatcagagttggcaagttgctgccattttgtgattagtggtggcataaatatatctagatattttgcctgcgcagcatattaaaagtagttagttataagtagaaggaatcaacacacaaaaggaatcagacaaacaaagagacataattgcttgttaatagaaaagaacaaacaagagagatattcatcaaaatgctttgcacctggttaagctcagctccaacagcatcagcaagagtgccgagagcatcatagagtattcgaaggtttcgtctctgctcatgaagcaacacgtagagttaaaactaatgaggccttaggaagcacttgttggattgcattgttcaatgcaattgaaaattatgactttaaattacaaagaacctggtattttccataggcacacataaggtgctgcaaaataattcccaagtgtggtactaactcttcagcagcctcctgaaaacagaagaaaatatataataattatacagaaaatctcaaacagaaatggttcaaagatcaagtagataacctcttcaagcgttgcaaatgccgaacacgccgcctcctgcactcttttgttagtatccaaaaccctccttaataaacctaagaggattttatcaaattgttcacgaccattgggatgctctaggctctgcatcagcaaaaaaggatgcacgataagttaagaatcatctatggattgcatatagataaataaagagcaagtccagttcatagagcattatatgaacacagcgaacctttggaccccccccccccaccaccaccaccaccagaaaaaaaaacccaaatagtacaaaatgcatgtcgttaggaatgaaaaaatgagtagtctgccaactgatgtttaaaaggcaaacacagcacgctgaacaaaaaaaaaaaagccaaagtccacattgtcatgtacctactttaaatgcataatacaaaaagggggtggggtgtgtgtggtgtggggttagcttttgaaggaaaacaaaaatcttccagtatagaagatggtagattcaacacttaggaatgctcatattacctgtacaatgaatttactatatcgggagagggtccaacaagtaatactccgtataagaggaaatttatcgtcaagaagtggaataagaaaagcaacaatctgcaaatgaatagaacatgttaggataggtacaattcacaatgagaagggaagcagaatagacagatgaagaaatcaaaagtgagtctcaatacacacatgctactcttttcctaatgaagttcaaggaattaaatacagcaatagttaattgataaaaatacctgcggaagatggggatatagcccagtaatgcatccctccgctatagcaccaatagacaaaacagcagcttccctctccttccacgcatcatcgtcagttcgagccagattttgctgcaaaatacagaaaaaggtgtatgtttatccaaatcattcaaggtcagaaacagcacacagcatcggaacatataaacacttggccaacaacccaataatgctgtggatagggttctacaataatgcttcaatattgaactcctacaaacaggtttctaagtaattgacaaaaacacggtataattcatctctttacaaaggaagttagaaagtcccaaatcccttaacttggcgaaccacaacagagttcattcattttataaaaaaaaaaagccatattacatcaacagccttcacaaaggtaactcgccccaaaaaagtacaggaataaagcaataagttggcaaaaaaaaacgtagttcaccttggaacattgattattatttgaagcctaaagccattttttgagattgacatataaacttaagcattatggtttatcagcttctacaaaacatatgatgatgcagctactgtaacgaaccagaaactgctagttcatatgttaccaactaatcaggaatcatcacaccagtttcgaaggaaaaaaaagattggaagtgcccagctgacaaggtgtgttcaagatcaaactctacaatttgcaaattcagatcagagcaatgccaaatatacctagaatttgagtagcagctcaggggctaatgcatcacaatatcaatcttgataaatatgctagccataataaatacaaaaccaaaagtacaacttacctgtatcaaaggcattaaagtaggaagaatgtcatcaccgaaaacattagaaaggacatccaggccagcagcactacatttcctcaaattccaaacatttacagcatcatcatcatcctgtccatacgacaacaaaacaatgttatcttcatctcgacagtttaagttggtggaagtcattaagctttttaaaaacaaataacatttctggactcacatcgtcttctccggtttcagatccatgtagtcgagaggcatggaaccggggcttcaagtcctgttatacaatgcctttcttgtttataaagaaataaaagcagagagcatatagctgtaaaacatacagtcactttccatatcttttataaattttagggttgcccaacctaataaaggagcaatagacaacgcaagctggtagtaactaatttcaaaaaacataaaaggtagcaaaacctctgatacaccagttccagaacaaaactacaggactgcaaggttaatctaggacattcactgagaactttatcgttacagaagatttaaccaacctgatccctgtctggaaacgattcgtcctcctgataacatataatatatatcagagcaagtcactatcaccaataacccaccagtgaaatatgcgagatataaagaaaatttaccacctcagcatcagcaagtgattcgtcatcatcagaatagctcatgtttgataagagtgtctacaaatgaatgcaagcaaaatatgtaaagaaactgtgaccagctctcaaatgcatcagaactaattataaagagggaaagggacagttactgggattaagcgtggcaagaactctctcaacccctcaggaggcatgctgacatcacagtatgccgacctagatatgcaccatagttacaacttcaataaagcattaatcaacataaaagaaactactgcctatatcgcagctgatgatagtttatttaaaatcagatggatgacgcctaataaaatgtgagcataacgaactactgaaattttaagaataagaacaagtagttgacacatagatatggacacaatatagttttgatatgcatgctggattaccatgtttacaggggacataccagaattcacaagcctcgagagcaacttcatcatctgaatctttattagcttgcagcatcaattcggtaacatttttcaaatgaggctgcagtttactatccaatgttagatccagcataacacaagatataagcaattgaaaaatctacaaatgaagatcaacaaccccagagataaacaagcaaccctagtcaacgacagttgtttatttcttaaaaaaatgaatagcatgaaatctgagctcaatagggtaacttcacggactacttaatgaaaaaataacaaaaatcagtgcaaagtaaaccttgcagcagggcatcaaaagtattgtgattaaaaacaaacaaaaagaaaacaacagatattggatagtttctgcacaaacataaacacaagggaaattaaacatttcattgcctggctacaaaccagggcatgagctgcaagtgaaatgtgtgtgtatgtggcatttaatctggtgtgaaatatttagatcttaggatttattattttttaaaaaaaatagaacttatggtaattttatttgagattgctgaaatgcccaggcaatgtgctagttacctccaaaattgatggccttacttcaataagctgaacccaggctgagcaaacctatcaaagagacaggaagcagaactatatcaaggtaaaacatgcaactgagcaactgaatagtacataggagcatctatagatactcactgtgctccctcctgtcataaaaacatgtaattttggacatgtttcaagtaaaactttaaaactttgaacatcaatgtctttttaaatattcggattagccttcactgcgttatagttttatcagggttttcaaatgatccccagtagaaatttatctgtcgaaattgcatttttgaagaccatgtccacgtcaacgtcaaaaacaacatgtttttgcaaccggagggagtggtcagctagaaaaatgaactcataaaaggatgaaaggaaatctaggtaggcctcattgttcttaaggggtataatcaagctttcgttattccggaactagaaagtgttctgagttttatcttattttggtttaatgtggatcttgtgggatgctctgtaaattgtgtacttctatacactaatataattattttggttatatttccataaaagaaagtagttggatagcaacatagtgtaatttctctatggtgaaataccagtttccgaacatctgctgacggatcctttgcaaggttgaataaaccctgaagatactgatccatcgacatgtacaaagcctgcatataaatgaaaatgattagaaaaattgttaagcaaggtaagacatagagagaggaggggtattcttactgctggcatgaccacgatgtactgattaatacagcccagagctagctttctaaggattgcatgtgttgattggaaaaactgaaaaatcaattgagcagactgttagaacaaatgctgcaaacatgttgaccagagtgtgcaaacatgtatacacctccacagatgcatgttgtgaagagaataagcattcagatggtgcacataaacagatagaatttatgattttacagattgtggaaatgaaagtacacacaccatgtttgatagttatagatgtaacacaaacctgcagtaatcttggcatgaatacattgattggccgttcaggcaaaccaggaacatcaacatcaagctcctcaggaacatcctcacagatctgtagaaaaacaagtttttgagcatgcaaatcatgttcaagttcacatagagtattcatgctacaggttcgctactgagttactgcttaagcacgtagacaccaactgttcgaagtcttctatgtgaaaatcacagatcaggctcaaaaatatgagagagaagtttaccttgtatatagcatccatagcaccttccatatgatccagatcattactgtccaagcattgatgtagagcttgaaacaactcgatccatccagcaactcgaacaatttgaaagagtacactgatgactgttccgactgtggatctgattgccttattggttgcccctatacatggcaacaactcagactttacgtactgctgggaagcaggaggcatggagctgaaagtagctcggaggttgtttttcagcagaagtccagcagcttgcctggcttcaaaagattttccctggcaagagatttgactacacgtcagagaagacataaacactaggaggttatagggttataaccgtatcaagattaaagaacacattttattccagaacaaggctgataatctgcagagttcttacaaggctaaatctgcatcaggtctacagtttcctagcattggttggccataaaaacgaaaaatagtatttcaaaggttgaaagaaagaaacaaacattttaaaaattttcatcctaccttgctgccattgtttagataaatatcatcccaactgtatgtgtaattttctagagggaaggagtggatatagaatcatattgaatgtattatttattgattgatattgatgaatcaagaccgcactactgtatggtgcacgaacaccttaaaccaaaacaacagtattgcttcaattcaatctgtacatctaattagggagcaatttggtttttaacaggtgtccacccctatatttaagctttcacgtgatgttgcctagttccataaaaagtaaacctcactaaaacctgaggtcatttcaaatacgttgcgctacgggctgacctatgacttgtcacaacagcaaataatgtgaggagtaatctaaaaattcggaggttgtactttagaaagcatgtatgacaagacggggcatcgcagtgacataaacgcatgatttagttgctgctcatttgcttaaagaaaactgaaacccttgtatatggagacatagcagctaaaacaagaaggcgaaggagtgtgcacgggcatgtagggttgtgtgagaagaaacaaaatgaatttctaacatagttgtaagcatgggcaatgtaattataatcaaacgcagtagataagatgaaacatgtggaagtatctccgacgaacagacaccacgccattgaagaggtggtatcagcagctgagcatcgaaaatcccacccaatcagcagtggcgattctacaacacgagtaacttctaatgtagcaaccaaccgagcaattggagcttctaatgtagcagtcaaacgggggcaaggcaagcaggaaaaaaacagtaaacgataagaagaagcggcgcgattcagatcgagagtaatcctgcagcagcgttagaggcaggggtatcgcatattcgcatcggtgaaaaccctagcgaggggggagttggggatggggaagggaagaggtagagtagatgatggatgacctctccgcgggcgaggaggaaaaccaagtagttgttgaagtcagggaactggctgtagtgctggagctgctgccagatgcgagcctggtcggagttgggggagatgtgcgcgtcgaggagggtgcagatctcgcggaggccctcctcctgcggctgccacagcgccgccgccgccgccatcgccgccgacgaagctgcgagtcgagaggaagaggaagaggagggcgaggcggcggctgaggagaagacaactccggaggagaaagggaatcaatcaattggaggagtagtatttcccttcccttacttattagtattactgtttgctcctccaattttatctgctactccatttttcttttaccttttcatttaccccccccccccccatctctcatcttctgattctttctctaattttagcatccttgattaggggtttattatgtaaactaatggtgtagaaatttacttaggctactttcgatttgcttggttgaggtgcaatttaccattgaacagtttagaaaacgtgcccataataaataaggttgtttcacgacgtaaataaagtaccgaaaatggagccttactctccaataattggcttttatacggaaacgttaaatggaaataaaagaaaatattattttcctattaaatggaagacccatgcgcgcacgcgtccacgggtgtgcatcctttattacaaactcaaatgaactgaggccaatgatttatcggttcatcagtatgtcatcttaaccatcgtagtgttgatgctttgcaaaatacacatattttaattgttatcaatatatgccatacgtgctggagaattaaggtcattctcaatgttactccaagaaagaaggtaattccaaaaaaaatttataaactaggttgtttatttttatgccaaaactttggctaagtttgttcaaatcaaagctttttattgctttgccattttagtactgaccattttttccaacaaacctatgggtattttggcattaccctttttttctattgctttattaggcattgaacaagcatgcacaccctaaaatatcaacccgattgaatgaaaataacattgttattaatttctgtcaacctacccatatatgtgcgtggaaataaataataatggacctcctttgttgtctttcatttgctcttcttttctttcatatccatgacacatagtactgcacaatggcaccacatatcagtgatacatatgatgatggtagttttgaatccaaaattttaaggatggcactaagggcctgtttggtacagctccagctcctaaatttaactccaggagttgagtctggagtggagttgt

SEQ ID NO: 74454 - DNA, 14196 bp, Oryza sativa
gtcggccaccacaacttctcaattcattctctaggtcggccaccacaacttctcaattcgcatgctcaaagtacgattgtaagtaatgcatttctgggatggattagggggggggggggggttgttaaattcacacataaatttgaggcattagatgatgtaagtataactggtgagattttttttgtgtttcgtctaagaaaggccaatgaatcaaaagttttgcaagtttactccctacctggtaagttgccaagtggtacgcttgggcactttgggtgtctaattgaagagcacttgctgtcgaccttctgcatttaatttatggatgtgtttttgctggcaatttgaaacattgttactatgttattatctgtaacgcaagcaggtcgatcatgtatcgcgcgcctatgtttcaggattttttttagtcatgcccagtggccatctgtgaaaggacaaaattcctcggtttcattcttccagaggaggacaactttttttttaacatttttaaaaaaatcaacggcggcaaacattttgagatggagggagtatttgaaaaggtacacgagcggagaggtgaaatgtgtgatttactttccctaatttatatggcaaaaggcagaatgacgtccgtggaatctgggtagaaatgagccgtcggagaggagagattctgggatgcgaatccaatgagcagtacagtataactatgaattccgaaatcaaagttgtcacttctgaagtaacagtaaaatggtgattgtgcctgaacataccctgcagttacatccatcatctagtggtctctgattctgatcacaattaagcagagagatgataacaggctactcgtagcaggggagatttacatcaatgaatgctgccttactcatataaacaggtgatgtaataatgtacccaaagtttgtttggggactgatcgatcgagtatctatctatgtatgaatgagaaaatgcatgcaatcagtgcagatggggttgatccaaaacgaaatgatcgatgctggtcagaagaacacaacactagtgaagtggagtatggacgacgatggatcaggagatttggaggtttgacatgtcgaggtcgacgctggcgtgaacctcgcgcaccgtcctgtcgtagtcgtcttcttcgtcctcctcctcagctggttgttggtcgtcgtcgtcgtcgtcggtgccccagccgtagccagagacgggcttgtcgggcttggggacggtctgcgcctcctgcacgatcctcatgatgtcctccacgctctgcggcgagaaggcagctgcagcagccgcactacttgcgctggaagccgcgtgatcggctccccggcggttgtagtagacggcctgcgcctcctccttgagctcgcgcggcaggttcttgaggaaccaggggtggtcttgatctcgcccatgctgatgcgctggaatgaagacatgcatatgcatatgaattgggaatagataatgttgattgatgagctactccatatatagtctgtaccttgtaggggttggcgacgaagatgcgggagaggaggtggcggcagggctgggagacgtggacgtactcggggatcttgtactggacggacatgatgcgctgcgggcgattgcaaatgaagcatataggtcatatatatgcaaagaaagaaatcaagaaagcatcaagcgcagactacgtaccgagatggtctttctgaagttcttggggtccttgggatcctcgaaagggtaagcgccgacgagcatgacgtagagggtgacgccgcaggaccagacgtcggcgagcttgccgtcgtactcgcggcgggagaggacctcgggggcgatgtaggcgggggtgccgacggtggatttggggcgggagtggaggagggaggactggagtagccgaagtcgcagatcttgaggcgcggggccgggctgccgtccagcagcgtattctccagcttgaggtcgcggtggcagatctgcatggcgtggcagtagctcaccccgcacaccagctgctggaagaagtagcgcgcctcgtcctcgtggaacctccccgcctcgcatatcctctcgaacagctcccctcccgccgcgtactccatcacgatcgccagatgcctccccgtcaccaccacctccttgaaccttattatgttcgggtgacgcagcgaacgatgattcacgatctcccggaacacgttctcgtcgatctgcaccaatttcatttcatgctatttctttctttcttttcatatatcattccaaaagtaatagttgcttgcttaccctgttccctctctcgatgaacttcatcgccaccagctcccgcgtctccttgttccgcatcagcttcgctaccccgaagttgcccgccccgatctcccgaactggctcgtatttctccatatcctacctcctcttcttctcctctcacttaatttcttgctttcaattctccttctccttctgcttctgcttctgcaggaggaacagtatctggaggaaagaagcagagcagagcaagaagatgaggaggagatgacagacgacgacgcagataacctgcagacagatagacgacggacaggctgaaagaataagaggaaagccagccggccggccttgtgcgaaaaggatggatgcaaccagcgcacgactcggtcggaatttccatatttctcctcatttgcatgctcattaattttcaactgatcaatcatcaccgctgttaatctcttgggagtagtactaagctatggtagatggcgaccactgctgtttgtctgtctgtctgtacctttcagttactactacctccgtcccaagttaaattaagggcaaccatgagtttccgcgtccaactttaatcgttcgtcttatttgaaatttttttataattagtatttttgttgttataaggtgataaaacatgaatagtactttactcttgactaattttttttaatttttttaaataagacgaataattaaagttggacgcggaaaactatgactatagttattttgggacggagggagtactgtgctagctagtgtacagttaatcatatactccttccttggatggactaattaattaactaccactgtgtacaacgacctcaatatatatattccggccggttaattaatgttagctgctcgatgtttgctttccaaacgcactgttgcatatgctaaagggcaaccactatatatgtctaacgctgacacgacaccacacatggatggatggataggtggatggcaaccttacctgctcatgctgtccgcctcctaccgatccagccatcagcagccacagcccacacacgaaacaacaaatatccaagcaggcaggcaccattttgcagatctaattgactactactcatcagcatcgatcactaataatatcgtacttagtagattattaacttgctttccttgtaacatatagtactatccatccatcgtcgatcgccaacgcattctttcggtgtatatttgtcaatccaaattaattaacgtgagtacatatatcaccgtcaccgatgtgctgtgctgtgatgttctgacgaggaaaccacccatgtatatatatgtacggttaaactaacaagctgcaacccggccaatgacgctcatcgatcatcaacaagcctaccaactgcgactgatctacttaattaggagtattaaatatgccatcctaaccttccaaccccaataccccatcatcaatttttatctctctaggtaccttacttagagtatgttgctgctatagaacatattttttttgttgccattgggtcactcaaattcagaccgactgttcttcctagcctagctatcaggtactgtatcagttacctagactatctgtatgagccggaatcatatcactgttcatgtggactagccctacgtactcttacacttgtactcttactagtacttggcatcagtacctgaatcagggaccatcagatttagaaaatgattactcctaattgtcgactgatctgtagtagtagtactagtccagttgggatccaatctggtagtattagtactaagtgaaaaggtactagtagctaatcaagcttatcatcagaaggggcagattaaaagtgatggattggatatctgaacttttgggttggagctgatggtgcatatacatggatgggaggatcatgcagcttctttcgtttgctttacacaagcagctagctagctcagtgctcatgtgccttgctgtccacttattactatggcctcctgtctaatcagatcagctcatgatcttggacattcatgaatccctcgtcggtcaatttcctaacttgatcaacatggagattcagtatttgttttaacctttggagcttaggctttcattgactttgatggctactccagtttgtaactactagcttgtggagattaccataccataaccataaccattacatcacaaacgactgagtcgactaagacctgcagcattggacttgttgtcaagtcaatggacatatgaatggatggatgatgcacagcgcatgcagctggttttactaggaaagtttcagttttggttgcaattaagttttcaattgatgtttgccagaaaaatggaagcagcattcagctataactgaacaaactgaattcgatcgaaagtacgtttgtactatacagtatatactagtacatggatgattgtatacgtgggatgtatagatagatgagatagatcgtgatcgatggcatggagagcaagttgttagtgcgaatctctggtcggattcgattgatcacaataatacaattaagatccagtccaagtctgcaacagtgcaaaagcatggcctaccaacaaagccatccacaccgatagattccttcgatccagtattaagctgacagcgatgcatggcccgcactgcactctaaaatataatctttcaggtaacagtgtattccatattcagtgtcctccatataatccactgctcctagcagggaaagcgaggagaagggcctccccctacctcaaggctgtgtttgtaaaatagttttgggatatgattttccacctctcacagagtaaacttcaatagtagccatccattcttctgatcccatttcatcacatccctccatttattttcatttcctaatcccacccctcctaacccatttaccaaaaacacctcaaatgttagtgttggttaaggcagctcagctcattagtattagtacggaggacctgtacagtttattgtcatttttaaccttaccaatttatcataatgtaaaatacgaatattaagaaaagacctaatatcaaataatagaaggggtgtagcttcagacctagaccggctagcccaccaccttgtagggctagctggaagaccctgagcgtttctcaaattatggcaatgtaacaaactaaatacacttcaatcattgctaccttaccaaattttagcatctttagaagcttcctctcttaaaactctccaaaaatttagcaaatatattaaaacaaaagaaagaaaaaaaaatctaaattacccctaaactattttggaagtacgaattaccccataaattcaaaaacaagatatttttcattctcaacctatcggaccgaacgaattacctcatagccgacttcggagtggttttagtcctatatcaagcacaagtgaaactacaactttgtaactttagaaaacaatagtgatatggtatgaactctaaaatatgtagtccttttttataaatttatttatgactaagtctgtagttttgtgatatgtttataacacaaaggaacaggtacacccaaggtccctcaacttgtcagtgagataaaaaaacgtcatcgaaccgcaaaaacagatatatagggtcccttaactatacaaaaccggtcacccgagattcttcggtggttttgaccccggttttggtctatgtgacggctgagtcagcatggaaccaacgtgggtcccatatgtcagaatgccacgtcagctgctcctcggttcctcctctctctctctctctctgcctgttgagcgcgagcgcgaggcttgcaggcaagcagatggttgaggacccggcgagctcggaccggtgcacgacgcggaaggggtctgggtgaccggcgagggcgcggccgacggctgcaacgcccacggcctcggcggcggagaggaggagatcggcgaccagcgccgccgccgccgcgcttcctccacgcgctggccaccaccgcctccacggggacctcgccgtgggcggcggccatcgtcgacctcgccgcccctagggccctccacgccggcgcacaaggggcttgccgcggaggacgagcggcgtggagctccagacgcgccgccagcggaaggcgagcgcggcggtgcgagtcgcgtccttgacgggaggcgggcgacgaggaggtcgtcggggagtgcgctgacgcggtcctcgccgtcgtagccctcggcggcggaaagcgtggcgccgttgtcggaggcgggatggccggggaaccaccggaggcggccttggacgtggcgctgtcgtcgtcgtcgtcctaggcgtcggggaagaaggtgggcgcggcggcggcggaggctagggggttgccgcggctagtgtggatggaaagctgaacattgcttcttcagctccaagatactgtaattcacgagcctttttattttgatggttgcttcttcagttcgaaaggtgtctctgtttttattcttgttcaagccatcggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtagctagccaatgctaatcttttgagctcgattatgatatatatcgcgtcgtcagatttgtgcagaatactaaaattggtatagagacattctgaccgggttatggtcgatgacactgtccatcatctgagagtttgcaagtctctgaactctgaacattgcccagaatctcttacagggatctttttgttggtgtcctcatacagtatacatcattggccccttgcaagcagaggacaaattctctctgcattcgtatgcattttaattctgcgaaacctgtagcttgtcctgtgtataaacaacgagaatatcatctgtttttcgttccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcatccatgtttcccaagatagaatgacgcgtacacaaacttccagcgtgtcgagggcgaggtcaacggcggcgccgcaccgcgtgtgccagcaaccccgggcgccgcaccccgggagcggcccgctcttgggcgccgccaccgacgcctgcctgctgtacagaaactgcagcacgagcacgagcaccagcaccttgtaccgcaccagccgcggcaaccccctagcctccgccgccgcgcccaccttcttccccgacgcctaggacgacgacgacgacagtgccacgacctcctcctcggcaccgccgccgcccacctctgccgcgtgccccccgcagcaccaccctccccggtggcgccgccgcgccactatgttcgttgccggccggcttgcaacaggagaaaagagtgagagagagaagaggaagggaggatgctgacggcggcgttgcctccgccggcgcgacgccggctgccggacctcctcctctcccctccccccggcggcctcttcccccacagcgctgcccgtcgccggctgagaaaagtgagagagagagagagaaagggagaagaggggaaataagagggaagagatgaggtggcgtgggtttcacgtgggtcccacgctgactcgtccgccacatagtacaaatccggcattaaaaacgccgaaggatgtcgggtgaccgattttgtatagttaagggactccgcatatctgcatatctggttttgcggtttgaggatgatttcgctgacaagttgagggaccttcggtgtacttcttcctaacacaaacatattggatcgtaacatctgttctcctcaaggcctactcacgatgacgggctgaattttctgggccacagcgtaatgaatggcccaagtaaattctagggcctagaagggatcgggaggacgccctggcccagctagcctttccgcccctcctacacatcgacaaagctatcgatcaggattcaggagaagcctgccagccatcagccgcctctgcctccggcctcctgcagtctgcagatgaacaacaagctaggctgccacagccggtgatggtgagggtgaaagaagaagatgactcaaaatgttatgttgtccaacacgctgcctgtatgtgtgttgtccaactcgcatccttagctgttagttgactggcatgtgctctcctttgtaatttagtaattttaatttcacttttttcttgtgtaagttaatgatataattcaggagtataagcattcacatccaacagagtcgagaatttggaaggttcacccatcatgcattcaggagtaccgattgattgttgtgtcctgaatttttgctagtatatgcatataagtagatactactccactacagtacagaggagaggattgacattgactagctagtccacttaaccgtctccttactactatcagaagaagctaatttaattaagtggagtaaaagcaaaatgaggggtgggctgggctcattggtcgtcgttgtcgtcggtgacgaacttgccggttccggggttgatggcggcgaagaagaagaagaggatgttgaagaggaggagcggctcgatctcgttgatggggacgccggtctcgatgttgagctgcgccagcgcgcccttcccggtgatgatctcgccgatgagggagaaggcgatccccagctgcgcgaggcgacccacgaagagctcgttcgccttggtgaacccgaacagcgggccaccctcgctgagccccagcgccgcgcggaaccccttccccggcgggatcacggcgcgctccagcccggtggcgtcgtccacgaagcgcccccggtcgcccagcgcgccgatggcgcccagcagcgtgaagaggatgaagaagaggagcagcggctcggcctcgtagatggggatgcccgtctccaggttgagctgcgccaggatgcccttgccggtgaccgcctcgccgaggagggacgccgcgaaccccagcatggccaccctccccacgaacagctcgttctccttggtgaacccgatgccgccggaggtgccgaagatgccgtcctccacgatcgacttgttcttgttcgacttgtccaccttgggggaagccttggttctgctcttgaacgccgccaccaccaccagatgcttcttcatcctctgcagctgaaccatcggcgatgaccgaggagcggtgccaaggtcagacactaccatcatcggcatcgccatgctctgctgcagagccattaagcttagatggattcaacaattagctagatggatcgatcaaagcatgcagtcgctaatagcttgcagctgcactagctagctgctaaattactacaaaatacgatatgatcgatctcttgatcttggcttgctctcttggaatgaattcgagtcccacgcccgcccggggttttaatagttgaggaaggatgaggcctcgagcaacaagggttaggaagcagccacgtcgcccacttgggatccatccatccatccactgtcctccagcatctaaatctcagtgatcaccattcatttgatttttgttaccaactcttgtactattacgtacgtacacttggccctatgctttagtacatacatactccatgtcacaacaaacaaacaaacaaacaaacaaaaggatcgatcgagcaacatgcctgcctgccaacatgtgcatagtaactactcctcgtccacaaatattggaagcaaactgacacccatcgctcttttcgcttctacaagtttcctccagaagatcgttcattcagtgattcagacacgagacaagcaatcacgaagcagcgccctgcacttgtctcatcgctcaaactcctccagagaatgtcgcccacgctacctgtatccgtgtatactcctataacaaattagtactaaaatccttctattttggaacataataatgtaataactgctcgcgactttgcaatttttcttcttaccgtcaactctatctctccctctcaaaacataaatattttttcttttttgttttgaagaaaacatataccattttgttttctatgttaagtaaacaagcgacgcgatcgagctatccgtcaagattgatcatatcaaattttctccaaggtcgatcctttagtacagcaccgtatacatacacgtatcacactgtaccgctgttgcgccgcgcatacattttcgggtcaaatttcagtttgttttgaactcaaagccttatatagaattcacaggcaatgaacaagatcggttccatggtgtagtggttagcactccagactttgaatctggcgacctgggttcgaatcccggtgggaccttttttttcactattctttttcaatattttattaagctatctcactatctctttgcttcattttcatgttcgtgtcacgttcagtatttagaatggaagtatgatgcacggaatcgaagggccaaaaaacctccaatcctccatgcatgttatgtgttaaaacgagaccaaatgcagtctctctttagtaaacgatctgatcatgaatttctccattgcacgaagggttttcttacttttcccaatgctcaaggtaaaatgctaaatggtgaaatttaactccaaagcttgttaataaaccgtgtagatcgacatccttctgtcatccccgaatagtacgggctgctggatttacataaggtcttgtgtagttcctaattttttttccgaaaaacgtcacatcgactctatgaatatatgtttgaagcattaaataatgataaaataaaaaactaattgcacagttcgtatggaaatcgcgagacgaatcttttgagcctaattagtccatgattagccataagtgctatagtaacctacatgtgctaatgacatattaattaggcttaataaattcgtctcgcggtttccagggttacaaaattagttttttcattcgtgtccgaaaaccccttccgacatccagtcaaacgtccgatataatgtgacacccaaattttctttttttgaactaaacaaggcctaaatattcgcacagtaaacacagtgcatatatataactacactactggatgtcaactttgaactgcactgtcatacaaatgttttccctgcttgttcttcaatttggcctaatgagggtatactctccaaattaacccttccccacaaattaactatgaactacatatttatggcattgtatcacaaaattatagatttaatatcaattttctcataaaactacagctttgtaactttagaaaacaatagttatatatggtctgaactctaaaatatatagttattatttataactttatgactaagtatgtagttttgtgataaatgtcctacatctatagctttgtgataattttggtgcaaaatctttagtttgattgaatacagatgaaggctgattggaacataaatttgttcatactatgaacaaatagattaaaatacaaatgaaggatagtaatttagaacacagattacattttattggaagcgtgatgcgaatacttcatggcaataatctagccgatcaagttattgccaaagattacgcgtgataaatagagatgggtacgtagtagaccagatttagacaagcctagtccatttattttatatttgtccaaggcaagtctgggcttcaatgaagatacgaattggtgctagttgttaccatgcataataagggcatatacaaagctagagtctaatatgagctctctatattaattaatatcactagagactatccttctagtagagacaataagatttctaatccattaatacactaaatatttttttattatacttttttccttttctccacccctcatgcaacaaactttccgttaataaacgctaagagttgactctgagccgttgtcatgcataacaacgatgtttctccttccttccctctctttcttccatgtcaccaaatttacctacatgacaacgaagagagcccgttattagacaccattgtacatgccctaatagcctcatagcaaatgagtcgaaggcaacgtttctcaacccaggaacattgtgcatgtcttaggaatacagaacatagagatatttttgtcctcgtgtagaaatattcgcaagtaactattgaatgtttctcgacatgagaactttgtgttgtggtggtgaaaatgatcaccaaatgctgtattggcttcatacggaatgggattaattaattgtttagctggcattccgcaacaaggtttgcaatacagtaataatgtgtgcaaaaggtactactccgtcccagaaaaaacgaattcctatctacgaatctagacacacatatatccagattcgtagataggatttgtcttttttgagacggaggggtgaattaattatgaattgtgggccagatgtcatccatgaacgacatgttatatcacgtatctgtgctagttgtgtactccttctgtcaaaaaaaaaagccaacctaggtggggatgggacactaactaggacaacgaatctagacatacataatgaatctggacatgtatgtctagattcgttgtcctatgtggtgcccatccccatctaggttgttttttttcaacttttttgctattttacattgtaaattatttctaaaggtcacactattaaggggttgtttggttcagaacttcaatttgccatgtttcaccttagacgtgccacactatcttaatcttatggcgggctcatcaccatagttataacttgttacactttttagcaccttgttctatgctttatctgtcccgaaataaataaaatcagtacgggatgtgacatactttctatctagattcacgatactagaatattgtcatatcacgtactagttttgtttattttggaagatcgggagtacgtcatagagtgaattgtttgtctaacttaatcacaagtgcagcttactataatttagtggtcctaaaaagtgtggcaagtgaaatttgttttaaaccgtataataagatggctatgtgaaactaatttgcaggttttcctcctatctcaaaggagaattcttggtcgtgcttatctcctcggaataaagaaaagaaaagaaaagcaacgtgggagaattgagacgtgcgggttgttggcaactgaatcgcgccattgcccgtgtaaatttggttggtctttcttggccggcccggtaaaaaaataattcattaaagacagacaggggaaattagaaaagtgtgtacaaatttaaagacaggtcgcttcccttggccttaatttgggcacgggggagactaaattctcggagaaggaaggtgtccataattaagcgatcgattcgagtccccttcccttcctccctaaaccctaaccaaacccccaccactctctttccgcgcgccgcgtgcgacgatggcgcgcccgccagccgccaccgctccgcctcctcctccgccgccgccgccaccgccaccgccaccgatcgaccgcctcgtctggctcgcctgcgccgccccgctgtcccgcatccccgtcgtcggcacccaggtctcctacttcccagagggccacgccgagcagtgtcccgcccctctcccggatccgctcccctccgcccaccgattcttcctctgcaccatcaccgccgtcgacctctccgccgacaccaccaccggcgagccctacgc

SEQ ID NO: 74455 - DNA, 621 bp, Oryza sativa
cctcacaaggtgaggttacctttgcctcctgtcgtattgttgttattgctcgctgtgataaaattctggttaggaatttatttgtggtatgtgagagcggtttgtttcagaacaattgtcgcttcaggtattgccgtcgaaactcacacttgcagtatttctgccatttgtttagtaattgtgaacaagtaatgttgttgttaactgatagtttcagtgaaatattagattcgtttgtaaagttcattatgaattgcatcacgtgtattattgattttgttgagattggcaggagttgatacatgaaaagctcatgcatgtttcttaatttaccggacactgattcaaagaaatttgtattttacttcaccattgctaatgcccacttatgtttttcttctctagtttggaacacacgatgtggttgctctgaagccaaataaggcagatgctggatctgctgctcttgggcaaggtgtagtttatcgcttgaaggtacctaactatcatctaagggctgttgactatttaaagtctttgcttctgaattaggagaaatgactgtaatttgaacaaacaggattcttccattactgttgcctttgatgacattcctgaaga

SEQ ID NO: 74456 - DNA, 1526 bp, Oryza sativa
gctagcagtataatcagtataatttaaacataaagtaaagttggcattcatatactcggaaagtatttcaataccataattgtataaagaagaatattctaaataaaatacaagtcttacaaaagaagaaaggagagctgctagagccatacccaaactcttccgaagacttctggactccgatttctattatattcctactccactagcttgatactactaaactaaacttgagagaatatgagaaagctcttgcttgaagtgtgtggaaaatggaatgagaggagctccttttatagctgctaatgacggttgtggcagttggaaatttcctaactgccctgcaactgtcattgaggatgcatcctggatgtccacgcaaaaccacaggatggaaggcgctgatgggggttcggccgaaccatggcctgggccaaaccagcccatcctcggctggcggtctcctccattgcttctctccgtagacttgtgaattttggcccaattggttatgtcatttttgagtttttggcccattcatacataagtctgatcctcgacattgtccgattgattgatcgtctgatttgatgtcgattctcctccactctgtggttattctctgcaaaaggtcagtaaacctattaccagtggaatattattattctaacacaaatatgcattacaagcataactatttctcctctaatttggtagtattgacggtcgaaactgatcgctaacgtccatcaacaaaaaccccccaagcttgaacctttgctcgtcccaagtaaaggacgaacggaaacaaagacttggttgttgatcaggaattgctactatgctgtatatctcaaatgtacaggtgcaaggtatatgtactctctctcaaattaaataatatttggcatggtggcttacccttacccctaattcccacaagacactgcctttccttgccttgagcggttgaaagatagaacaacaattagagcactaatcacccaatttttattcaacttttattccagaagttttcaaatgattttacaaaagaaatccaagttcctcaaatgattcactcagtctctccaagtgtatcaatatgaattcctcacctttttgcccttttagattcctactctaaggtttgatatgtggagctcagtagggatcaaacatggcatacttgcattcacgtttattactaagtcaaaaacttagactaaaatagatgactaaacatacttaagatcaagatcgtgcaaagtgtgtgtgtgatatatggtggaaatgaaatgtgaagaaaaataaagaaaacgcttctcctttgtgcttactttcttctcccaaaaatccttctttttattaataaggagagggcatggctacattattatcttttttttcttttttttcccatatcatgctcatacttgagagagcataactttattattttcataaccatgcctttccctcttcccttttttttttcaaaaatgattttctttttaggagaagaa

SEQ ID NO: 74457 - DNA, 4442 bp, Oryza sativa
ttaactttgcacattttaatttttgaaggctttcacaagcattttaattattctaggtataatttagaggatgtattttagggtcgatttgggacgcgacaactggtacaggtatggctttgaataatttgtttgcatgattattagtaaggaagtcgtaaccctgttgtagagtccatagccttcactcgggatgagcaaatgttaagtgtaggggtgttgttgacggtcattaaatcataatatttgaccgtcaatacctacatataatgaaacaaaacatggtatccaacttagtggtagggattattactaatcaattccactagtgttggtgaaatatgtgtatgcacgtattttaatgagaaaacacacccgacatgcgaggaaacacacctccgaccaatcagacgcgagcacacagattggagggcccacaaatcaggtgaaaccgcccgggaacgggtcataactgccataaccgccatcagggcccaccagtcattgtcccagccaaagcagaggccaggatgtggggcccagggttcggccaaaccaggtggttcggccgaaccaccacaagctcctttaatcctggccttccacgtgtacgctgctgattccttcccaatgatggttgagggcattttggtcatttcccatacatgtaaccgtcatatggaggctataaatagagctctccttcacacttcacaacacacaactttgagctaaattacaagaggctctattgtatcttttgtacattagaataaggtagagagtgaggggaagctctggaggagtgcccggaagtttggcgctcatccgacttctacctcgataagtgtagcttcatatgggtaattctggaggagtaccggagctgtcggtacactctgctcctggttcggagaacttcttctataaagtaagcattcgtgttcctttttttttgttatttaattactttgtctaagcgatatagatttccatctttgcgggttcattgtttagtattcgtactaagtgctctagtaataggactctagataaagaaggaagttcttgtacaagtattagagtagtaattaataacttagacgtggtgtctaggttaaagattacatttgtttgttgtgtatcccacggatttgtcagagatggacggcaggtggtgaggggatcctctagagtcgcgtccaggtatcctccacgttcggatacatcatagagctatagccggaaccacgttggcagaccagcaggggtcgttgcccgaagcaatacataggaaattatctttacttagcgtagataattaaaacacatagaaagtcttctctagcctagcctacctatcatctgttgttgtccttggataatcttagccttaggtagattacacacgttccctgacttcgatatcctttaggagtcacccgaaggtgaagtgctacagcggtattccgtgcgcttgcggatttatctgtggtcataagaaataccaacacccttgacatgcagacgagggagatctagtacgacctcacagaatacatggctcaaatgcaagaatggcaacagactgctgatgctcaattcgccaacttcaacaacatgatgcagcaacagcacgatgaccttcaagcgtacttccgctttcaggggttcaattcttatcaaggaccctgagcgaatgccaagcttggggggagagatgtctctccccccactgagataacttgtatcacattggatatttccctttccaattgcatatttgctttcaaattgcatcttataaaacttgaaaacaatataaaaatttgcaaaatagaaaataccaaaaagataggataggtttgggtcatgctaggtaagacaagctagttctcttcgttgaaatgatgaatagttgctctgttttatatctcttatatatgggttcatggtaagtgctctctcaaaggttaaatataagtagccaacaattatctgagaacttgaggtaaatgggctgtacttgccaatctaagtctaggttgttgcgatatatgacatagtaaataagagttgctatgatcctgatactagtttgaccaaaatagtggagaactagtgatgcttgcaatgcataaatatgttagaacaataatattccactagtgttaggtatactaattaaccttttgcagagaataacactaaagtcgacgagaatcgacatcaacacagacgataaatcaatcggacaatgtcgagaattagacatatgtatgaatgggccaagaactcagaattgacacgatgatttgagccaaaaatcacaagtctacataaaggagcaatggaggaggccgccagctgaaagctgggttggttgggccgacccatggttcggccgaacctccctcgccttcgttggatccatgttttggctggacggttgagatgaagccccaatgaaggttggagggtattaccgaccattccaaccgtcacaaccgtcataactcagctataaaaggagctcctcttctcacttcactcagacacatcaagcaagagctctctcatttctctcaagtttagtttagtagtatctagctggtggaataggaatagagtagaaatcaggagtccggaagccttcggaagagttcgggtatcgctctagtagctttcctttcctcttttgtaagctttgtactttttttagaatactcttctgtagacatttatggtattgaaatacttttcgagtatatgaatgcctactttacattatgttcatgttatactggatatacggctaacttatctgggagatgctttggtgcgggtataatttttgcttatgcaattactctatgtcatgacgatgatattagagtagtatctggtagtttagacgtggtgtctagattacgggatatcattatttagggttatatgctgcggatgagaggtgggccgctgatggtgacagctcagtacgggtattcctccgtgcctgtatatgatcccaagttaattttctggggagggtattcctccgtatttagccccggttgtattgtcatgacgggctgtcgtaaggaactcggcaatcaggggtggcttctcgaagtaccaggagggcatcggatagaggatattagctagtgtatcagataactagaatgtatgtatactatgtatacgagattaagtgctacaatactatgtcggaggaacagttttgcactgtagtgcgtgactcaggttattgttcgtctatgacgttggagcatttagtcagaggagccggttcccatggaatccatcgacgcctaatgtctcctacctctcccttacaccatccgcaaagcatcaaaggtctctataatttcatctccctatatctctcttagactgtgtgcatcttcggtatgcacgaatcgaaagtgttctgaatataattgtatcatcttgatgtaatgtgaaagggcatatagccttctcttaaaaaaaaatcatctctcagtctttctagcctgtactggcgtgctgcacggtcgcctgctcagcacatgcccttatttcgcatccaaaatcaccaagaacgggttcaccaaacacatcccaaagcttcgattcagcggtggccggaactgaggtcttgggacttagtatttggtttccgctgtcctcgatggacctcttcagggcataattcattccatgtctctaatttattgaccgttaacgatattatgcactatatatgtcataactacttcgtgtactgttcacatttatggtgggctgacgaattttgactcttttttttttctaaatcatccttacaaatttagaaaatgtctattaggtactgaaaaaataaaccatccctacaaattttgtaatgcatatcgtaaaaaaattttatatctaatatatatgcacttttgcagccatggatcgaagttagatgtacgaaaccgatcgacatatcaaggagtatagaagtggtgtttcaaattttataaacgtcgcagaggaggagaggaaaagaaggaacgattgcatgacttgtccatgtacaaattgcataaatgggaaggagtttgatagctaactagatatacactctcatatgatacgttgagaattcatgaaggggtacacatgttgcatgaagcatggagagcaagaatactatagatacagcgagtagtggtgcacaaaaccaggaaaaagatgaagctgacttgttcgtaacttctccgttgagcagtgaaatggttgatgtcgatcaagatgttttgtaagcaatgttgcgcgatgttgaggagctagattataatgagagagattatatgacgttcacctcaaatcaaagtaacatcccaaaacattcacatcacaaatcttaagttacttatacacacaaatca

SEQ ID NO: 74458 - DNA, 687 bp, Oryza sativa
tcaacattaccaagatagatgggggaatagaaagttcgagttaaaaaggtatttcaaaattttgttagcaacctatatcgggagagtcgctcaacaatgttatccacggcgatgttagaagcagcacaagcaagaatctttgatccacgtttcacctcctgcaatattatctcaatgatagttgttgtcttcccagtgccaggaggtccatgaagcaagaaaacatcccttgacctgagggccttcgagatagcatctttctgcagaacaaagatatgggccccacaaaaaggaaatttatttcatttgaatacatattgaaactggtatttgaaggcgatacaaaaaagaacataacaagtagatatacatggtaaagacaaaaggcatcaattgtaatttttttatttttattaaacaatcaatttctagcaaagaaaataaaaaatgtggaggccaaacaccagtgccagcataattagctgtggagttcaccgaagcaaaagcaacaccattaacagaagtattgcaaatatatgctactactcaggatgaggtcttccaaagccagtattagcaggtgcaagaattatatgtaatcgatgacggtgttgacacatttggttgtaagttgtaatgccaaaagtgatggaatgtccacagtctgaaactgcaggtgctggtgtt

SEQ ID NO: 74459 - DNA, 1950 bp, Oryza sativa
aatagcctgatgtaaaaggggaaaaacggaagagtagtaatacaccaaggaaatggaagtcttaagaagaagaaatatcaatatgttcataatttgttggcatcattcactaaatcatagaaaaggcataaaatatttgtggggtggggtgcagtgaggggaataaaatccaggaaatttgagaaatttggatgcagaaaactgctgtgtttaaggttcaaatcttaggatgaagcatgaaactcaatgtttcaaaaataccacagtagtacctacaactattaatttaaaagagattatagttctaacaaggtgcggaatataagaacacctatttcactttttggtgaatcatcctagaaaatgatgtatcaagtgagaactagattctaaagcagcacagtttggacattcgatctcgtctgacttagtggaacttcggtactcagcattgagaagtctgagagagaatatgttgagtacagaagattcaaaaatgtaaggtgcaaagttgttcctttttttttagcagagaaatttctctattctacatatctaactgagatatctgacatctaataagatctcagattgtgagtccataagctcttattttagatgaattctgacgtgataaaccataaattgttcaatgcatagagatattcatattaacccacacattttcctttttaatgaaaacctcataagctgtaatttttggacattcaagtcttagagctagtttatggtctatgctcttcaatttcctctatatagttccagtaaaacagtgcattatcccttttccttacatccctgaaatgaaaaattaagtacccaaaatcaattaagaatttatgcaagcagaaaacagtagtattgtaatgtaactcctatcaagtccatgagcaacactccatcattgacagaagtgtctatgcatagagcatctgaacccaataagtactcagtgtgccctttctcagacagcacagatatatgggtgacacttcacaataggtgaagtcaaccacatgaactactgaaggacagccatgctaatcacctcaaacagtcaaccaaattaagaaatatcatcattttatgtttttggggatgctcggtcaatacagtacaaattaccaaatagtaaaggatgagttgaaacctgatttgtgaagatctccagatatgttgactgcagacatggtaggtggtaggtacacaatagagccgacatattctgaatagtataaccaggttggtaaattattttcctctactgattagccatgaatcacaccagatctggcattaaattaatataatctctcgtctgatttgctattttcaggtaatgatgaagattaatattcattactaattagttttgccatttccaggttgtacgaagcagggcctggcaaaatgaaagtagcaataggtcaggaagctggcaaccacatttacaagataggactggtcccagaaagctgactgactcagatgttaggggtgtgtttagatagggttctctttgaaagttatggtagttttaagtcctactccacctttaactggagcaatgatccctgcatttttcattgaaaggaaacaatgtcctagaatgatctatagattgcctagaagacaaagaaataatgatgaaaagggtaacttgctaccagaggtagagctaaataaagctaataagtgttattagaaacaatggttagttatgcattagctacaattatgaacaacagacatgtttacaaaatgatgaataatgtgagaaaccatttgtatcacgtgctaatttatgaaaaataaatgacatatcagagtattttattgatatggatcacgatatcacatactatcaggctgctactcgtagagtactgtacaatattgcataaatattttgaagtatatttaggaacc

SEQ ID NO: 74460 - DNA, 1133 bp, Oryza sativa
gcaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 74461 - DNA, 7415 bp, Oryza sativa
ttttactgtgaaagtataaagctgaatagttctgaggctacagcttcagtatatggatacaagagaatgaccaatagcatttacatttttctcagtccaagatgagaacatatcttcttagtctgtaataaaggtctagatgatcatacctggttgattaatctgcaagatgagttatgctaaactagaatagcagacactagactaacacggaaaaatagcatgaagatacctgtctcagcttctcagggaccacaatgctttgaatggaaaagtatttactcatcaactatttgctgcactttgaatactgaactcagaactacgaattactaacctggaacatgcatgaagtcaatggttcaatcagccttttaaccaaagtccgcacatgccaaatgagacacaaatttcaacctagagggctaggcccaatgggacagcccataattgcatatagatgatccatagtgtgatggtacgcggcagacacgaacacatgatatttgattaaagccctaccagctgagagtgagatagctttcctgtaaagttacacaacaaaaatgtgaatactcaaacattaattaaatcatattcaagctaaatccgcacctaagataagaaaaataaaatccacgcggaagatgaaaataggacatttgcagtgtgaattcgcctaagccaaagtaactcagtactaagttggtacgttccccaaactgtaagccatcaccccaaaatactacaaagatttcatatatcggtacaatgcatcaaaatttcagcactgaagttgcacctcgcgggaacacaccgccgtagcaaaccccgcatccggcacccgcgagaacgacgatctgtacagtttgcactgcatcccggcgcgacattacgtcgaacacccggcgggcgagcaaccaattctcgaacgctctcaccactggcctctcccctatctccccaccgcgatctcctcgcatcaacctcagagaaagagctgcgccgaaccgtcacgaggcggcggctggggttgccggcggcgggcgccaccggaggagccactacgccgccggtgatcgatcgctcgctcgcttcctcttccgttgcgagttgcgatcgaccatccacggctcggctctgtcactgacaggtgggtcccacaccgtcagcagtaggacataaaagtgaaattttcagaaatcccatgaaacctcaagtatataactggtggcataaatgtatcacaaaaccttatctccatttcggcaaacattactaagatttttaaaatatagattgtatttgaaacttttagttgttgacatcttacttaaggttgttggatcaactcttcccttcttcaacaagcattgtttcagatatgccaaaattaatttaaatttgaaaagggtgaagttttgtactccaaaacatttaaatcataaaacacgtgattatacgccaaaatcatactgacgtgggttttatgtatttgaccataaaacgagatttgatgaaatttactcgacacaaaacaactctagactcttctcgaggaagcaacgcctcccttgggaaaggaagagagagattttctcttcctctcgccgccgccgccgccgccgccgcggcgccggccatggcgacctccggcggcgaggacccatccggctctgcctcgtcgtccgccagcgcgctcgactccctgcccttctcctccgggaacccacgcatcgaggagacccgcggcgtcgtcctcctccaccccgaaccacccgccgcctcgtcctcgtcccttctcccggtaagccaccccctcctccccttcgatggccctcgtaatcgccttctcaatgttctcgttcgcgcgcttgtcttgccaggtggggaggaagccgcgggtgtgcgtgcctggcgtgcccaaccacctgacctacgccgacttcggccgcttctgcgcatcctgggcctcccacatcctcgagacgcgcatcatcaggtatcgtcgggtctcgattctcagttgggtgaaagcttcgctgatgataattctccgtagtagtagtagtagtagtagtagtagtagtagtagtagtagacatgggctcattgcgcgtttcgtcagacctcaaacattggccaattttggtgtgcatgagtggttctgatgtatgtgtgaattggagtgttaattggtgggtatgtttgtaggattgatggggtggaggatcagtacggcgttcttataaaattcgacactcagagcttcacggatagcttctacatgagctttaacgggaatcggttctcatcactggaggtgctggattgctttggttctgccgagcacttcgatcttctgccgctctgagtaaatgtgtgctgtgctgattgatttggggctgatgtgctgcagggtaatgtttgccgtgttcgttttgtggaagacgttcactacactcaattgattgagcacgcacatagctcagttacaagctcagctgaacaacctacatgcccagtatgtcttggtatgtggaagtcttttgagttactctagaaatttaccaaattttcatgatgtagtgttctttcagtctgttcagggaaatttggaatacctcagcagctttcagtattgtattttttaagttaaaagttagagatgttcacccacctgctttttaaaaatatcattactccctctagccacaagtacatatgccactttggacttacatgtagtcaaccttcgaaattttgagtaatggtatgccattattttttattttgatacatgaaaaccatgtgtgtatctgtctcaaagattactttcataatgttataattttatcaggtttataaatggattacaatagatattactggtcgaagtgtatattgagagttatgctgatacccaaagcatgtctatgcaaccaggagtagttttctatatttactatcttatttaagcccaaagtatagctttcgaactcacattgatcacaccatttatttgtttttattgtcaatagaacgacttgaccaagatcctggaggcattcttacaacaatatgcaaccattctttccactattcgtgcatgtcaaagtgggcagactcttcgtgcccagtaagatcttaagacaactcacttactacaggtgttttttatatatatatattagtttactaagggcatcatcatactgttctatcaacataacttttgctgtcaccaagtttctggtatctcaaatttatggcaatcaactacattattttttaaaataatacttactaggagattggttggcattctataatttgaattcattgcttctttgttttatcctggctttagaaacaaatctatgtgtgtttacagaaagtgttgtgcaggtttgcaggtattgtcaacaagaaccagagaaatccagctgttcagtttgtggaacatcagaaaatctttggatttgtgtaatctgtggccatgttggatgtggaaggtatttcatgttaattctggaagatgtgaattttactaagtaaacaacttatttgattgattggggattaacgttctcaaaggtacaaaggtggtcatgctattgaacactggaaagaaacgcaacattgttattcacttgaattagaaacacagaaggtttgggattatgctggggacaactatgtgcatcgtttgattcaatcgaaaacagatgggaatctggttgagtacaatttctatggtgatcattcagttgatggtatgtgttcaacatgcaatggtgatgcggggatcagtgaagctctgctcgacagtaaaatggaagctgtaatgtattgagtacataaagtttgtagatcactagccataccatcgtagtacattttgttttccatctcttacaactgcgcgctttccctgcttttagattgttgaggagtacaatgatctcgtcacgtctcagcttgaaaaacaaagaaatgtaagtttaaatgcattgtgctttatttcgtttgtctagttgatgtttctttatcacctaggtaacgcttttatcacttgctgctggtatctactcccactgtcccacaaaaaagtccaatcccggggatgaatctggactcgtccctaggattggactttttgggggacaaagggagtatgttccaaggaattattggtgtcagatcattaacatggaatatttggccatgtaagttttggttttagtactaatgtacattctgattttggtgctaatgtagtattacgaatcactcctgctagaagtcaaagaggataatgagaaagaaattgctgctgctaccgagaaagcagtgggcataaaagtacaaaagttacaagcaaagcttgataagtgcatggaagagaccgggtttcttaatgatgtaagctcttgcctatttgttaagatcaaatctgaaactgtagctctagaattactgccttcagggaactttatgacttacgtactcataattattttgatatattttagattcatgaaaatcttgtaaaaaacatggagatgtggagggagagaattcaaaaagtaaaagaaaggtattttctctgatatctttcaaattatcacaggaacgacttatgaatcaattcttgtttacaatcatgtcctattccagctaggtaacttagtagaatatgcatatgttttcattgcctctcatatgctgtaacgagtgaccaaagtggatatttggtcattttataattcccttgcagttgttgaaattggacagaaattgcgttaatttagaatttgagttgatctcaatttatagtttctgttttactgatgatcaaaaatcggtttgattttattatagggaacaagctgccattagattgaaagatgaaaaaattgagaagctggaggaggaggtcagtatgtttcgtaactgttgttttttagcaagttttatgcttctcttctcatgatattgcgtgccttttatctcggataagtcggatatgtaactgatgttaccacatgttagcaactcagaacctccagcgtgcagagttgttccttagtgctgtcttgtttagacttgttagtggatatcacacttgcttgataagaccgtactataatcaaatagtttagtcccttgtttgcataaagtttaagttatgttatgcacataacataagtgaatcccctgtagcattgtatctcatgatcacgaggtaccttttgtgttgcaaatagatgctgtctgacatctccaaagaacaaaaaagagaaagctatgcattggtctttggtcacgttgtttatgattgcaatcttctgcataatgtttacagtatgcatagttttaccattgtcttattagaaggcttattactgacccatcatcctcttgtgacagctaagggatttgatagcccattttgagcgccaaaataccgtggcagaagcttcagagtcaatgtcaagcgatataaacggtagcacaattctctcggtaccatctgaatcatctgcaagcagcaacagcagcatcagaaattaggattgagatttgttaccgtaagctgtatttcagcatcagaaattagtctgttactggccttaccgtacattctttgctcccttattatctaataatgacagttatgtgttaccatggttatatacttgttggcttctcaaatgcatagtacaaatcaagcctttgtacagtgtgtttttctggacaattttccttgcctgtccatgtcaaaatttgacatttttccaaagaaaattctctcagaagatgctggattccctatctgcccctacccccaaccaccccaaccacacattgctgctctaacatgcatgcccatttccgtctttttccaagatcatatctactacttaatcaccattaaacctgcctggttactgctaatcacaggcggtttgaccgtattaccactcattttgcttactacttgatctgagccgcttagctcggtaagaagtaggtgagtagccttcatggagacggaggcctcgccgccgtcgccgatgagctcgctgcgtgacaggctgagggccacggtgtgctgctgcttcggctacggcggcggcggcggcggaggtggcctcggcgacacggtggcgcagtggcgccgccgcgtcggctcgccgggggagttccggtatgatcccctcagctacgcgctcaacttcgacgagggcgccgccgacgacgaagacgacgactacgaggccggcgacaaccaccgtgccgacggccttctctaccggagcttctcaccgccggcggcggccatcgccgccgtgtaagcctccggcgaccggaagcttcgatcggttgcagaggatatgcgagtatatatatatttagccatgcacatattaagaagcaatagttcagagtgtgtagcacgtatggttgcatgtaaaaacttgattatatgtacgaatgatcagtgtttgatttggacttttggaggtttcgcgagttcgaattacaacgcaaaattttttctattcttgtaggcatcgaacgttttcattcatcacattcatgcgttaccagtgatgactacgattgatcaacatcgaaattcttggagatgaacgtacgataaatgattctcaagttcttgatatttctgcaacgattacagctggacgcacaactaaattgtcctaggtaatttggcgtcgtttggcgattaattattgaacctgctatcctaggccaacccaagctttgattagctgcattgacgttgacagcgagccgtagaaaaatatcaagcaaagacaaatatttcgctcttggtgtttggttcaagccttcaaggctacatggacacatggcttggactttgcgtgccggctacttgcgatttagaccaattctaggaataattaaggctcgtttgtcttaggaattagtaggaaattaggaatgtgcaggctgcagctgcttcactggcctgtctagccgtagccatcaccacaccagaagccagtttgcatcgccagcagaatgtgccagatacagctgcttaattacaagtttctctccccttaatattatcataatccagggacttaagcttgagttacacgtaatagatttgttacggatgaactatgtagactcaaagttagaaatgctaaaagggataaagataaacatcatactatcgaaggcacagtgcctgcatgcttgccttgctagtatagaaaagcttacgcacatatactccgatattttatacacagtgaattaccaaaacatgttacacctcaacactgcatcgtgcatcaaaacagagaacatatccaatccgaatcttaaagctcctaatatcatatatatat

SEQ ID NO: 74462 - DNA, 625 bp, Oryza sativa
ggcatatgcagctccgatcataaagccatacgtacgcacgacatttctcaaccgccgatagatgcagtgtcatatagctacatagccctggggcatgcacccccaggggcacccgaaaaaaaacccccagctggctctgtagtcccgcccggtgttcccatccgggactaaagatcgatctttactcccggttatttcacccgggactaaagatagcgatctttagtcccggattggtactcccggtttggaaaccgggactaaaggggggttacgaaccgggactacaaagggtttctccaccagtgctagtaagctagtaacacttgcatctatcgacggttgagaaatgtacgtgcgtacgtatggctttatgatcggagctacatatgcctaacgataaaccgtacaaaactttaaaaataaaaaagaaatgctttataaataaaacctctctactacaaaagaaagccaccttaaatcaattaaaaagttccaaaacttaaagtttggcaatgatcgatcatccctgggattacaatcgagctgcggatcatgcaaccacaagaaaatttacagcggatcagtgcaaccacaagcgaaactactatattcattctaaaat

SEQ ID NO: 74463 - DNA, 3072 bp, Oryza sativa
ttagtccaggtttataacaccaaccgggagtaaagttgggggcctgacaaggactaacaggtttagaaccgagactaaagatcatctttagtcccggttggtgccaaccgggactaaagatcaaatatgcccactgtagccaccaaccaggactaaagatcatctttagtcccggtttttagtggaatcgggactattgtggatttcggccgaccgaccaaagattggtttctccaccagtgattagaaatatagatttaaactgtttttgctgtctcttgtaagcatttggtataaaataatttagcaattttgaattaataagtacagaaataaacttggtttggagttaagctttttcatgatttaatgattcctatattcatagttattaaatatcaagttgtattccatgtggagtaaagtgaatgaaatcgattggagcgagagataattgaatgacccaatagagcgaatagatttcaagagtacatttaaaaaatgtgaagcggtagcaataattatacatgagttgaatatgatacactacgccagatcctcacacttctgacgggatacctatgacgggcaacggatttggtcactagtgaccattacctctgacgggtcagacgggataacgtcaccggtgagccatccggccgcggaccgtcacaggtatcccctcacctgtgacgggccgaaaggaaaacccgtcagaggtataccagtgacgagttttgcttccaacctgtcactggtatcccctcacctgtgacgggccgatacattagaagccgtcagaggtgatgggccgccacctgtgacggctttcatttctggcccgtcgcaggtgaggggataccagtgacgggccgttgaacagaagcccgtcaaaggtatgagcaatacctttcacgggctttttttatctaacccgtttgaggtgtgttgggtctataaatacccccaaactgccaactgctttccatcccgaccattgtactgttcacaaatcagttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagaaggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggacaaagcatggagagcaagaggcgcctgatgtcgcagctgaagaagtgttggatcaggatgtagagaacaccgccgcaactcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagaattttacagaactccttgagctgttaaaggatctgttgccagaggggaacaatttacctgaaacgacatatgaagcgaagcaagtattatgtccgttgggcccggaggtcagaagaattcatgcatgtccgaacgactgcattttgtattacaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgtgctggcatgccgaagaacggaaagtcgatactatgctgaggcacccagcagattcagtacagtggaggacaatgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcaaatgcacaacaacctccatgcgatgctgttttgtaccatcaacgataatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagaggtacacccggacccctgacagagctaacagggacagaggtgcacaacttagtgatgggaataaccaacgagtttggaaaaaagaggaaagttggaaagcgaaaagagaagagcacatcgaaggaaaaaacagaggagcatgttgaaaaacaaaagacaaaagagaggagcatgtggaaaaagaagtcaatattttggagactaccatactggaaagatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatctggcagggtttaccttcctccagcctgctacactctctcgaaagaagagaagattgatttgctaacatgtttg

SEQ ID NO: 74464 - DNA, 1769 bp, Oryza sativa
ccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatcagacaggagaacccaggccgatcagagagttgggtcaggaataagcacatgtcttctttcaacgagttggctgaagaaccgaattgccaggttgcagaacttgtctagtgaaacacttcagtggttgtcacagggtcctgaatggagtaccaccacttggcaaggatatgacataaatggatacacctttcacacggtaaagcaagacagcaaatgcacagtgcagaacagtgggttacgcatcgaggctgctagtgacggtggtcgtcgtgatcaatactatggtaaagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacagggatgaaccgttcgttctcgccaaacaagttgttcaagtgttctacatagttgacccgtgtaacaagaaactacatgttgttcgtgaagggaaaaagagaattgttggattggacaacattgcagacgaggatgattacaaccagcacgtccacggcataggtcaagaaatacctctagaagaggaggaagaagaagatgaagttcaatatgcacgtgtcaaccatgaggaaggattatttttgtaatttatgtacgtagtttatgtctacatgtctattatctgtatgactctaatatgttcgcaatgatcaatagtatattgcttatgaaatagtcaaataaaataaataagtgaagcacccactagaagtgaaataaaataattaagcaagtataagcattggaaataaaataattaaagtagtataataatgaagtgcaattactactgttagtgaaataaaataattaagtataaaaaaatatgtagtgtatgtgaaaatatgttaaggaaaataaaagaactaagtgaaataaaataaaataaaatttctctaagcaaactcacctgtgacgggctctatcagtagggccgtcacaggtgacctcacctgtgacggcccagagtgttgggcccgtcacaggtgggcttacctgtgatggctccacggttggcgcccgtcacaggtgaggccacctgtgacggccacatagttggcgcccgtcacaggtgagtttgactagggttgacctagggttggacatcttctagatcgatccagatccggcacccactctcactcactcactctctcgaccgccgcctcgcctctctctctctcgatccagatcatccaccctccttgccgccgcctcgacctttccaccgccctcctcgacgccgcctcgacctctccaccaccct

SEQ ID NO: 74465 - DNA, 2203 bp, Oryza sativa
tcaactcctgtaacttctttttgtcctccggaagtttaatctttttaattgcattaatactcctttgagttacctcaatccccctctcatgaacaaaaaatcccaaaaattggctagctgacacgccaaaagcacactttgttgggttcatcttcaagctatattttctagttctctcaaaaatcttcctcaaatcagctatgtgattttctatttcatttgacttaatgaccacatcatcaatataaacttcaaccaaccagctgatcagatcgtggaatatgtagttcatggccctctgatatgttgctccagcgctcttcaagccgaaagtcatcacaacccactcgaacaagccgattgcaccgagacacctgaaagcggtcttgtgaatgtcttcctctgccatgaaaatttgattataaccttcattaccatccataaaactgataatcttgtgccctgaagcagcataaactaattgatcagcaaccggcatttggtactcgttcttaggggtagccttattcaaactccgaaaatctatgcacaccctaagcttgccgttcttcttgatgactggcactatgtttgaaacccactcggcgtatcggcatggtctgataaagccagcatcgtataatctagttacctcagccttgatagcatcatacatatcggccttacatctccttggaggttgctagtgcggtttgaatcctggcttgataggtagccgatgttcaataatcgatcggcttagtcctggcatctcataatactcccaagcaaagcaatctctatattccttcaatagctctattaacttggctctgaactctgccgataaattcttactgataaatgttggccttggcctatcccctggaccaatatcaacttcttccaaatcatcagccgacatgaaaacttgtccttgcttgtcatcgagatcatctaccgtgtccttggtgtagacgtttgaaccctccacgacgcactcaaaataataatttggggtctccatcttcaattggctgtatatcacaatcgaacacttttagaaaatatccatcccaaacttttacagacaggcaatcaatcccatccatctcccaaagagttaaatcggcactagcaacattaactgacctgtcggctggtacgatctcaatcttgtcatcttgccattgaatcaagcactgatgcatggttgaaggaatacaacaattagcatgaatccaatcccttccaagcaacaggctgtaagaacctttcccatcgatgacaaaaaagattgcaggaacaatcatgctgccaactgttagttctacgttcagaactcctttggtctccgatggattgccaccaaagtctttgagaaccatgtttgttttgatgagatcatctgaatttctgcccaactttctgaatgtagcatctggcatcaaattcacagcagccccaccctcaaccattatcttggacatcggctttccattgacataaccattaatatacaaaggcttgagatgccgattctccgtcccttctggcttctcaaaaacttcctgttctggcgacaaaaccaatctagtagaggcttcctcaacttcatcaacattggcttgtttggcttcgtattccgtaggtaacagaaacaccatgtttaccgatgcagttacaacactttgtcctttggccaacctttttgctttgtcggcttcaacttcatcggccattgcaaccttgctcttaacgcgccattcttgcttaggcttcgctttcttcagccgatggttgatttcttgctccacttcctgaaacgctccctgttccccattcgttgaaccctccttttctgattcttcataaaaataccagaagggcaccattgtgttgctctatcttcatcctcactttgatagtattctcgattgaccgggcccaacctttgatgaacgggaaccctcttccgactcagccgattacctctgttgtatgaccggcttgaacttcctgtgtcattactacatccagggcaatcttcgatcgatggcagtctcatcccctcattccagtaaaacctgaaaaactcacaaccccaatgaggatcgaaaccatcaccttcttgctcgtagtacctctcctgctgcttatcatgcctcctttgatatttattgataatcttggtcgaattcaa

SEQ ID NO: 74466 - DNA, 2021 bp, Oryza sativa
ggtgctgctgtatagatgaattaaatgtgatttgttgtctgtggatgttttggatgaatgtaggggctagattttatatacttgattttggtgcagtgaatcttgaatgtggatttaagtgcaactgttgctgtctatgtttgcccttgctgtctatgtttgcccatgctgctgcctatggttgcaactgttagttaagtgcaacttgaatgtggatttaagtgtcatttggacatataaccattcatggagtgtgtactgctatatatgttgctagacctattgaattttgtggatcatgtttacatttagctgaaaaaggataggtcagtgtagtccatggacggaaccgacctagacaccaaagttctccatgcattttgttttctgtcattctttgatgatttatatacccttgctgctgctgcccaatgtgttccttattaaatggccagtgatgaattgctcaataagaacagattatctacacttgttcatttttttgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattgagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattgagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtacgaaatttataatctttttcgcgaaagttaaaccatgtcaacgcccggcgcaaacccgccctccccaacacctgcgaggatccaggaagaagcaaacccggccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccctggtcacaaaatatatggctgtcacgaccgaaaataacccaacgggcgttcctgacgtgcgtgcattaatccttgtcccaggaggcaaggtacaccaaaagttgatacaattcagagtttaacaagcggaagcgtaaatagttatacttattacatgggcagcgaaggcccggcacacaaagacaaacgagaaacagcggaagactatggcgactaccacatgctcttgacggcatgcacgagctagacaccaaagccttcatcttcaacgaacttctcttctggggttgggaaaaaatgaacaagactaagtacaaccaccgtacttaacaagacacaccccctagtgcagaaataaatgcatggagtacaaatgaatcatactgtaaaagggtagggtt

SEQ ID NO: 74467 - DNA, 674 bp, Oryza sativa
cgaacaagccctggatgaagaggaaattggagaagatgttgatcaagctgcagccgagctaagtgacctaggagaaaaaacaccatcggctccacctaaaaagacgcctccaactcctgcagctccaactcactttacaagggtaacttatcctgacaagctcttaaaaaatttccatatagccgatcattcattgaacttgtatttgtagaagaagaaaatcgcttcaaagaagacatcagcaaaagcatcatctaaaccagttccatcggtaagactccttctgaagaatcttttaaaatttaatcataaccgatgctaatttacatttgtctttttagcctactcctcctccttcaccccctgtgcagccgatgtcaagcggccgtactccaatggtcatgggcagccatcatattgaagaagaacaacaaccagccgctcctgctatcccagtaaatctttcttttttcaaaaaccccaaatcggctgtacaacatgcttcagtgttaacccttttccaactttcatctttataggtcttagccgatctattctcttttgacatcaaggactacttcgacgaggtggaagaagacaccaccagcagatccctagctcctctatatgaagatgttagaagaagtctcgaagacatttgtcatcgtctagag

SEQ ID NO: 74468 - DNA, 5679 bp, Oryza sativa
aattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcctcgtggaggttgaagccgacgtttgggaaagcgaacaaggcaagtcacatcatccttgaacagattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcgtatcacctggacaatatggaatggtttgattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttctacatgtctagtgggtaaggcttagtttgtggctcagtctggttataaacaaaagtacacggatggagatggaagaagtcaggggtcgatggacatctctaggacaaatgaaggctacacgagatgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtccgtataccgtggtggtatatggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaagaaggaatggttggcctgggttggcttgggacgagctgggacccagggtcgggttgccggttcggtctgaatcatcgtaggccttgggttaaggcaggttcgtgtgggttcacggccttgataaataatattgtatagttctagaatcgtgtttacaaaatagctttgagcaactaagtgtcttttaatgctgtttactgcaaccctaaccctttatattataactcccttgtactcccttgcatttattatgcacttgtgggtgtgtcttgttgagtacggtggttgtactcagtcttgctcaatttttcccaaacccagaagaggagtctccgaaagatgaagattttggtgtctagctcgtgcctgccgtcaagcgcctgtggtcgtcgccctagtcttccgctgtttctcgtttgtctttgtgtgtgctgggccttcgctgcccatgtaataaattaactttttacgcttccgcttgttgaactctgaactgtattaacttttggtgtaccttgcctcctgggacaaggaataatgcacgcacgtaaggaacgcccgttgggttatttccggtcgtgacaagttggtatcagagccaggttgaccctaggacgagccttagatcccaagccttagcaatattttcaaaactaaaaatcctgtcttaattgtgaaaaccctctagtctctctctgtcctgctgcttcatttatcgccaaaatctgacttttaaatgttgcttttctttttgtttttgtttgtagatggccggcagcatcagccgtcgtggtctggacctgattggtttcgtcttggagctgcggggcatgtgcgttgtcctggggtatccgcatggagtggactaccagggcaggccgctcccggagcaggagggtgacgatgcagagccccacgctgcttgggaggttactgcagtgatcctcactggctcacccgagaggacttcattggcagtcaccgcgggtggagattctttctccgccgcttgccagaatgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcaagaacaacatgaagatcctggagctgcgtcaggagaatctgcagctgaagaaggacctagacgcagtggaggcgcagctgcatcagctcaagatcgcctagggagaggtctgtcgccccaagcgtcgccgcgtctgccgcagccagaagatcaccgcccgcaagagcacctccaggcccaagcttgttcgtcagtccctggcgtggacttgcttcgttgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccggtgtgtggcataactgtgtcggagcctgtctttattttatttgcttaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctaacaccggtgatggcaaccaacctgaaggcagcaaccacaacaaccatggcagcccacctccacctcctcctccgcctccaccaccaccaccagacaccaacgccattctcacccaaatcctcgcccagcaggccaacatgatgactgctttcctccaccacctccaaaatccgccacaacataatgctccaccaccacccccacaacactctaaactcgccgagttcctccgcatccgcccacctaccttctctagctccaacaaccccgtggatgcgttggattggttgcatgccgtggggaaaaagctagacaccgtgcagtgcagcgatgaggagaaagtcatcttcgccgcccaccaactgcaggggcccgcatctctatggtgggaccatttccaggctacgcagccagaggggcagcctattacttgggcccgcttcaccgccgctttccggaggacccatgtgcccgccggagtcatggcccttaagaaaagggaatttcgagagttgaagcaaggcaaccgctccgtgatggagtatttgcatgagtttaacaacttggctcggtacgccccggaggatgttcgtgaagatgaggagaagcaagagaagttcttggcaggaatggaccctaagctgtccgtgcgtctagtctccggtgactatccggatttccaacgtctggtggacaagagcatccgcttggaagccaagcacaaggaactggagtctcacaagcgccgcttggcgaatttccgcaatcaacagggtgctaaccaaagggtccgctacaccaatctgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctaccttcaaatggatccagccacatgtccatatctgttctggagcggccgcaattgtcattttactcccgactattttttgtccatggtgctgcgtcacctcttttggcccaatgggctgtgtatccatgttggtcccattaggggcgcgtcctagggttggagcatgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttgtcctacttgttcttgcttgttcttcgattgcttgcaggacgagtgccctcgtggccgggttgacgcgcaccacaagttcgcggcgaccattggagacggtgtatcggttgctaaggcgcggcgtctttggacagttgtagtcgggccgtgaacgtcgacttcatctaatcgagttatcccttacctctcatcgaaagatcgggccacaaaccctagcgggttcacatcaggtggtatcagagcgtggttcatcggtgagagaatttacccttccctccgtcattaatttttttttcctatagtccagaaaagaccaacaaaaaaaatagtagattagtttttccatgatcctatagaccattgtgccttttcactagtactgcttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccgtcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctacaaaaaaagttacatccgattctcccccgcttcgccgggttcggcaaatttagaatcgccaaattcctcttgcaaaattctgtttttgtggcgagaagcttcgggacctattcgcatagaactttaaaaaaattctacaagcttcatactttgtccgtttgagataagattttctgtggttggttctagtgtgctcctggttgtgaaaaaaaaaatatcaaaaaaaaaaagttgtgcctctctcctcagcactagaaagagcaagcaaaaaaaaaaaaaaaaaaaaaaaaaggatccagcgagcacaccacaccattccccctttgtcaccaccttctaccaccggttcttgttttcgttgctgtttgggtttgtgttttgtggcgtcctttgtggttaggct

SEQ ID NO: 74469 - DNA, 22536 bp, Oryza sativa
  unsure (1)..(22536): unsure at all n locations
cacgccgagcagtgtcccgcccctctcccggatccgctcccctccgcccaccgattcttcctctgcaccatcaccgccgtcgacctctccgccgacaccaccaccggcgagccctacgccaccatctccctcctccctcttcgccacgacgcccccgcccccgcccccgcccccgcccccgccgccgccgaattagcagaagcagaatcacaggagttccgctactacgccaagcagctgacgcagagcgacgccaacaacggcggcggcttctccgtgccaaggttgtgcgccgatcacatcttcccggcgctcaacctggatgatgacccgcccgtccagagcctcaccatgggggacctgcagggcgactcgtgggaattccgccacatctaccgcggcacgccgcgccggcacctgctgacgaccgggtggagcaagttcgtgaacgccaagcagctggtggccggggacacggtggtgttcatgtggtgcggggccccggcccccgagaggaagctgttggtcggggtgcgacgcgcggccaggtactcgggcgagtcggcgtgcaacgcgcgggggcgggtgcagccccaggaggtgatggaggcggtccgactggcggcggagcaggcggcgttcagggtgacctactacccgcggcatggggcgggggagttcgtggtgccgcgggtggaggtggataagggattgactactccgtggaggtgcgggatgcaggtgcgcgcccaggtgatggaggccgaggacacccgccgcctcgcttggctcaatggcaccctcactaacctccgccaccaacaaatctggcgcactctcgaggtacctacctcttcatcgtcccgtcccgtccctcgttaatattaatataatcaccatccccgatcgaggattgcatgcgtctcatgattgcccaatgtcactctctatgttactccctccatcccatagtataaacacttttaaattttgacacagtctccgatatgctattttgatcaataatatctataaaagtaaaatattttaaataaaatgagttgcatattatgataatttggttaatgataaatctagtaatatcgattttatatgattgatcttttttatttttatgctattaatggtcaaagaaaaacattttgacttatcactatgctaaaaatgcttatattttaagacgcaagaagtatgtatgtactccttccgttctaaaaaacaaaagcaaattagtactgtatgtaacacattttagtacactgaatctgaatagagatatatccagatttatagtattagaacgtatcacatccggtactagatttgttttttacatgacggggcagtagttatgtttgatgatagtgatgcttatgcctcgtcacctttgtccccgtccttacaccatgtttttgtagatgagtgttcatttcagcaagcttaattgttatcttcttataatggatattgctttgctcttgttcgtggctatcgcagctgatcatcttcaatttctgcttgtatctctacagttacatattgcattgcgcatcgcatatatagccgatctgacattactgctcgatcggtgcttgtgtgcaggttgaatgggatgcctccgccgcgtcatcttccatgaaaaacagatttgttaatccttggcaggtccagcctgttgatttccctcctcttcccatggggctaaagatttctaacaacaatattagtgcacctgtgtgcaatggggattcactgctggtgccaccgatactaatgcacccgcaacctcaacctcccgctgacattcagggagccaggcataacaatggccatgcctatgcagatataccctcttcatcaacaccatcaatggtgaggactcagcagctgttcccaagggatcttcagattttagttccccacaccgacattgtcactcctcaaaatggatcaccgcccgacaaccccgtaaacacgcctctttctgcatctgacggaatgaagaccatacagctgtttggcgtcacaataacatcacctgtgcaaggagacaccaatggcgctttcgcttcagcacaagtgaatcaggttccagagggtgtagatgatgaaactgctaccgaagaagcttctgacacaagcctacctgactctcttaccaatggccacaatcaagatggtgctaggctttgaaggaatatcccattaaacgtttccaagatgtactagtactttcttattgatattcatgcatttacttgcaattaatggaaaaaaaattcagaaatgcacttactaatcggtctctagttctcaatgccatatatactcaattatactatatgtatagttgtaaaagtactttcttattgatattcatgcatttacttgcaattaatggaaaaagaaattcagaaatgcacgtactaaccggtctctagttctcaatgccatatatactcaattatactatatgtatagttgtaaaagtactttcttattgatattcatgcatttacctgcaattaatggaaaaaattcagaaatgcacttactaaccggtctctagttctcaatgccatatatactcaattatactatatgtatagttgtctggttaccctttgttctctgcaattcgtgctgctcattatttgtcgatgaacaaaagccatattcaatagagtctcctgctctccttcattttttcctgactggattgtcattttctacatcaaccgatttagaagtaactatgttttttttgcagagatacgatgtacttcctccgtttcacaatataagtcattctagcatttcccacatttaaatatgaatgtggaaaatcctagaatgacttacattgtaaaacagagggagtaatatatttttatcagccacctgtttactgactgtttgtttactgttttctacagatggctggaccagatttgtttctaacattttggtctgttctgtttcaccctccggcagtttgacgggatgtggtgttcttatgcatgcatttaatctggagtttaggctggcaactatgccgcatggtccagttaagtttggagtaatctggagaaacgttcatttctttgttagaattgttatagagcagcactgctctgttttattttccttgaattttcacacctgcactttgtttgcttgttgtttgtttacctgtattgatctgataaacatctttaatttcctggggaaccgttgaactctgctttgctgttgcggctagcttttccaattggtatggcataaggatttggcacttccaagtgacatggtgatgattttactagtagtaacaatttgtattgtttacttgtgattgatcgatggagtggatgatgctggtaaggaatatatattggtgtggtatactaggatatacccttttgcaggagaaggggatttcagccagcctgagattgagagacgacgtgttcaaacgattgagcagtctatccttgttggaaatgaagacattgcaactcaccacccacctcaactcgccaccaaagctgaaagagatgctacaatcaatagcaacagtatgtttctgtcaaggtgatcaagtgcagattgattgatttttcagctacactagtctaccatcatgcacggtactccagctctgtgttcccaattcccttctttttgtccaagataggctgtatgcatcttttctttacattcatgattcatcaaaaggcagtcaaaatggtcctttttaatctccttttgccttggaaggatgaaactttacatcttgtgactttaattccttgttaaaagtcctggaccgcagcttgtatttgagtaggtagacaggtagtactagtagtagtagtattttctgagctactgcgagaggaagtaggaaaaagtagataccaagcaaaagcttgagacttggtactatgggacatatcaagcgtgcacatgtgtgtctgtctgtccctgtatctaaaccttctctatggaccatatggatggagtattacttcaaccactggtcaagctaagctagcaaaacgaaatcatgtaatcgttatagttgccaatacactgtccttgctgccagctgccttataacaagcttcagagtaggagccaggctaggcaattcagagtaacagtccatgactccaacagatatttcctcaaacaaaaaaaaaaggttttacaagtacatgaatgaacattcttctgatagataattttttccccagaaaaataggaggcccttaaaagcagttttacacaagtacatgaatgaacattcagatatttacacacaagctccaagtcatttttttccatcttggccaaagttcaagatcgatgagcagaaacctcgtcattcccagttgcaagttaaaaaaacaagaagaagatggatgagacggatagatggatcgatgtctctgcattacattacagaaaacacaatgctgcatgcagctgctttccttgtttgtctgctagctgtgattcattcgtcagtccatatacatgtacctccaatccgatcctccgtggatatcatatcatatactactacggagtactaggtagtaatatgcatgtagttacagtaaacaaatgaagagtattactatattcagagcaatccgacgagattaagagtacgtgaagagagtgagggaggtaagaagctactcctagctgagaggcatggcgggtgggcgcctggtgatggtgagggtccggatccagctcctccccctccccctccccctcaccgtcgtccccttggacgacgaccgctccgccgtcttcttgccgtcgatccccagctggtggcacgccgccgccttgccgttgccggacctcttccaccgcgccagctgcagcagccgccccaccacctgcttccgccaccgggttacgccgccccgcttcacgtgctccaccaccgccgtggtcgtcgtatctgtctttttctcgccggcggcggccttctggctgtcccacgtagccttgccgttgtcctcgaacttgatggagatgaaggaatctgttggttttaattaaattggcagcagcaatagtagagtacgtacaagaacacaattagcttgcttgcgagcgacagagaattgaaggcgaggcgaggtgaggtgtaccatcgaggctagcgatggaggcggtgtcggcgtcggagttggcgtcggagtcgtggggggcggggcgaaggtggtggcgagaggagtcgaggcgctggaggaaggaggagccgagcgcgaacaccttggggagagagatgctgctgttcttgcggtggagcggtcggtcggcgaggaggtgggcagcggcaggcgaggtcttggaggcgaggaggaggaggaggcgctcccggaggcattgcgagcacacgcccaccacctcctcccgcgggtggaagtagcacatgcatggcctctcgcctcctcctcctgctactccatccttcatggctcacttcttcttcttcttcttcttctcctccttgagttgagttgatatatactctagatagcaagctgctaggtcggtatctggagttgcacataagctgatgagcgtatatagattaggagaggaggtagctacttgagtttcttgctttgtgcacaattgtgttgttcttgcttggataaagatactagtagcactcaagagcccaagaggagaggacataccatgcaggcatgcatcatattcagactttcagacagttatgaaaaggaaaagagagagagagagagtagaggggattggtactgtttggaggagctagctaggcagatggattaattattgagagtggcctgattgcacgtagctaggcgcgtgtaatgttattgagttaggaggagcaaggacacggcgcgtgtgtggccatgcatgggtaggctgcctcctgcctaattagctagctagctttgtggttgaagcctttatgatcgatcactcaatccatcgatatattactccgtatttgactatatatgttcgcattgaaggattgaattggatctgcctgcatcctcatcgatttatctctggcagtgatcagtcaggtatatttgcactcaagcatggagatccatgcatgtttgctcatcgttcatagctcgctatcgatctcaagcttaattggaccatcatatatactactatcatgttgcagtagcatcgtatattcgtatcaatataatctccaacaataatgaccatcaattaatataatctcaacaataataatgatcgatcaatatgtggggggtaattgctctactaacaattggcacactcactgatcacctagctacctagtaggtatgtacgtgtacggtttacatattgcgtgcagtgaaggaaaccatccatccagctagctagtgtacgccgtgagtgagtaagcttttttttgccgtacttttttttcaagcttaccaaaggtaaggttatcaatgcaaattcctagccatatttttactatatgacacacaaagtcatggccaacaaaattaagccatgtcacatttttcatagtcactgatatgtgggtcttagattatagaagatgaatcttgctacatatatttgtagtagccaaccaaacattaacttagttagcataatcaaatttgcttaaccacaaatgttcatcgaccaaacaacctctaactacatggttagtatatataagtatacacaggctaagctagccaccttaattatcatctgtgtgctgtttaaagggtgtgtatgtgtatggacagaagaaaactattaattaatgatttaatcgatctgcagtttgctggactgctggcttgtcaacggatcagatatacattaatagtatattagcatacaggatgggcaactgcatttcgttactgtttgaacttatgacaatgagttgatcggatggatgaatgattgatcgaactatagggtcggacgtgatggagctggtcgatcattcatactactagtagttagcttggggtacgtggtccaatttcgatggagaaaaaccaaggaccacttagctactacctccgtcacattataaatccaactttgaccgtccatcttatttcaattttttttaaaaaaattaaaaacataagtcacgagtaaagtactattcatgttttatcatctcataacaacgaaaatactaattataaaaaagtttcaaataagacgaacgatcaaagttggacgcgaaaacttatggttgcacttataatgggacggagggagtagttattagaagatactaatacaatacaaaagggaattatctaattcgatcgatcattttccgttttaagtggtgtttacgtagagcagtattaagcgagtgaaagaaggaaggaatgggcagatgcccccacgtacgtctgaatgaatgaatgaatgaatgaaaggcccaaattattagggaaggagaggcctaattaatctaaatcgatggagggtggtcggcaaatgaagcaaggacgatgggaagagaaggaaaaggcgaatgagttgaatctagctaggaatgcttacttatatcggtgcatgcacgcatgtttattggagagaaaagaaaaaggaaagaaagaaaaaaaagaaagagaagtttctctgctacttggtaggaagaaaaacgagatctatatgaatgtgtgagagagggagaaagggagagagatgcacatgggctgtgggccattccttgttgtaccaatatgtacagtgccatacctgcacgcctgtccctccagttaatctgcctgatttaatctctccaccttctcctcagatcaattctgaccaggtaaaacaatcagtttctgctctagcacaatgcagcggtaaaatacaaggaaattgaccgttaataaatctgctctctacttgtacctgcatacatataccacagcacaacacaagtaccagctgcaagcgtgtccttcaattccatggggccttgttgccatgtccacatgcatggtcaaacacccaacaaatgccaccgtccaatttcgccttttctttattaaaaatgatatatgcatgacacttttatccaactctaatgtacaaccagagagataataaacatcttacacagtagatggctcatgccatgataaatcctagcgtgcacttaccaacgctactcacgctgcaacacggtcggacaacagtagaacaaaaatgtcgtactatcagccctcttttctttatttatttatcccaaacaaggaaagaacttttcgtctttgcacctcctgtatgtatgaaaattagaaaaaaaaaaggtaaactgcacgctccagatcataagtttcggaaaagaaaagaaatctcttcatgcatctttccatccctgggttggatgctggactgtacaagcggagatgtgtaggtagctatcacctccatcaaacactcaaacaggacagtgagcatgaatgcacgaacacacgcacccaccgtaacgccaccggcatgcgaccaaacccagcccaatgcttgtcttggagttgttaagacagccgatggatcttctccttggacaattgtagggtcaaacaaaccatctcgacacacaaacacacacctatccatcgacaaatatactaccactatacccagcacacgcacggcacaataatcaggtcaaagatactactggtaccatctgtccatcatcatctcctacacaaccttcctcgtgaaaccctgtaccccaaccccatacacatcgtcatcatgctcatacccagtcggtgcgccagcggtatcacacaacaaaacaacaattgacacggtatatacatactacattacaaacatacttgctgttttatgttcatgtttcctttcagagatccttgaatgatgtatgcagtgcagcaggagaatatgccgttgatgtgcatttgtcattaccatccaaatagcatccatccaaatatccaattgcgttgtaccaaagcaccgcattgtgtgcactctgaatttagacgctgttgcaatcaacagctccatctctcttgttaggtcggcggcgcggaatcaagtgactgttgctagattccgtgcagccagccatgaaccatctctgcctgatgagctgcacggtgacacagagcttcactgtccttttgcgcttcacaaagcaaaagcaggagcacaaaggcagcagagaattttgttagacgaacatgattcatattgttcgcagtaaaattagagctacccagctactaacacatcgctagaccagcatggaatttgtgacctctggggatcaaaatttgttactacttactacaccacaacatacaaacaagcaaatgaccgatcaaccaacttcagcatgccagcttcccatggttcaggatatcagtaagctcaagcgtaggagctgagaacacgaacatcatggttcacaaagatttcccaagctcagaggatggcagtcccacaatacaagatgattacctctgggaaataaaaagggagttagtgaactggtaattatgggtaacatatagcaaaaagaacagctgaaggactcttaacaattattgcaaagtacaactaaaaattctcatgtttcttcaccatttcagtccaaaattaggttcagtcaatgaagcagggtactgagaaagtatgttgcattacattacaaaaagtggagtacacagaaaagcatgactgatgattaatgaactactcaccgtgtatgcaaaaaatctagatcaatgaactagagaactcaaccgttgtggtgtgtaaatcatctacaagcatgcaagtagtataaaaaggtacagacaaagaagaaaaggtagtaagcatgtctagtcaacatctttcatttctatatggaactggggagatgattaatacaaaaacatagtattcatcaccagagcacatcagtcatagtcaacaggaattagtgcaactgcaaaccagaccaattacaactaatgacaaacattgtcagcatttttaatgaccatcctgggcctgtatatcatgtatttgtgtggccatgcagagacacgctgactgaaaattgaacaaattccaggccttccaggcttctcgctaaagcaggtgctatagtaaaactgattgcaatttcatgcatgtttcttcagcattccactatcacatcagatggtcaggaggctggatacatccatcattatctattttcaattaatttcaaactcaatgtgatgaagtaatgtctgatatgtttgttattagtgcaagtgcctaaaacatcagtgttggtgttttagtcatcaaaatataacacatagcacgaatgtctaagctgtaggaagaaaacagtgtggggaatctatacccaagtatctcagatcaaacacccatgatacaaaagaagttcaagtagatctatgaagtcatatactcatatgttgaagttccaagaaatcaaggaaacatatctaaataggtgaaaggtggaacccaaaacgtaggatgagccacgtaagcaacaaaaatgtggctgtctgattcagtaaacaacaaagtagggagagaccgagagagcattgtaaccatcggatcagatggatggtaaaaaatatatagagagaaaaaacagtggtgtaaagaagcaactagagcccttgagaataaaaacgatagccatccaccgcctgtgactcttggtaccttttcattttagcccctattaatatctcttatcatgcactccactaaatagtacaaatatttgtgaaaatacccctacatcgtactcatatttttaagtcaaggatcttgcaagttttgattttaaaccattgtgcatgctaaattctaactagaaattacggcatgagcatggatttgctgtgacatagacatactaaactaactaaactcttttgttataattttactatgttatgggtataataaattctatagttttcttagaataaggacataataaattctatatatagggatggcaatggggacctgaaccccgatatccaacggggaaaaactccattaggggtgtaaacgggatgttatcggccaaaattttcatccgtcgggtaggccgggggcggggatgctccacaggcccccggccctgaatccccatgggggtgcacatccctctacagtcgcagcccacaatagaaaaataaaggctcaaggcccaatttggtggactgtatatataaagcaatgaaaccctctctcagatccaatcagcagcgggaggccgccaggctccgtaagaccgcggccatgctcagccgtcgcgcctcctggccgagcagccgtcgccacagccaaaagcagcacacgcgggtcgccgtcaccactaccatgcaggcgtgcagcagccgccaccgccgctgcatggtgtcttcatctccttctagtctttcatgctctgccattgatgaagtctttccagctggcgacacaggcaagatgaaacggcaagatgcggaatcagcggccaagcgttgcgaacatgctacttgtttttttaaaaatttcttcttttgtatttcttgatttattttgttcttgtgatgattatttgtgcgaatgaatcgattacttcctattgatacgttcatatgtatgtgtgccattcttcctaaatctgtccttccaattgattcattttttctctaccctctgttccttcctgtttcaatttgttgagcagtggcctttgcgtttttccaggtgtgttgccccgtgggcccctgaaaccccggtgcagaatggagacggtagcaatacatcacccgacgccggggacggggacggggagcgggagatttcagtatgtccgggggtggggacggggtaccacaacccgacaggggcagccccgttgccatccctatctatatatgaagagcatctctctaagacttgccaacaaaaataaaatgaggatggtttcatagtgatatgctttgctataggtttaattaaaaattaaaagttcaaacttgtcatttcaaaaggtataattttcttaattcttgcataaattttacataagattaaacaaattccttgagagcctgcaaaattatgtgcataggctgtaaagcgggtgtgctaatggaaaataagggaagaataagggggtcatgcagaggtggtggaaacaccaggaagatggcgactcatgcagtggcgaagatggcaacaaataataaacggcaaagagaagatgaatggaaactctaaccctagctgttgcactcaccattttgtagccgaaagatgggatgtgcattttagattacaaacctatttacaacattactacatattacagatttagaaaatcattaaagagggaggtaatagtcgcagcagtaatgtatggtaaattttggtaaaaaaatctatggtaaattatttgttgttgtgataatatttttacttacaaatcaagataaatctgttaatgttatatctaacttcctgccaaagtatgttccacaaacacttatttacactgttagttgttattaccattttaaactaattactataaacaaacatataaacacttttaaaagggaggttatagttgcatgaacgcggaagtcaataggctagttatgagatgaaaacaacatgtttatggaagaaggagagcatacctaacagtatttcatcaaaaagcaacatacaacatgccatcaactcatcatcgctgggatttcctgaaatgtggaaagtgtcattataatatcttaagtggcaagggaaatcataaagagatatgcatatttatgtatgcaacagaaaatgcaatatcagcaagaacaaaaatattatgccccccccctccctctctctcatgtcaagtgaacccctaattcgttttaccatcagcaagaaaaataatcgacggaattaacaatgactcaatgagtaccagctaaacagccatctcacctgtgcaacagtagcgccccttctagtccacctatttccatggttgagggtaactgatgaagcagcagcagcagctgggacgttagtctgaggatggtcaggaatactcgaagtttgttgcccttgagaacagatatgttctggtagaacattttcagtaagtttatgtaaggtgtcacttctgtatagcgaacatgttcaagtgcaaaggattttcctcacccccttgaggttgtgacaaaaagaatctaaaaaagcttacttggattctgaaaactctatggtatcagactgctcttcataatcatcttccagattgattacaggaatcatttggccaatgctctgaccgtgaagcgtagcttgtccatctgcagcctggtctagaagcatctggtcttcctgtaactgagcactatctgcagcctgtttaccagcgccattgtttagaagcatttgttcactgttctggtcatgattatccaaatcatgcacacccataacatgattcaaaagcatttgctcattctttattgggcgatcatcgcctgaatgttcatcagcatcatgattgagctgcacctgttctccattcatattataattttccaacacttgtacagaggtactctgcccctgattcagaagcatttcttcagtttccaccaggtgtccatgatccgtgtgctcatctgcacaccgctttagaagcatttcctcaccgttcataaggccgttatctaaagtatgcacatccatgacatgatttatatgcatctggtcatcctccaactggtgattatcctgtccatgttcatcacctgtctgatttccaaccccttgttcattgttaaaatcatccgtaccatttctttgatttagaggcacttgttcatcctccgactggtggttgtcaaatgcatgttcatcttgaccttgagttcctgaagtgacgcagtttgctccttggctcatctgaccaacttgatcaggaacagagtcacgaccattatctaaaggcgaatcattggaaatctcaaccatttcacagttttcttgagattccacaacattgaggtcaaaaatcccataccaagctggcaggtcttgttcatctttggtaaggtctgcgttatcagtttcaacttcactctgcggagcctccattccatctctgacttcctcggccactggttctaccaagcatgaatccctgggagagatcggaccctccatgccctcctcagcatcgctgaactgggactgcctatgcagtggttcctcatcagactgtgatggatgaacaacatcctcgttggaattggacagcttgtgttgggtaacatttatttcagcaacgcttggataattgaaggcagcaacagcatcgtcaccatcgtcatcgtcatccccatatatatcttgagcttgatcgacctctatgatctctgactccacctctgctgtgtcttcattggctgcagcttggctggcactctcttttgtctccataacaaccactgaacggggaggtgccttgagatctcttggcacatcatcagcatcaccgtatcccacatcagcatcaccgtcacggacaatgccaggctctggcaccttggaatgatccaaatcggcgccggatgctcgccaatctgaatccctccggctgccatagttatagctccttgtcctggttctgctcctgctcctgcttctgcttctgctcctgcttctgctcctgctcctccgtcttcgatccagcctgctatcactggagacacggcggtcgttttgtgaataggagcgtgacatggttggtctcctttggtcgtcgtagtcgtggctccggcgggcactccgatcggctgaggcggcatcattgtacttgcgcctgctgtcaaagctgttgctcctcctgtcccagccggatctacgggatagcctgtcatcgtcccctctgtcgcgggggaagtcggcattccggcgggacctggggtcgtcgacgtcatggttcctggcagcagggagggggtcctccctggcgcggagacggtgctcggggatgacgccctgggcgacgaggtagcgggcggcgaggcggccggcctcgagaaggacgtcagcgcgggagcggcggtcggcggcggcggtgagtagggcgtcgggtgggggtgggagatggacatggagagggaggctgtcctcgtggtggtggcggcgggggcggtcgggggtgcgtctgtctctgtgcgggttggggttggaggggggagcgcggtggtggcggcgcggggagggcgatcgtcggcggtatcgtcctcccgaggaggccgggggcgggtcgcggccgcgaatgcgagacctcgactgcatctgcatctgcatctgcaattttctcccttaccaccctaccctaggaggaggaggagaccggagtccaagcttgaatggtagcagcagcaatgtgttcccgttccgtggagttaaatccggcgtttgtctccttcttcagttcctccgttatactccctatgtctcgtcccagctgcccagatcttcgcgcggtcggtcggcgcgttcgttcggtggcggcggcggcggtggaagacgatggttgagagaggcgaggcgaggcgagggtttgcttttggtctctctctgtgtgtttgtgtgtgtaagtagagagagagagctccctccggctccctagataaagcacagcaccgcaccgctcaactccagtagtccactggagggagtggagtacttccctaattaatctctctccccgatttcttctcctctctctggagtctggactggaggagtccttgctaatccaattgttactcctgctaatctgaattactactgtcatagtaactgctatgctattctgaatccctctgccgtttttttttttacggttttaccactccctaggcagttgagtagatctgcccactcagtgctaatgaattatgactgggattaactaggctgcgtctcctgctttgcttcttttattatcactataatatactacactactactgttcctctgtatgtattactactatacaactactaataatactgccctttctttaacaatcgtgatgtggaccaggaccaagaaaggtttaggttaggttaacctgtactagacacccctatttgtgactgatagagactgcaaatctcgaatgtttctttgtagttcgattgcagatgttcttctgtgctcaagactctaagactgcactccaaggtttcaatgtttgcatggttttgttacaattctcgtcatcttaacaacgctactactcttctgaatgcctttgctcccccagcctctcactcctcacctgtatctgtatctgtatgtacgtactcctatgtgtagtcgctgattgagtataacaacacacgatgggcatgatggaatgatgccatcgcatcatataacagcacaaattcacgctacatatactaatttacatcttgtcaagaacctgctttgttgctgggctgcaatctttacaaggcccaaacacacataaaagtgaaccgaatcatgcccaattgacccaatctttgttgacacctcctgggggctttcgtcaactcaacaacaaaaaggtctcaacctccaaaaaagggaaaagatggacatcaatcacacaagttcgaatctgaataggcactccgaacgcaagtcctagattgaagctgagacttgccagccagccattttattcctccttgaatggaaaagatgaaggcaataatgatgtgatgtagtacagcaaagggttcactttggaaacatgagttgctgtacagcaaaggattcctagttttagaaactctgaaagtgaatcactctgtactgtacaccctttcttctgctggcctcagcttgtgtacctaaaatgttctccaaggtagatgtgcacattccaaaaacataagttgctaactgccactagcaacatttatgggatgattgtctagacttcaatgcaatagcttcaatggctactactttttctaactataactgtaataataaaccaaagggtaaagcctcatacatcatcaaaagattagacacaagtactcaattccctccaaaattttagcataatatacttcaccaaacatgaccaacataggcttatcatgaattcatgatactacatcaatgcttatatgcagagagaatgcaagcatagaagatacagcaagaaattaagatgccaataaacagatataacgtgcccaatcccgatatgagcttccatggttggttggcaaacaaaagtaccaaaaagaacatgagaatatacccgtactcctactaaactgttaccaaagtcaagaattgaactgttacactcgtcttgttcctcaggtctagcctggtcctgcacaaaagacatacagcatataatgattgatatttaactcgttcaattgatcgaccaaaacatggcaatggctctcgaatcaaacaaataaaacagaggaaataaaaggggtactgtggatatgtcttatactttcctaacaatctcttactatattggaatcacagctaatttctttggaaacacttaccgttggtaataaaagagggaagcatactttgtcaaggaaaaccgggaaaatacacccccatgtactacaaacttttaccattttcacacctattttggacattttaaagagaaacaaccattgtttctcaaatgattttcagaatgagataaacactgcataataataacctttcatttcaaataaaagagacaaaaaatgatgagattgtcctttgttatgttatactcttaagtcaaaatgagaagttcactatagagaaacagcttataacttataagtaaagtgatttatcaacaaacctctagcagacccaggtgcaccttcacgttggctcatatggggcgcgagcatctccatcacagctctcatagcgtctgcagcctgctctggtcctgccaagtttatttggatgccagcatccctgtgcatgcctggttggccatgctccccttcatgtccacttgaagtttgttgtgggcgatttccttcagtagagcccgtgaacgaaaaaggaggagggactgcagtattggttggaaaagaaggaggtggggtatggttacttgaagtctctgtctgaggtgttccttgactgttcccattgacatttgcatgattaaaaatgtcattcaaatttatatttatggaatgctcagatgattgttgactgatatcagacacacggttgatgatattggcgaagaactcaggagttggagaatttccaggaggaaaaaacgtgaatggaacaccactgcttgattgaccaggaaactgtccatgtgatgcttgactttggggtgcgtatgtattctatacacaacaaaactgatcagttggtaattttgaaaggacaaagaaatcccccaaaagaatgaatttcatgtaatcaaacaatatcagcattctatacctataaccgaagttccaattaggagttttaaatgcacaaattagtttctaaaaagaaaacaatggactgtatgtttgccagaggtaggacatatctcaaagtccagtaaaaagcacacgtggtttccagttacagtacctgttcttctggtggacctcgctgttcagccagcttctttttggtaacctaaagttcaggcatagagcagggataaaaattccatcagccattagcgagagtagcatgaaacaagctttatccagttaatgaaaataagagcataaaaacaatacctcgatattctgccagacattttcattactaggatcaagctcggaggctgcaagaagaaaaacaagttcattatgcacccacgcgttactttactggatatactaaatgcaaaatgtagattcatgccagaatggcaaccagaacaagttggcatccagaacaagttaatttgatctagaaaaatgaggaatataataatcagtagacattagaagcaatgaaggttgaaagtatgtgtttgatgtgaatcagagtctacacagtgctgaaagcatgtggcatggattgcgctgcactagcgaccttgaccacaaaggcaattaattacataaagatctcttaaaaggatacaccagaagaaactgaagggtagatatgtaaggttgtatgtaaaaaaatcaacttttcagaccacaattcaaataagcagcagctttcccagaaaaaaaaatgtaacagatgtaaaaacagtgtatagcagaatgtatcacaggttcagcaaaactaactgagacttatggattgcctacctttcaaatatcccttgtacaaagcatcgtggtattttcccaaagcaaaataagcagatccaagtcggctgtatgctttactgtagttagggtcaatttcaattgacttcaggcaatcctcaacagcttcattgaacatattaagaagggtatatgcagcagccctggaagtaacatgtacttttcaatttttcatgttacattggatcaaagcaatgtatgaagcagataaatgctcttgtgagaaacaagtgcatagttgtaaggcagtaaggattgttaacaccgctaccataacaagagtaaaagacgttaggttaacaagagtaagaacttgacaattatatatcaactttcccccaaaaaaaagggcccatgggccatggcacgtacgatttgtaaccagctgcagctggcttccactgttttaagatgtttgtaccggtgggaagaataataacagatcctgagattactaaccacatcatagcttatagcggattttggggtaacatagtattttatatctgtacttactggttctggcattctagactggattcactattagccactaagccatctcaagatcccatgttacatagaactactcaggaaaacggttgaaataacccaagttttgtttagttccattaattctgacccttatccctaagagttactcagttatgctgaaagagacaacaactgcacagtgcatcctacatattcaccaaaaaggtcatcataaatgtcattaatttgtgcatacctgttacaatagtaaatagcattatttcggctcaacgcaatagcacaggtgtacagttctacagctttaagatgttgttttgacctcatggattcattacctgataaacagacatgcagttagctacagaaggcttgaactgcaaaataattagctctttttacattgataaatgaaaaaaaatgaagatttttcaagtaagaatttttagttaaagttaaaaaaaacaggaaggtgtaaagtggttcactacccaatgaacaaattatgctatgctaaagaaaatgcacaagtgaaaagacaaagggttgtggataaataccttttgacttgaagaattctgcaaggtctcctaagcttgcccttttccttcctgacttccgcatcccctaaacagaggtgcattgtacctcatatcataattaaaaaaacactagactataagcgaaacaagaaaaaagtagcatgcagtccaacagtcgccgatctcttcgtccaagtagtgccactacccaagttgccctagtcatttaagagaatctccatgaaacaggggacagtcctagataacaagggaggcatctgggataacttttccttggtaacagggtgtagggacaatacaatcatgatccattattgtgctttaaaagagcgcgagttagacaagtaaatatcacatattataccagcaatgcatcatcgaagaattgtgttgcttttgaaagctggccaggatcttcagctccagcagatgatgttttaaagaaattgatttcatcaagcgaggtatagaattttgcaaacagttcatctcctgaatgatctgatcaaatagcaaaatcaagttgcatgagtaaacactgatttcaagtgaatgatttttcctacatttgttattactcagtaggaaataacaccatttacaaaaacaagcttaatatttccagcattatctggacatctgatcatagagacaaccaacagtttatgctatagtcatacctaagtcgaaggtatcttcattttggccttcactctggtaaggagaggcagaagtcagtatgagaagctaatatttcttattaaggttgttaaaggatataacaaaacatggtgaacaagacttgatgtatgagattactaggatgtaaaattataggcataatgtaattccaaacgtatgcatgatgttatgtcaatatgtttgtctttatatatatatatataaatggcatggaataagacggatggcggtgattaagcgtgtgacaatgtgtgtgtgtggtgattgaaagaagaagaagagggaaaataaagggnaaaccccaaatttaaccccaatttttttnttggaaattttggnttttgggttacccccaattttttnttaaaggtttnnccaagnggttcctnnttnccctttnggngggaatttaaggntntngnanangttgnccttcngnccanctgcccaagaaggttttgttggataccgggccgggtgcagagttatcttgttgagcagcttccatagagctaaagagttcaagtagaagtcctggatgtaccctttcaacaacagatgaagagttgatactgaaaatggattccagacattccctggcaacctcaagagcttcaggatcagccccaggagctaactcaactgcatagcaaacagaattccaatgtcaggagaaccaatggctttgcaacactgcacatctttgattccaaaaaaggggagctaagctggtaattaattttgtctctactgtgcttttttttttggtgtgggagggaaatcttgcatattgtgctgctttagatttggatggtgattatcgaaaatattatagcctactactgtagctaactagttagtaattagcaaattcaatggtgcttcgcatcgatgtgcgaaatggctccatctagagatagaagaaaaagggcaagtagtaatccgcaacctatacacgcgactccaataaagcggaaatgggatttagggcaggcgtatgggatgggatggaaccctagtagtagtagagtcttctcgaagcataatgatccgaagcgaagcatgttggtgggcggttgcaagggaagtagtccgattgggttgatcgatccgcagcagcaagcaacccatactatactagtactagttcgctcgcaggaaaacagtaaaatcgagcgtgatttggtgagaagagaaaaggggatgggagacgggagacgggagtagtgaccggagttgaggaaatcgaggaaggagaggacgatgaggcgggagatgggggagtcggagcgggtca

SEQ ID NO: 74470 - DNA, 20382 bp, Oryza sativa
cctagttattttcttcaactcgaaacttcaacttcttatttttcattagcatgtttttcaaattattaaatgttatagcatagaagcttataatagttaaattttaattattcatatactaataagccttctcatcctgcatgcgttaaaatctccatacgaacctatggaaagaatgcggccttaattaaggtgctctctctaactgagatgaatattgcactgatctaatgggttcaaacaaatttacaaattgtacgcccaataattaagttggtagtggttagtaagaaaataataaaactgtatattgattctccctactgagagagagagcttcgtataagttggtcaagaatagtcccataaaaaagataaatcggtatagtggtattaatatacgtatcttaattttgttttttctcaaaaacatagtataaacgtaaacattcacaacgtgtgactccgataaacgcccacacacacattatactctaatattagtatattaaagatgagcacgcacataattggtgttgcctgtgtatatccagctcgatggagatgattggagtactgggtagtagctggctggccagggaggccgaccggaccaactgcatatgcagcatgcttttcattcttgatgatatgacaggctcagcatgtatagcattataattagaggaaagcgaaaagggaaatggccgaatttcgcagcatgattgggtccaagcatacgtccaccacccatctattctcatactcctgctgccgcgctgtgttgttggacaatgctgttggttttatatattccgctgtgtgtgtgtgggtgggttcatgtatgtacacgctgcaattctgcaagagcaacgcaacaaaaagaaactcggagcaaaagcagcctctcttttggcaaaaggctttcttgctttgctttgctttgctcgtaatactgacagacacacacactactactactactacacgtgagattttcctgaacgtcgaccccgttagcttccaggtgggccgtaagtggagccgaaggccggcgccggggttagggccgcacgggataacacagtgttacaagcaaccgagcttgacgaacctatgcggttattacatgtgcgagatgcttagggtctgtgggagatacagaactaagggtatgtgggagatatagaactgagtttacagatgtaagtcctcatgctccttagatattgcaaatatttcatttaagttgattgtaacacaaatcatttgttttttactttccatagctcccgagcatcccttataacgcaagcccgttcgatcagaaaacgcttatctacttatgcgcggacttatgccggttcattcgtcgcgacacctacaactatccaggagagttccatgatcctcatagctaacttgctacggatcccaaattcaagaacctaatggagcgggagagggaacatgctatagactaaaatgtttatttgtcgcgggggatacttgtaatattacaaacactatacattatatgtaatttgatgtttataactgagctcggtcaattttcggctaatttttcatctattatcccgtgtggtcaaattataccggcccatgggataataggttaaaccagacggctagcatgtgctagagcgacggcacgaattatcccgtgcggtcgccttagcacacgctagctgaggggataacctattatcccgtgcgatcgtccttattacaccgcacaggacaatcaattattccgtgcggtccgtataacccgaccgcacgcaaaaatatcgattttcccagacgagtggttgcaggcgggccgagcgaccgcacgggataatatatccaactacccggaaaaatgggtattgtagtagtgacagtcccgcagactgctgtccaattggatccacgaagcagagcacgcaacacaaatattagaaagtcggtgaatcaaatttaaacaattttctaagaaatgataataaaaactattttttgcaaaaattgaagcttggaaaaggtttatgcagtaatccataagaccataatcaaataaaaggagactgggggtgggtatgcagatgcgatggtgtgttcgttcaaaccgatggagttggatttccgcggcacgcgaaaaccagagtcattagcatataattaaccatataactattacacacttgaaataaatatttttaaataactttcatgtagattttttaagaaacacactgattagcagtttgggaagcgtactcatggataacgagaaagttgcacgtcaaaaaatcaatttataaagactaagaacatctctgaaagagttgttatttgactcttaagccaaaaaatgacaattttagtgaaaatatggtttacaacaaacttaccgatcgaatggccaagctatctggctaaccaaactcatccagtagcccaatttggatagccaaattagcttgccaaacgtgtaccctacaccggtacccctatctctctctctcatttctgcgcttcctctcctatccctagactcctcacgagcatatgtgccgacaaatgcacttcccaccatccgcaaagccgctgagagggtctgtcatccattgttgttgccccccctctccccgaggtaacctgttgccgtccaaaaacaaatcaccgcaccctttcttccattgccacgacgccctttccctgtcgcgcctagcagcagtcgctaaccatgccgaggcctgccactcaacccacagcctcctctttccctgtcactgtcgctcaagcaagtgagatccatgagacggtggggtgatatcatcatagcagagggagtcaaggccgacgaccactctcgtatctcaaggttggcgattgcttcctgcctagctctagcgtcgctgtcgtcggccaaaaggcaagagaaaatctctatcgttgctctcttctatgctgcctacctcgctctctccggtgctgaccacctcaggccaccccgctggcgtcggtggcaatgtcggcctcttagcggtggtgggtggggactagggaggggagaggaggggttgcacatagaaggagagtaaggaagagatacaggctgacatatgagatctgttgttagattggagagggtattttagagtttgttggagcgaaagataaatgtaactctttattttttttatcgattttgctatatatttgtcgataaattttctcccaaaaatttgacagatgtaattacaatacaatcgtagtataattacactgtaacttacatgtaattatactgtaactataatgtaacttgtatgtaactttcaaaaatctctccgtgatattttatttcggtaaaatagaggttgtgggaacaaatccttatacatatgtgtgtgctgtgattttatttttcttcctcaccaaaacaaatcttgtaatagatctaaagattcaaaattacatgaaacttatatacaagtcacactgtagttacatgcaagttacagtataattacatataagttacagtgtaattacactataattgtactataattacatctatcaaatttttagaagaaaatttatcgacaaatatatagaggtggtcttttttttataagctagccaaatgaagtagatatttctagagccaaatttgacaagattgttggagatgcgcgcaaacggccggcacacgtacggacggacttgcatagcagagcagcatgtagagagaaagcaggaggagaaagtgcgcgtgtggcgctgggatttatccctttctttttcagtcgccggactttttatcattccaatccagtcatctcctcttcttctttctatctcaatttttttttcttctctttctttctttctttctttcagctggctgtacaggggggatcacattgggatgggaccttttttttttttggagagaaagagctttcctctacccctccctgtactccactccgtaaagtatcagactatcagagagagtatcagtcaaaagtaatcatgaagtagaagtactcgcgtatatactcctacttgagtaggagaagaggcaagagcagtttactcctagattagattatagtgtcatggaaggaatccttcatcaagatactggagtacccaatcgatcgactgctttatttgccgtgcggaatggaagaatgtagttactccgatcgaggatgtgttatttacatgatgcatcatcaagcaatcaatcaaaccgcaatctcagaattttctgtccatacaatattcacattaggccggttttaatataatttatttattatgtaaaaaatatatatacatattgtatcgtgagtattaattacagtattttactagtggtatgaataataataatcatgcatgatgatgatttgtacaaggagaaaccggagtattagatggtacaacaagcagcaggggccccttgttggcgtttctgtaggcgtaggagcgcgcgaagcagaggaacattgccagctccgcggcactgacgccggcgagcagccagtagaagtagtcgaggtggcctcggttgagatcgtcggcgaaccacccgtcgccgccgtctctcctggtgatgccatccagcgccgatatgagcgcgctgctgatgaagccgccgatgcccatgacgctgtagtagagcgccagccccaggctgcgcatcccctccggcatctcgccgtggaagaactcctgcatccccaccaccgccagcacgtccgccacccccatcgccacgtactgcggcaccagccacgcccagctcatcgccggccgttgctcccgcaccgtctccagccgacgcccctccaccgccgccgccaccgccaccgccgccagcgacagcgccatgcccgtccccgtgcgctgcagcgtggtcagccccctcgggttgcccgtcatgcgccgcagcattggcaccaccgcgcggtcgtagatgggcacggacaccatgatggtgaccggccccaacgtctggagcgcggcgggcgggagctccagtccggcgtggccgatgtggcggtccagcgtgcggccctgcttgttgaacaacgtcatgatctgcgcgtacgccacgccgtacgccaggcacgtcgcccatatggggagcaggcgcagcatgcggcgcgcctcctccgacgactgcttgtagtgtcgtagcgagagcaaggggctggcggcggcggaggagaggcggtaggtgggggtggcgaggaggaagaggaggaaggcgcaggagacgacggcgaaggggatggcgaagccgacgccccagctgacgttctcctggatgtagctgacggtggcgatggagacggtgatgccggtggccatggagaagtaccaccagttgaagagtgagctgcgggaggcgctctccctggggtgctccgggtcgaactgctccgcgcccaacgccagcccgcatggcttgtcgaacccctgtgccaaggccaccaggtacagcgacacgtacaagatgcccacctgtgacttggacgccaccaccgacgacgccaccgtcagcatgccgtacccctgcactcatgtcgatccaactttcaatttgctttcaggtgtaacgacactagtaccacataacgtaatttcacagttgaatttgaactgtaagtatatctttcaccaatcaaatcatttttgccgtttattttaagcatgtatgtatattgaaatagtagtaggataaggacgagcatggtgatggtgccagtggcagtgtttaatttgattgctgtcagtgtcaaatcatcggattgaccaaacgagggagcagatcagatactctagctaggttaagggcataataatagtagaaaaaaccgaaccggtacttgaaccgtcgtggctgctgggtcaccgggtcagtggtccaaccgccggttcatccgggtcaattgcagaaccggactactagttactatcatatatatcatttcactcggtcatctaaacaagtagcagtgtagtccaatggtaacgcgtgagtgtttgtaaccaagccaaccaggtttgatcccccacagagcatattttttcacatattcttctaatataaataggtattaggccttaccagctaatgactttgggcctacgcatgccttatctctttggcccactaatcgaaccgccggttcaaaaatcagccggttcaccggttttcgacaaaaagccgtccggttctcaccgggttgactgcatgaacggtctttgaagcaaaccgaaccggcgaggtccctggttcaggttttttccggtcgaaccaccgggccggtccagtttttttttactatggttaagggtaataatggacgagtagcgtgcagtgctggttagtaattaattactttttcggtccgaaaatatatttgaccggatagataagttgtctctaatctacttctaatttgctatactaatcttctactttactcctcggtccataataaatcaacttaatatgtttaatatgtttagattcgtagtattaaaatatgtcatataataaatcaacttaatatagaatgtccccgtaaaaaaacttaatatagaatgtgatatgaatctggacattcatatgtctagattctatattcgttttttatgggatagattgagtaggtttctatataattttaaattttattgatgaatattgcataggttttgcctctgcacgtctctactagtatatgcgtatgtatgtatgtatgtatgtatgttctatattactatactggtggttgagtaatgagtaggagtatactcctagtagtggttggaggagtattagtagcacaagtatcacatggcagacaacaggctgttacgttccattgattagagtagtccattggagtattattcatcaagaatactaataactaaggtagcgaaatgtaaaagaaacgagtaataacaacaaggcaaatgataagtgaaaaagaagaaaaggggtaaaattggaaccaggaggtaaagggtgcaggcgaggaggatggatgggtagcggccgaggaaggagtcggcgaggaaggcgccgaggagaggaagcatgcaggccgcccccgaccaggcgttcaccgccgccgccgccgacgcgttggattgccccatcggccccgtcagatacgtgatcaggttcgccgacacgccgaagtaggcgaagctgccggccaactccaacactgtccatggaatgaattagctagcctgatcgatctatagactatagctatcctgcctcgccggactaaaatgatgaacagcatacatatacataccggcgacgaagagggcggagcgccagccgcctgaggtggcgcggtaaacggggcgcccgcggaagtcggacacgccggggagcgcctcctcctcctcctcattcggaagcaagggacgaccgtccatcgtattcggattcctcctcgatcgatcgctttgcttttctcttcctttcctttcctcgctgaatcggtgcgctctgctctgctcgtaggtaggatgatggtggcaactacaaatcggccaattgaattgacaaggctcagaggattaattaattaatgcggcttgcttctgctcctgctcctgctcctgctccagttgcacatggccaaatcaaaccatccaggatccttcccttttccaatcctcttctgatggtgatgattcggatggagatatttcagaccaacgaacgagtccacgatccaccacaaattaggcataccagacgacaagacctgctattaattgggcccgcgcccatcccatatcatatggtaactttaggccttcagcccaataataatcccatcggacgatggaaaggcccacagactagatacctcggactacacagtctgtcactaactctctataccttccttccgtttcacgaagaatcaattgcttcatccatcccattttaactatgattttccgtgtttaactttaatcgtccatcttatttaaaacttttttttaaaagaatggtctatttctgtcatctcctttaccgaaagcagaatatatggacaggctccgaaagattaattaatttcagtataaatgtcaatgtcgtcagctcccaacaaagattaattccagtataaatacccataccatgcataggtagctaactagcaagctggtatcatcttcttctacttcctacttcttcttattgtgggttgtggcatatatataatatcccagtgaacagtgaaggatggaggaggagtggtgttgtgtggcgccgggattcaggttccacccgacggaggaggaactggttggttactacctggcacggaaggtggtcgggcagcaggacgacgggatcatccaggaggtggatcttaacagcatcgagccatgggacctgctgcaagctcagcagcatgatcaggagtactactgctacttcttcagctacaaggaccgcaagtaccccagcgcgcgagggacggggacgcggaccaaccgcgccacggcggcgggcttctggaaggccacgggccgtgacaagccggtgctctcctcctctcgatcatcatcgtcgccggcggtgatcggcatgaggaagacgctcgtcttctaccgcggccgcgcgcccaacggctgcaagaccgactggatcatccacgagtaccgcctcgtcgcccaccatcagcagccggacggcagctgctgggtggtgtgccgcgcgtttcacaagcccaccaccaccaccctgcagcatcagcttcacctgcacaggccgcctcctctacttcatcatcccggctactacgacgaccaatatttatatcctcctcctgctgctgctgctggtggcggcggcttgctctgctcccctgccttggacatggagttggaggacgaggaggatgaatccaagatgatgatcttaagcaatgataatattccgctggtggtgagtccgactgccgtacacacacaaggcaccggcggcgacattattaacgacgctactaccgcgcctgctgctgctgctgctgctgatcatcgtcgacaccttgctccaccaccaccacttcacttgttagctaattcagtcgattaattatattaatgagaaatttactagtaatcggatcatcatgcatccatcatgcgtgaatgactaccacgtattaattcgaatccatactctgtatcatcgtatatagtagtatttatagacaccgtacgttaattaattactgctggccgtcgacctgctacctatactatatattagcacaaaatgttatcagtgcaaatatgtgcatgtagtcctcctccatatacatatcagtacaaatacaaacatgttatctcttacagtatttgggtctttcgttcgtcactacccggccggtctgaatattaatttatgcgatcgttcaccttcacatatacggatgtagttcaccactacacgtacgtatatacatgtatctttgatcgcgcgcgcctttcaaaaagaataagaagaagaagaagaagaagaagaaggggagtatatatgtatctaagtatgttcgatcgatttccaggttaattaatttcatctcgacaaatgcagcagggctctctaccagtacatcgaagtatatttatctgaaccatcggtttataagggcataacaatatttactaactcagtgattagagttaatgctggtattcatgattttatcaattattttttaaaaagaaagagaagaggtttttatccttcatcaaatgatatgcttaatttatattggtctattctacaaccgtgttcaggaaaaaacaacgcatatggcaaattgcaaactgatcgatccaatgcccaagatctaattaactcaatggttttgatatgaatattttaccggagaatggcaattgattaagcggaacgtacgtatgttgttggctgcagcagaggcggggctccgattggggaggagacgaaacacggcgtcgacgtcagctgcgcgcggctacgatttgggaaaggattagcatcacgtacgtgtcgtcgtttgatcgttctggatggagcagtacgtcggtccttcttaattaattaattcatcctgtcgatcaattacatacagcacagcagtacacatcctctactagctaattgtgttgaactgaacgagacagaaacagcaccgacgacgtacggcttgccgggcgggcggttggaaatcatgattattagtcacctctgatctgattccaatggagatagcgaccctgaaaactctgcacgaatagccatcctcaatggacgcatatgcatatatacatgcatgatacacatatatgcatatgctcatgcacgatggcagaagacatggttgatcatctggtacagcggcggctggggcggcggccggccgtatagcagcggatcggatcgattggatggatctctctctctctctctctctacgtacggtggaggccggcgcccttgccgggaggcaatccatcccatctcccccctatatggtcacgtacgtcgtcttttaattaagtgccatccatgcataagtccatatctgactttggcaaatgcaagtgcagatgcaatcatggctaagctctccatctttgtatttagtagtagtagttgttacctttgagttcattgtcatatatctttggaaaatatgtcttctttgcatacatatgtgtgtacaaaagtcaactagtgggctttttctctctcttttttcggagctagactttaaaaataggatttggtgcgatataccactcccaacttcttgttcctgaaatacaattgtttttttatttaaaagtacaactaggtttgatatacaactcttaggaatccttcggaacacatgattttcaaaacacaggaatacgaataatataatatcggaatgtcatgccttgtaaatcctacaagaaatagaaatacaacatttttcaaaaacaaccgtttggatgtcgcatagaaaaaaaacataggaattgaagacaccagaagagggaaaaaaacacattccataagattttcaaaggaattttgaaggttctatccttaggattcaaattttctaaaaatcctccacttttcctgtgttccaaatgagtccttaacttctatccatagatacaaatgcattttgtattcaactaaattgattaatgcacatcaactcactacgattttgcagtgtaaatattatttgttttcttcaatcaatatggaaatttgtaggctcggaggaaatattgtaaattccttttgaccttagtatttaatgtccttcttagctcaacattttcttaaaggtattttgaaatttcgattttttataattaattgtaggtgtttttttaacttgtcttcttagaaaatgaaacacctaaaactataaaagtaataatcaaactagataattaaaaatcagctacaactctcccaaggatatatggggcttaatttagagagagatggaataagtccactttgaatcacttaactagtggtctaatcactacattctagatatctccaacgaagaatatactacgatgaaggatgtgaagcagattcggcaactaggttagtgagtcaaagtggacttattccgagagagaaacaaggttagggagtcacagtggacttattccgagagagaaacagaggtagcgtatgggccggtgacatatggtccgaaagcggtgggtagtaggtgggcctggcctggaagggttacgcgtccagtccagacgtaaggaacccttgctgatcgatcgtctccaacccaacaacaacaagaaacaggaatttcgatttctttttcttcccttctggaggcgtcctgccctgcgttcaccccccgaaatccctctcgattcgccgccgccaccgcctcctccgctccgccgccgctagggtgttctccggcaaccctaaccctaaccctaacctatcttcgccgccgcccgccaatacaccacaccctatacccgccacacacacacacacacacacactctctctctctctctctctaatggcggcggcggcggcggcggctgcggctgcgccggcgccggcgacggaggaggacgaggaggcgctgctcacccgcgtgcagactatcatcttgcgggtcgtcgagctcgaggacaaccccaacccccgcctcctccacaccctcgccaccatctgcgaggcccacgaagccaggtacccacccccacccccaccccctgcgctcttcttttcttcctctcttacctatagatgttctaccttccttcctcttactattgttgctccacacgaacccatgtttgattcgctcatgccctcttgctgctccttttccttgtgcagctagggcaccctcctccactccctttatttttttttatttattaggcaccctgctgcattgcatatttttcctacgaaacccatactgttgttcttgccaacctaaatcagttcagttagtgagtcctcttctccgtaggtcaaattctcgtttgcttaccgctgttaccatcattcataaaacaacttcgtatcagccatgtatgatcgggccccttcttcattagtacctttcatttctacattttggaaaaaaagaacaatgtattccaaacttgccccacttttgggaagagtaggtggaacaagttgaatttcccatttttatctcacaagagtcactgtccaatagcggaggaaactaaactgccactaggaaggtcattcattcttcaatgggaaattgttcaccatatttcttgatgaatagcattgcttctaagattgcttccttaacagtgttatttccctgcagatatgcacaagaatgtgcgaatagtccatcgtacaataacacaaacgcaaggaactcccatacaattggcaagctggcaaacttgcttcgggtgagcactctagagttatatacactacatcatcataatcttagttttatcagcctattgcttaaattaatcattcttctctttaaccccattggcaggagaatgacgacttttatgagttagtgttctgtaagttcttatcagacaactcatactcggctgcagtacgctctgctgctgctaggctgctcctaagctgctattctgcctggacggttagcttttccctctctgtcaacacactaagctctctacatttcttctcatctccaactcggacaataccaacctttcatttttcattttggtctctgcagcctcagtatcctcatgcatttgaagatgctattgtagaaaatataaagaaatgggtgacagaagatggtggagcgtcaaatgagtgtgaatcgaagcatctaggaaagaataacaaaccaacagatgctgacatgctgcggacatatgccattgggttgcttgctatggcgctgtgtgggtaatgccatgagttttgtttcacatgtgattgcgtgccatcctttttgctttcaactatctctgccgttcacctaactgttgcttctttttttgtccttcccagtggtgggcagttggtagaagatgtcttaaccatgggggtatcagctaagctcatgcactttttgcgtgtgcgagtgcatggggatgttgcgtgtgcccagaaagattctaatattccactagataccaaacatcctcggagcagagatgagaacaggagcaaatcacgcctggttcaagacagttctcgattggatggaatgaggtctggagatggaatttcaattgacccaacttcagaaaactgtgacaatgttatgggaatgcggcatgcacatggagaacggtggatagatgatgctgcctctctgcaacctgagcgtgctgattcatcgttggatctttttgatgcgatggaggctggtgcaaccaatgatagaacttatagtgcaagcatttgtgatacaaagtcaagagttggggaaaggctttctgcattgagacctggaagagatgaagagatgaacgaaaatacgagagatgatctgttaaagcggaagttgagtcgaacaggatcacgacttagggggaagagcaaagcaggtgaaagcttgcctgaaagtgaaagaacacctttatcaccaacctcaggattgaaaataggaactcggactagcagagagaagaatatggtgaggattgaggatgcaaataaggccattgatgtgaacaacagctctccaggcattgagccatttaatgcaatttccaaagaagagtatgaggatcggttcaaggattgtattattggcttaaaggatatatccgacattgttttaaaggctgtgagagctgctgaagctgaagccagatctgcaaatgcacctgatgaggctgtaaaagcagcaggtgatgcggctgccgagcttgtgaaatctgctgcatcagaggtatggaaaagacggtttgcattcttatacactgacaatttttctttatcatactatagtaacaatttcttgtttgtcaacatttctgaaggtttggaaaactggaaataatggtgatgcggttgtattagctgctgagaaagcagcagctactgtagtggatgctgctatgtcaactagtgtctcacggtaatggattaaatgctctctctctctctctctctctcacacacacacacacacacacactcactcactcatttggtctcatcatattctgagagtttgatttggtattgctgaagctctaaccaagtcggtgaagagcatgttgtggaagagcctgtgcaaatcagcgaggatcatgaattggaagattttgttatcactgaccatgggcagctcctacaacttagagaaaaatatagcattcagtgtctacagattttgggagagtatgttgaagcattgggtcctgttctccatgaaaagggagttgatgtttgccttgcattattgcaacgtagcattaaagaccaggggggacatggccactttacacttctgcctgatgtccttcgattaatttgtgccctggccgcccaccgaaaatttgctgcgctctttgttgaccgtggtggtattcagaagattctctctgttcctaggattgctcagacatataccgctctttctgcctgcttatttacttttggctccctccaggtaaacactaacaacctaaattgcctgtctatgcagagttgatatgttatttcctctttgagttgctgaaatatgattcatgcttgcagtcaaccatggaacgtatttgtgcactctcatctgacacacttaataatgtggttgaactggcgcttcaacttcttgaatgtccacaagattcagcgaggaaaaatgcagccatattcttcgctgctgcctttgtgttcaaagctattctggattcatttgatgcaaaggatgggatgcaaaaagttctaggtattttacatggtgctgcttctgttaggtctggtggcaactctggggcattagggtcctctaatgtaaaccaggggaatgatcggtcacctgctgaagttctgactgcatcagaaaagcaggttgcataccattcatgtgttgcactaaggcagtactttagggctcatctgcttcagcttgttgattctattcgaccaagcaaaagtatccgtagtattgctcggaacacttctagcgcaagagctggctacaaaccatttgacattggcaatgaggctatggatgctgtttttcgtcagatccagcgggacagaaagttaggtcctgctcttgtaagagctcgttggcctgtgctggataaatttttggcatctaatggccatataacaatgctagaactctgccaggtgaagcttgtacattttcttttggtcagcaaagtttgttgtttacctattttgacccataacaatttgtttcaggctccacctactgatcgctatctgcatgacttaacacaatatgcatttggagttcttcacattacaacgcttgtgccatactgccgcaaactgatagtacatgctacattaagtaacaatcgtgttggcatgtctgtcctattagatgcagccaacagttttggctatgttgatcctgaggtaagatttttgttatcaaatagattaataagctcaataaattataaattataaatctgtaaaatgtggctgctgaaatcatctctaattaccatttgtggatcaggtgatctgtccagcactgaacgttcttgtcaatcttgtgtgtccccctccttctatcagtaacaagtcatcctcaactggtaaccagcaacctgcagctacccaagcagttggtggggcattttcagagaacagagacaggaatgctgaaaaatgtactacagatagaaatctaactgcaaatcagggtgaatctcgggaacgttgtggtgatggtaacacatctcaacagggcaatactgtgcaaattagcacacctgttgtgccatctggggtggttggtgatcggagaatatctttaggagtaggagctggtggtcctggtcttgctgctcaattggaacaagggtatcgtcaagctcgagaagtggtcagagctaataatggtataaagattcttttacagcttctcagttctcgaatggttacacctcctgtggctattgatcctattcgggcacttgcgtgtcgtgtcctgcttgggttggctagagatgatgcaattgcacatatactcactaaactccaggtactgttggtacaatgtccatctacctttttttcccctacacctctagctatgatttgagcattttttttagcaattggtcaactacattttcactgcataatcactagtaagcattaatactgatggtgtactccccccactttgacatacttcttgggtcctttctttacatactgttcaaaacaaattagttaaatcttgaataaaattagtcactgctccttcatcagcaattttcttcttattgtttcaggtaggaaagaaactatcagaactgatccgtgataccagtggacagtcaattggaggagataatagtagatggcaaaatgaactgacccaagtggcaattgaactaattgcggtaagggacttgtattatttattgtgatgcaaatataaattgctcaagagcttacattcgtagagttcctttcctgatttaactgttcatgatgtggaacaaggtggttgcaccgtgtagttatttggtattatttcctcaattaccatgaatgcagtgtatgtaagcagcttatacaacttaaattagtggttgtgtgttagaattaacttgtgtttccgcaatattctcctttttacacatggacaatatatatgctcttttaccctaattatgtattgcatgtgtcttgtgtcctgtaattatgactgctgttttattttggtaggtcctgacaaattctggaaaagaaacaaccttagcagcgactgatgctgctgctccagcactgaggcgcattgaacgagctggaatagctgctgcgactcctgtctcgtaccattccaggtttgactgctttatgattttgcttccattacttcatcagcttttgtgtctgggcatttacatttgtttttatttttggtggtgtctagggaactgatgcaactgatacatgaacatctccttggatctggttttactgctactgctgctatgctgcaaaaggaggctgaccttgcacctttgccatcgacagctgcagtgactcctgtccaccaggttgctgccctggagacatcatctgctcagcaacagtggccttctggtcgtgttcagggatttgtgccagatacaacaaaggtgactacagaccaaactggccagagatctgattctgtcttgccttcatcaaagaagaaatcactgtccttctcatccagtttctcgaagcgaactcaaccttcgcatctattttctggtaatagagcaagcaatagcctgaaaagtcctgttcctattgggaatgttgacaatatgatttgcgctgcttctactgtcaatactggagatgcggagacatctcataaaacaccattatcgttgccacagaagaggaagctagtggacatgaaggatcttagttcagcgtcagcagcaaagcgctctgcaatggttgatcaagcatgccagtctcctgtattccaaactcctgctcctactcgcagaggactgtcagtggcagtggattctcctactgcttcatttcattctggacggccaaatttcaacaacatttacacagagaacctggatgattttcaaggcacacctggagcaacaattaccacaccacatcacggtgcaagtgatcaacagccagtaaatttggagtgcatgacgctcgattcactggttgtacaatacttgaaacaccaacaccgccaatgtcctgctccaataacaactttgccaccactctctctgttgcatcctcatgtttgccctgagcccagtcgcagccttagcgcgccagcaaacatagctgctcgcatgggaagccgtgagataaggaggcaatttagtgggatccaaatacctcgcagggatcgccaatttatatacagcaggttcaagctatgccgtgtttgccgtgatgaatcctcacttttgacttgcatgacatttcttggtgatgcatcacgagttgcagctggaaaccacactggggaattaagagtatttgactgcaacactgcaaatatcctagagacccagacatgccaccaacagcttgttacaatagtagagtcggcatcttctggtggaaatgagctgattctcacgtccagccttaacgaggttaaagtctgggatgccttctcagtatctggggggcctttacacacatttgagggttgcaaagctgctcggtttagccattctggaacttcatttgccgccctttccactgatacgactcgtcgggaggttctattgtatgatgtccagacatataatcttgatctgcggcttcctgataactctggctattcaggaggccggggttatgtacaacctattatacatttcagtccatcggatacaatgttgttgtggaatggggtcctgtgggatagacgaagtccaaaccctgtccatcagtttgaccagttcactgactacggcggtggtggcttccatccagctggcaatgaggttgattttcttttcctgaacctttttgttattttgttagtttataattctgttcatttcagagcatgggcatcaagagatttactccctctattgcaaagtcataattttctcaacttatgaaccttccgctctaattccgtccttaaatattgttaaatgccaagcccttataattcataatggagagcaacttttgtacagaaagaatccatatttgtgaatttgtgttgtcacttgcccatgcaccatgtgctatgtgatcctgtacttaacacagctggctcagggccaagctatgatgttaaaccattgggtaataatcgggtaatggtttgcttgctcttgttcaatttgtttaaacaatcatgaaccagctgccgattctcacatttcaacaacttatgcagccaagggccattgctacccagccagtcccatttttcgtccagccacctgatttttggggtgtcgccttccacataaatgacctccataattaatctgcaagactgtttgggtagaataggagcccatggaagtaacataaatgaatttattttcctgattttgccactaaactgtaaattataattatctatatttttttagagtaatttgtttctggtgtgcttgtcttctcatctctgccgtccatactttgcaggtataataaattcagaagtgtgggatctaaggaaatttaagcttctgaggagtgttccttccctggaccagacagtaataaaatttaatggcagaggggatgttatctatgccattctcaggcgtaatcttgacgatgtaacatcatccattcatactcgtagggtcagacatcccctgttccctgcattccgcacgattgatgccgtgacttactcagacattgcaacagtccaaattgatcgtggtgtccttgatcttgcaactgaacccaatgattctcttcttggggttgttgctatggatgatcctgatgagatgttctcttctgctcgcctatttgaagttggcaggaagcgtccaactgatgatgattcagatccggaggacgcaggtgacacagatgacgaa

SEQ ID NO: 74471 - DNA, 19790 bp, Oryza sativa
cagatcaattgttgaacttactacaagacaagagaagtccctcccatgatgtccactgcaccattaacttgtatgttgcttatacaaacacaccacatcaaactacatagattttgggcctcttcatgctattttcaactttaccgagttttaataaagttactaaaaaaatggctacatttagtttgctgtcaaattttgataactatataagaaatcctgccaaaattttatcaagttaccaaaattttgacaactatgccaaaattttagcattggtaagttttttttcatcaaagtgaacaggcccttttactccgtaatttacacaactttattgcaaaatatcagagataatagtcatttctagaagaaaagttatgtttattttctgatatttatcatttaatgccaaagggatatgctagccacatgcaagtttgtattctttcatccaaaagaggagaagatgatggccatgttcatccctactctcaagtgattatgcttttggaggctttcggctgcaggagcccacacatggcaacagatacacgtagatcaaacaagacagtgccacatataccagacaggtgggtcctggataaggcagaaatcaaaacgtcgacaccatccacgtgtaatgtatggcgatctgaattattttaggaaagcaaaaaatgtttatctgctttaatttgctttcactctaaccagtgatttttttgatggccgccttggcgccccattggaccataaaaaaagagaaactattgtgaaagtaaagagatataaaggagagactaactaactccactatggtgagagtgccgacaaattgtaaaaacagacactaagagataaagcagagtaaaattgttctaaagcatatagcatgagaaatgcatctttcattagaaaagcaaaatatttctttaacattttaggtgaaaatgtctacttataggcacaatttaattgataactatattttgtttactagttaatattagttgctaatatttctttcattttaaaatataagggatttcagataaatgtgatatatcatattactatgatgtgtcatattcacctaaaatctcttatattttttgacggagagagtctgactctcctagtcccaaaaaactcaatctaagagggtcacatacaacaaatctagattgcctagattcattatattaggaggggatgcttctagattgagtttttttttttggcggatggagtatacgttgtaacttgacttttttatgcctttaagaaaacttgcctttttcagtggaatgtgctgcaattaatactatgtttatcatgtttgtcgtggcatgtgtgcccttgtatcatttgcacttaatcgaatggtatttataaaaatataatgttgattattccataatttattcataaaaatataactatttacagagaggtacaaattttttaggtaacggacaatataaaccataaaaaaatccttgcctttttctcacttagtaggtgccatctaatgcccttgattgaattaatcatagagtcaccacacaacaaaatgagtagttagcgaaatactacaagatgcacaataaaaaaacttatgaacaatatgcaaaaataataattctctcacctagtactgtaatttattgccccccgattgaattaaagatagaactcaaatgttgggatagctagaagaaactagccatttaatggtattaagataggagaagccacattttttccaacccttcatttcgtttaatccagatggaatatgagcaggttaagaggtcgaacctggatttgctggacgaaagcaatcaacccgtaccaattaatgatagagctaccactgaacaaaacgatgagcagtccagtgaaaatagcaacaatggactggcaagttgtacaattatttatgacccattaatttatttctcccccacaaaagaaaagataggaaaaaaaataaaaccagggaccaaactctaccaacttgggctgctgctaggcggcagcatatttgtcttctggcagttgtgctgagaagccaggcagaggggagtttagcctgaaagtgagctctctagggagatagagagagaagagggccaaagaagaagaagaaatcaaagctaggagaggtccaagattcccactaggaccctttcttggttctcttctttttctttggctgattggaaggtctagagtcaatcacttggtttcttttgtttcttttctttggctccattggttcttcttgccttccaatcgttctaaggggtggatagaatttgtaagtgtcatgttcttcttcttcttgtcctttttagtttgttggtttggagttcacttctccattttcgcttcttcgagatgttataatcaactgtgttctaagttctaacatgtggtcaaaatgctgattttttttcctcagttggagtatcacctatcaggcactctgttcatggcccaatgattttgattggtgggcagattttcacagaccccccattccagtttttttttcccaaggggatgcgcgaatcttgctgctaatgttcttgtgaatcaaagccaggagatttctggaaagtgaggaattcttttcttagattgcaatatcaatcacagcgctttctccacaagttgcaatctctgagcgcttttgatctctccacaccaaccaaaagcaacagaaatttaccttggattccgcggttttgaagaatctgttctgatttggagatggagaggcagacgagcttccgattgggcgcgctggagaagctcaagagcttcagggggatggagaagcagaagagcttcaagatgatgtccacggacaacttccggaggcacagggacagccccgggaagcgcggcgacacgccgctccacctcgccgcgaggtccgggaacgccgccggcgcgcagcggatcatcgccgagttcgacccggaggtggcggcggagcgcgccgcgcaggccaaccacgacggcgagacgccgctgtacgtcgccgccgagagggggcacaccgacgtggtgcgcgagatcctcaaggtctccgacgtgcagacggccggcgtcaaggcgaacaacagcttcgacgcgttccatattgcggcgaagcaaggccatctaggtcagttctttcttcttcttcttcttttttgtttgttctttttttttgttcattttctgaacctgatttctgttattagtgatgactgacttcgatctcagcctgccagtgccaagtcaatgagctgatgattagaggtttatggcattaggattttgcattgacttaatctaatttgcatgtgtcattgtgtagggctttgaaaaatcctatgctgaacttgtctgatttgacttatggaaatatacaagtgcttttgcttttgttcatttcttttcttcacaacgtgcattgctaacatgaatcgttgtggttaccttcttctctcttttttttacataaatgtctgagactagtgcatatctcacatctggtttgatttagacctcatgtccagcaaggaagcaaataccttctttttaggtgataggcaagctgagtttttcattatggatttatggtcttgtttagtgagggttgacaaattctgtacccaaagaagctttcacgatgtgtctacattgaatggtttatttaagaatatatacaatgaaaaaaatggtagtattcctttcgcgcgatggtggattttgtgcaaccattattagttttatgaccttatgatctcattctgttttctacttgtgaaagactgaaattcatgtcattttagtcatggagttatatctagtagccagcaaaccacagctatagtcatgatcacaatgatttgtacaagatatggtttagttaagtattttgctaacgaagaaaaaagaaatcctggctcatacgtttcttttgtttcttggtttttcagaagttctgaaggagctgttgcaggcttttcctgctcttgcaatgactacaaattctgtaaatgctacagctttggatactgctgcaattctgggtcacactgaaattgttaacctcctactggaatctgatgcaaaccttgcgagaattgcaagaaataatgggaagacagttctgcattcagctgcaagactgggccatgtggaaattgtaagatcattattaagtagggatccaggaattggtttaagaactgacaagaaggggcaaacagcactacatatggcttcaaaaggacaaaatgctgaaattgttatcgagctgttgaagcctgatatctcagtaattcatctggaagacaacaagggaaacagaccattgcatgttgcaacacggaaggccaatatcgttgtaggtgatcttatattgggaatttcatttgttttattttacctccttgctactatatgtttttgtcgatctttttagatgactatttgtttgccaaatcacttgctatcctgtttactgagtttaattatgtcagtattttgagaacagagattatcataactttactgtaggatacctctatttgattggaatggtgataatgctttctttatgaacaaattcaaaacaaatgcaggtgcctgtacataagttttaaaaagaataaagaagcatatcatatttcaaacatatagaaacaagaaggtttgctttgactgatatatgtgtaattccttacagatagtgcagactctactatcagttgagggaattgaagtaaatgcagttaacagatcagggcacaccgctcttgccattgctgagcaactcaacaatgaagaacttgttaacatcttgagagaggctggtggagtaactgcaaaagagcaagtacatccacccaatccggcaaagcaacttaagcaaacagttagtgatatcagacatgatgtccagtcccagatcaagcaaactaaacagaccaagatgcaagtccagaaaatcaagaagagactcgaaaaactccacattggtggtctaaacaatgccatcaactccaatactgtggttgcagtgcttattgccaccgtcgcctttgctgccattttcaccgttcctggcaattttgtggaagatatcactcaggcacctccaggcatgtccttggggcaggcatatgtagcaagcaacccggccttcctagtatttttggtctttgatgccttggctctcttcatctcacttgctgtcgtcgtcgtccagacctcgctaattgttgttgagcagaaagccaagagaaggatggtctttgtgatgaacaagctgatgtggctggcatgcctctttatctcggtggccttcatagcactaacctatgttgttgtcgggcgcgacgactggtggctagcttggtgcacaatggcaatcggtgcagtgatcatgcttacaactcttggttccatgtgctactgtatcattgctcataggatggatgagaggaagatcaggaaggcgtctacaagccaatctcgctcatggtctcaaacagttgactcagatccagatctactcaacagtgaatataagaaaatgtatgcactataggataatagttacatgatgatggaatccatgtacacgagagtgctgtttttttttacccgaggcaacaagaagaatggaattgacatggaagtctttgttcagagcaaggtgccagctatattaactgaaggcaccttactgcaatgcaaagcaagttaactgaactgccaaaacaaaggaagttaactgaagaaacctcacactggctgctgaatttgttcctggtgtttacctggagctgtggtctcgtgtcagcgaatgaacacctgctaaaattgttttgttgttgctaaaaaaaggtcaatagtgagggcaacaatacgatttgtagactgtactaggaaaagaaaaatactatgctctgtcacataccttggacatgtctgctgcatgttgttgctcgatgagctagaaaatacttcgtatttcctttcttttaccatcctgatttcgacgttgtcataaacagttgagggttcactggaatctacaaccatgcctgaaagaacaaaatttgccatttgcaaatgtgcagagacaatcaggcattctggctcgttcaaactgcaaaaacaacgaggcatggccatcagcaacccatcatctatgaattaatgcatagctgataaaaaggcaaaactaatcgtcatatagccatgtgctgtatgcagacatgccaattgggcaatactcaagaacgagctaagcaccaatatcttcagaaacgttgcagcagcaatattaggcaccgaaatcatcattaaaaacatcataacgactcaggattgaagaaacgatcgcctctttctccaaattgccgttttcgcactggaggaattctcctaagagaaaacagccaagaacaaacagagagcaagcaaaatcgagaaaacaagccggtgtaagggtttaaggttcgtcggagatcggccgtacggtcaccgatcttgacgacggtcacaaccgagacgaagggtacggactacggaggggttcggagttttcttctccgaactccctcagggcctcacgaaccgttggattaagacgtgcggctaggatccgagacaaatgttgcgacctggacctgtggtacatacgggccacggcccatgaaccgacttaagcccaggcaggattgccttgccggcggcctcgtcaatacaacgacctgatgggggtacggagaagaaaactcctctgctttgggcaccatcgccgccgtggatgcctgcgtactttcttctgaaaaacgaggcctcaaatttcatctatggtgattatgtttctttccattttatgatagaatgaaggtcgcattcggaattattttcagtggccgatcagtcttcacccttcagtgcatgggatgcctgcattttatgatgatgttgtaccacatatatataatctcgattctccttaacagagagatcatttcattccctatgaatatgatcccaacaccagtttgcttcttcgttgagagaaactgaaagcaggcaaataaaaacttcagttcagggctttcctcttaggggtgtttagattcaggagtgcaaagttttggtctgtcacatcggatattatatagagtgtcgtatggggtgttcgggcactaacaaaaaaactaattacaatatccgtcagtaaaccgtgagacgaatttattgtctaattagtctgtcattaacacatatttattgtagcaccacattgttaaatcatggagcaattagacttaaaagattcatctcgcgaagtagtcgcaatatgtgaaactagttatttttttagcatgtatttaatactttatacatgtgttcaaacgttcgatgtgacatggtgtaaaattttagaatgagatctaaacaggcccttagtgcaagggatttaaatgcaggttgtaaaagattccttcctctcaacatatatttgtccagagtcgttgtactagaatatatcacatccagtcttagattcgatttttaagtacggagggagtactttagaatttcagcagctgatcatggccatgtcgccgtacgtcgtagaggacaacggcggtgaggtcggtcgagtgccggcaataaagaaggatcgagaaatgttggatcttggacatatgttttgattcaacagtttgtttttgtttgtgggaggggtcggagaagaaaactccgaacccccaaggccctaggttctcctcgatcgctctccgctgcgcaatcaccttcaaggatcggcgacttggataattagttctctacgctgctccactatcctttttgtaattgtacatcgtgccttctgctgagaagagaatgtctgaattttctgaattcatttttttttggtagtgttctcttgagaatgttgttgttccctctgataaaaacaagtgaagtttatgttctgaactttttctgtggcggtcagtctttgttgcaagggactgaaaatactggcaacaaaagaagagtgaaaaattctgagagaaatcattcacaattagccactgaaatgagcaagggcattgcttgctgcaatataccaaaacttcacaaggtttcttattgtctctttctgcaggattgaaatatttagaaaaaaaaaacatcataccaggtcacagcaatgtgtgaccaagtgactggttgcgtctctgaagtctgaagtatacgagtcattcagagaaactacatccatacatcggtacattgcggggaacagacacaaccgggggtgttaggaatccttgttctccctgacgtgttttaggatgtgatggcccccaaccgattactattagcttgctagaaaaaatgatcgtgcgttgcaacgagtgaaggctgttgttatatgatttagttaaggtgaaatttactgtgagaattcacttggatatatatacttttagaaaatcatgagctgtagttaggagtttgttcatctcaagttagcatgcgagtttttgtaaaaagatttcttatacggatatgcatttctaaaacaaacttaaaaaccgactcaaatacgtatattgtatatttctaaaagcgaacgaacttagaaccaactcatacacagatgacatatcaaaataccggcaaaaacatcttcaatttgttaacagtagagagtagagaagagatagagatactcgtggatgaaaatttagatacttgtggcacgtttttcaaactgctaaacggtgtgtttcgtgcgaaaactttctatatgaaaattgttgtaaaatatcagattaatctattttttaagtttgtaatcattaaaactcaattagttacacgttattattacctcacttggcgtgaaacatttaatttttatcttcatatataggagattcaaacaccaccgtgagggggggggggagtactggtacagcagtaacaggctgggatatgttgggcttttgggccgaagcccaactcgctctccgggtagagtacacgtcaccacccgactcgtctcctcttgtctctcttcccttttgccgtcttctcctcttctctccagagtccccccaagcaaacccttcttctctctctctctctctcctctcacgcttcgctcgcggccgctcctctctctctccatccatccatggcgcaggacgacgccccggactccaccacctcctcctcatccgcctcatccgcctccgcccccgccccctccgccgcccgcctcaacgccgccgccccggagttcacccctcgatccgccgcccaccaccaccaccaccacgccaaccctcgccgccagcaccgcgggggcgggggtggggcctaccaccaccaccagcagcactaccagccgcaccaccaccaccagcaccaccagcactggcaacactacggggaggatgagggggacgccgcggcggccggggcggtgggagaaggagggatcccggaggatgtggctcgtcgggtcgtcaagcaggtagcgctcccccccacccacctgatggatgatgtgtttactgccttttgccatgctgtttggtgctgattatgaggattggtttggtgtggaatctcaagtttcaaccgataaagcttgatcttttgatcaacgcaagggttagattgggtcgtctatggagtagaaataggcatgtaggaagtgtagcttaacccagtgattgcaagtgaaacgatggaattagtgtgactttacacttctgttgatttgtctgcaagtttgatctttagttacagatgtatgcactagagggatgatgtctatagatatttgttccttaaaactgtttattgcctattattttgcttattcttgtatttctgaaactatgaggataaaaaatattacttcacagatcactggcaccttgattgtcctgtgtgcactagtaaggggctaaggtggaatctaggacgagtaaaacagggaatgtctgttagagattgctatttttagaaaatgcactgtaattctgcacttcttttcttggagaacactatagggtttatagtctatacaaatcagatagggtggggatggcgggaagggtgcatgttgtctttccacatggcgcggtctgctgcatttacgtgtgtgtggggtttgggtcgagtgacatgtctcatgcctgccaacgagcaaatatggaataacaagatatgcatgtttgtgatgtttggcaaacatgatgggcctcagtatgatttattagcgacacggtgtaaaaacgacaaaaccatatcatgtcgtcttgctgaagctcgtaattgctgcatgcatagtaccatgaggagttatactgttttcttttttgaggataataacttaggaaatagaaatagtgcagctctccatctattttatgattgtttctctttgcatctttctgaaggggagaaatggagagagaaatcaattctcttcttttgtattgtttaccttctgcatctttttactttcttattagtttaccttttctctgatcattgaaagtatgatattaacttcgtcttatattaattcctttttttgttgtttattagtgcaatcaagctgttatgggatgcttgatttgcacctatataagtggtacacccttggtttgattgtattttaaaaccttgacaggtggaattttacttcagtgatgtcaatctggctacaacagaacatttgatgaaattcatgattagagatccagagggatttggtgagtcaactgttcaatttcaaatagaccgcctgattgtgctttccaccttcctattttccttttgaaatgagaaccaccataatgttttagggttattctcacttataccttaacaaacctacgacaaaaatcgctgtccaccttcatgtctatatttttctttaaatgtttggtgccagcgataatttcaaatttgtcatgcaatatatgatgataaaattcctgtgaactactgcactacgtattgctaattaggctatttttaattgtattctactgatatagatatctttaacctgggaatgcattcttccgtatgaattgatgcacattgatattactgcagttatgcatgactgttgcaccagcattgatgtttgacaatgttctgctgtaaaaagactactggcacatttagaaatgggcgaatattatgttgaagcattctaatatatttgcaccttttgttgtaccactattggaatctgcatatacttgcttgatataactactgttcaccaaacaacagttgatacttttgagttgcatcatatcattaagtggtgtacatgaatttagcacatgctttcctacacatgatatttgttggctcatattttctgatggcattgacatgtcttctgttttccagtgccaatgtctgtagttgcatcttttaggaagatccgggagttagttagtgagagatccgcattggctgcagtattgcggacgtcagcagagctggtaagcatcttatttaggccctgtttgttttaacttaagattattgtaatctatattattaaatcagattactataagctggattataataagctgacatagaataagctgtgagctatttgtttctctagattattggaggcatctaagggtagtgggtctttagccaccaataatttggaaaatgctcctccagaggagattattagattatactaatctggcttataaatcataattatctacttgtttgtttcagtttactcctaataatccagtttataataatcctaagctgaatcaaatagggccttaatgactttttaatttttttttctttccgatatgcctgttcatcctattgttgacacttgacacagcccacccttcattttaattaaagatgcattatacgttatgaacctttgctcagtaaggaattatatttagtaaacaaattattttttttaataagtgcatgaatataagcgaataaacacacaccttttcatcaatctgtaccatcctaatttaagattcagtttaccaatctcattttcctctcattctgaatggcttctattattctctaccaagatcctaagactatagatcttcctatatacaggttgtttcagatgatggaaaaagggttagacgtcgagtgctctttactgaggcggatgctgaagaagttcaggtcagaatctaattaatcaaataaaatctattcattatatatgtatgggaactgaattttctgttatatgtgtactcagtcacgcattgttgttgctgaaaatttgcgtgaagagcaccgctatccaaatcttatgaagattttctcagcttttgggaggtatgcatcaatgcatgtctttgagcacaaatatatgccaaatgtggtgttgaacacatgatgttctatattgcagtgtgaaatcaattcgtacttgctatccacaaggtgggattgatggtgctggaacttctactggcaaagcatcaaagattgagatgttgtttgctaataaggtaatgtatcatggtatatctaacttctaaaggaacacggaaagtttattagttattgcatatacttgttctagctctgttaataaatatttgacaccatacaagaatgtgtattccaacttcttaatacttgatcactaatacatttactgtttggattgatatgtgcagatgttagcattagatttctcatgggatagtttcacattatggtagcttcatatattcttatttagtgttttaaaaaaaagttctacaaggctgcttacaaggttgcatacatacaaggtacaggtgccctaaccttgtaccgtgtaagctgcatatgtggccgattacaccacataagccctacaaggtggggtgaccacacgaaaccatgtactgttttttaaaacattgcttactatttcatagatagaagtgatgatcaaaagttgcatgttggtgaccttgtccatgtccgaaatgtcatacttgaaaagagggataagcaatgaaatactattttggaaggcatttcaagtttcaacaccagtaccttgatttcgtccctcattttttttggctttacttgcaggtgcatgcttttgtggagtatgaaactgttgaagatgctgaaaaggcagtatgtcttcttgatttctctaaccatttgttttttttttctaggaattattttgaggtgctttggtagttgccatcaacacaatttaaaggaactctgtttttctgtatacaggtttctgaattcagtagtgggagaagctggagagatgggattagagtccgctcactgcttggttgcctggtactttaacggaccctacacaatgcaacttgttctcccttaaccatggactgatttttaaaatgcatttgcgattcacaattgtcctttatgcactacttgtgtttcctgactagatcttagtcattaacatttatatttcattaatcggcaatactgggtggtttgttcattcttgatttagttacttctatatttaactgatgggtaaacattaggtgtaagcttgtttttggtcatttcatcatttatcaacagatatagctcccagaaaaacatgtttgactagcttagtaagatttaacattcctacattactatgcatgttattttatttatttgtaaaatagaagattcttaaatcgttaaacatttgttttcattaattgtcattagaaacaagccatgggtcaaggaagaagaggtggagatgaggtggatgctgcagacgaagatgaccctgaaacaactgaccatccacaagactacgaaacagaggatgcttcccagatttcagaagcacatcttgatcatcaggtactttaaatgatcctctcctgctcaccattattgtgcgccagaatcaagtgtggatattataacgacatgtataaatttcataggctgatgatggctaccatgacaaaggcgggatgaggcacgggagagggagaggacgtggtggaagagggcgtggccgtggtcagtactatggccatagccgggatgccaatcatccaattggcactcctccatcgaatcacagtgctcttgctgatcatccttcaaagccaccccctggtcctcgtatgccagatggcacaagaggatttaccatggggcgaggaaagccactcaatcctaccaatgctgtttaatggcagtggccatgccggtggcagcctgttgccctgttccctcttgcaaatctgatacttgcctcaggttccaaaccgatgaacgccgattaccgttgatactatagttagatacaacatgtgttggttcgtttggtgcaagattctgcagagaaaagttttacctggtacatgcatgtatactggtacagcagtggtgctggcaatgtgaacatgtcttttgatatctggatgctagttaatttagcaaaatatgtagatatagatgaaaaatgaggtgtctgatcaatgatcatttgcagcgggataattctgctccacaaatccaagatacccaacagctgtttaaaagccttcaacttggaaggcatgcaatttcagagttgaaaccacatctacaccagatgtgcaaatagtcttgtgcgttacatgaaaaaaaaaggagtacaaacacgagaaaacgccaggaaaatgtctcataaaattattggtttcacaaaattataccaaatgacaagctcacttcgcttgatttccatgctttggcctctgctctttcttcccgtctgttcttctcattcccttgatcaatgtggcatcgcctgcacgaccacggttattgctgacagtcacagccttcaccttatcaggtaagcctttctgcttgccatccatgacagtaactggtaggcatgactgccttcttatcctgccaatttctgctgtgtcatgcacaccaaatgctagatcactacgccatgctttcgctgtcaatggcgttgtgatcagattcttcggtgcacagtaggggagctcagggttcgtcactctcttgagtccatttgtactgctaccttggcttgcatagcatctttcagagtgtttcttggttgcattgcaagttgcggtaggagctgtaggtgtaattgcagcaactaccttctgcttcctgctcgttatggctgcagaagttgatctcctttcaatttggttcttctcattggagatggattgtgtggacactctgaatatgctcttctctgatgaagagttaggtgcaggaaacattgatcttgccgatgttttcgttgcctctgtctttcctgatagctgtaattgataaaatcaagatcaagagaagctctctgatgaagagacaatctagaaatgcagattgcaattgagcagaaaatccacttaggagctctaaactgtagcattcagtaaaaagaaaatcattcagtataatttatggagcaaattagtatataccctggaagctgaaggtttaacttgctgatgaattggtagctccttctggaaaaccatttgagatgagttggtttccatctctatggaaggaaacagtggtgtagctggaggcgtcttcagcctgaaacaagctgttcttctaaaaaaacagttccaacaacacaagtatatgatctagtcatctggatgaattgaattccatcctaccagtcgtagtcatgcttctcgtccactgctatgaggaaatctgtcttccctgacggagctttgctcgtgcggccacctatcacagatacaaattcaaaagaacacaaacactgcagtgaggtcatccatctttgaagcaatttgagtgggattttcaactgcaaattttcatattgctaatcaaatgttcatattgctaatcaagagattgtgaatatgtccataacatttctgacgacacatataggaaaaatagaaacgcaagagccgaagatgtcaccttggatagcatcaaactcaacggattgcatgggttccaggaggttgatgtccctatctttttcacgcttgtacatctccctgaagaaaactacgctctcgtctttgtctttatgtattgcagatggggcgttaggcttgcgcatcccagaaaacctcctgatgctgttcatcttcaggaaccagagagattgatttactgcacggaaaaaaaaaagaatgcaaagatcagagcatggaagaagtcacaaacattacatgaatattactactactactactactctaaaggatccaaattttccggcaactccaaagcaaccgctttaatcaattgcggattgggtatgctctttttttttcattcaaaaaagacccttttacttagtttttcagagcgcgggccttaacttaagaactcggaacgtaaaaccgtttggtgagggacctaaaagtattatctactaagaaaaggtcctttctgcaaaaatccacctgcttcatcctagccgtacgctcaagccaatcggacggcacgccagccagcggcttgcgcggacgcggaaggagacgcgctcgcgggcgacgtggatagctccgcatgcgaacacgccacccccgaatagctctcaactcaccaaccaattcagggcaggttttaatttaaccgatttgggtcacatactggaaatcatggaggcctaattcatcggtgggaaccgcacggttggcccttggccgggaaacaacattgtcgcatactcgcatgggcgttttcttccactgccatgctgtgtgttgcaacattaattcaccaaacaagtaataatctattgatttatctctgcacagaacatttagtagttcttacttcttggagatcaaatgggtggattaacggtgaagactgttttcagctcaaacatattagaaggtgcttcagcgctttgggggtatattgcagacagtatgcatagaagtagtaaacatatgatttctactattattttacgaaggccacctttggatgagcacggagaatatgcttgtgagttggttgccttgcctttaaggtgttttgctatttttcctattagcacagagtctgaaactatcttaaaatttttcaactacgcatgcatggcctattgatatgcattagttgggcatgggagatttggatgctaactttggattattttgcttcaaaaattgtgttcttggctccctatcctgatcggttgtgctatatgtgtgctgtgcaatcaaggtaaaagaaaggtctagaggagagctttgctttagtgattctaaattcgatattttagctcttatacatgtaatttttattgtgtttttgctcaacgtgcaaaaacatactttgctgtcatatatttgtttgattgatcatccatactccgattgaatctgaatgtagttcagttattggcaattgtcataattaaagtattaaactggctatgaattacatgtctgtgcagagcatcagctgagtaggctgtaaaattgctaaatgctactaagaatcaacataggtatacccatctctgaaactaagtcccctcagcattttgtctgtactaacttcccagtttattttcatgtttgtgtgtctgaaaataatatgtttttggtagtttggctgatgtatcaagcagagcaggtactcggtggtccctttgtactgctgttagctgccagtttttttatccaactgaatgtcaggtagaaggaacaggaaggaaattgggcagtaacaccattcaaaactgtatagtggagctgtggaagtatgataggtaaaagctttccgtgattgaacttcaactagatttttttgccttttgtatttagtattgtttcaatggtagttttcctatggaaatagctgtttcaggtatatttagctatgccttttttttcacggtgttgatttggtgagtagatcatctgctatgtttgctacgaatattatagttctgctcttcaatgaaatgtaaacaatgtgaattgaggttaatttacgatagttggcatgtgactaggtgagattttctttgtgtatcctgagcaaatctaccgaacatcaataaattatgcattgtacacatggtcttcagattgacggtcatattttttttcactctattatgattacttttgtgctgtttcaggtggaaccaaaatcaggtatgcatccagtcattagtttcactctgtttatttgtaatttttgttttagatttgtgtcgtaaattgcttagattttttttttggggggtgtctcaaacttcacatttgagaaaaatatattgtttagtgcattggtcggcatgcatgtatgataatcaatgcacatcaggctagcaaatctgacacgtcatcctttgagtttggtattgcagttcctgtcaatgccctcttggatatatacatacatgggctaaaatggttctagcacaaaatgtccttattcctacagtgtatgaagatacttcgttatctaacaaatgccttttctgtgtgtgcagattgtttggtggttgaacttttgacggaaatggactatggagatataaatgtgacacttccagattactgatatatgttgggtatttgtatgtaattaaacaacgtgtacctattcgatagtgtgatgacagctgacctgaattgatgaattatgatgtgcaatgtgtgatctgtattttaggttaagtgatttataattgtaatgcattgtccagtcatgtatagatatcggtaaaacaaactactatttcgctatcctactgtgtgatacggtgatagggcgtgcaacgcgcgtgaaatgtctagttgaaagaaagagcttaacttgattcgaggatttgggggtttatttaggtttttctcaatttggcggttcggggaatttccacatatgacttggttatgttggtttcaaactttctatccctcctagataattttattgtgttcaattcagagtccatgactaacacggaggccacggctgaaaaattagccccgtacagatgaaaatgtttatttgattcgatctctgatctctctctttttttttgcttgcaattttttttataatcgatattttttttatctcaaacaaatatgaaagtgaaacttctggtgattttgatgtcaacaataaaaaataatcgatttattttgttgtgctttggcacttgccaattgccacccacacattaaaaggaattatgttttgttctgtacaggtttctgaattcattggtgggagaagctgaagagatgtgattagaattcgctagctgcttgtttgcctggtaccaagtttaatggatcctactcaatgcaacatgtttccttttaaccattctatggtctctgcaaaatctggagtagtcaatggtgaataaaatgcacacacaattcacaattgtcctatgttctccacttgtctttactgaatcctgactaacacctagcagcaggttaaaaaccttctagaaggtatacaatacataaaatttcacgattgaaatctggcgcatatggttaattggttaccaacttgtatgtttttttttaagattatgtagataattttgcttgttactcctatatcattaagaaaaagaaaggagttctttccgttcaatgaaatactagccgctttcctacttttacattaaa

SEQ ID NO: 74472 - DNA, 716 bp, Oryza sativa
  unsure (1)..(716): unsure at all n locations
ctggcgnccnnnnnaatatagattctaaatcctgcatgcctgcaggccgactctagaggatccccttccttcatatccaacgtactgagcccagttgggaatgttctcgtcctccacttcatcttcttccatttcaaccccttgctcaccgtgagatgtccaacaattatagcttagcatgaaccctgactcaaacaggtggaaatgaatagtcctggatgcagaatactccttttggttcttacacttattgcatggacaacaaataaaaccgtacacttgttagcttcggccactctcaaaaaataatgcacgccctcgataaactctttggaccgccagtcaatgtacatccattgcagatccatctacatgaaatgaaaaaacatcgtacataaataaattttcgtacaataatgacagtcaaacagtaatgataacataattaaaaactctttcgacaagcaattcttattaacaatttttgaagttctaaactaatatttatgttgtacttctcttaattttaaatttaggttggtttctattttttaagattaattttcatcatattttaaactatgagaataaaatttctatatattcttcttccccacacaaattttctctctcataacttacaacaaaatttggagacaaataaaaatgtgtgaaacatagctccaaaagttatataacaacaaaaaacatttgag

SEQ ID NO: 74473 - DNA, 1227 bp, Oryza sativa
attcctgcagcccaaaaaaagaaaaagaaaaaaaaaccagcaaatttcccttcccatgcgacgcgacctcctcctcggcgactagccggcgaactcgcgcacgccacctcggcccacccaggcccaggcccacctcgccgtggatcgccggagtagggggttgccggccggagcggcggctaccaccagatggtcggcggcgggggcgagtagcgcgacggcggcggcgaggacgacgagcggcggacggatctgcggcgcggcggggcggcgggggcgggggccaccatgtctgccgtagtgtgtgggaagaggtcctcctccatcttcggcgacgagctcatcccttcctcccctccctccccatcccctccccaccaccaccaccaccccgccaagcgctcccgctgctccccggcccgcgccttcgacgaggcgactcaccgccgggaggcgctcctgcaccatctcctctccctcttcccccacatggatccccaggttcgcctccgagctctacttatatcgctattatttcgatttttttttgtgggagtttgcaattggatgcgaagaggtgaatctccgtccagtaaattatgtggcttgttgggttaaattctctggtgcctggagctaaggatgcaatagctaatagctactaccaactatgatgctgcagaaatgttgaacaatagttagatagcaatggcctatccatttttgcaaccaacctttaggaatcgaagtgctactaatatatcatgtccgtccgatctccgatgatctgatggctggccatgttttcactaattttacagtattcaggaatgtaagtgtgaatgtgtaatcaacaaatacggcaaatgtgtttttttttgtcagcaccttttgctatcttcaattgagcatgcatatactgtaagaaactggattggatcgcattcgtcatgtacattttttgcaactaaagggtgtttccatcacagctatgtggtgtttatatttttagctgtttgatgatgagtttccgcatgattacagttacttgaaagagctcttgaggcatctggagatgatatagattctgctataaagagtttgaacgagctgtgcctggaatcggctgcggtaggtgattccaatagcgtcctgccagccgctcttaagttatcggctgaaggtacgtctgttgaatttagacagttgcatgctaaacatccagac

SEQ ID NO: 74474 - DNA, 554 bp, Oryza sativa
gaattcgagctcggtacccacatgctctagcgcatgtgctgtacatgcaccccgagacgagccttggccttcgtgaataggaagcaatgaacctaaccagaatccaccaaggattgtggtgtggcaatcgaatctcgagcagcatgcttttcccattcgaagatagaccaaaatggggggagggggggggggagggtcaccacttgcttatttactctgctttggactgagtttaggcttatgtaggtgcctgggatttgaaggacgagagtgtacatatggtgaaaatagacgaactatagctaaaaatacggatttagttcggagggaggtgggaggggggttcacgacagtggtcgctgccaccgtgctgctgattccccggtcacagcttggctgtccaccgcaattgcactggcagccgacaatgttagtttggtcaacgatcatgacgctgatgaagtcgctgacgtgcccttagtcacgacgtgtgcagttggtggttgtctcccccagattgtctagcttttgatgacggatgtcaatactcataa

SEQ ID NO: 74475 - DNA, 2736 bp, Oryza sativa
cgagacgtgtggcttggctgatgcctctgggcttcccgtttcgcttgtccgaagtgacgatggaataaagagaagaggcgatccacgcaggctcgagacgaagggggtatgatgttaggcaggccggaatcatccgctagagcctcaggctgggcctgtttatggaaggccacatgggccatggcccagcttgaagccacccatctcagcatatttggcagaaaatctaattataacgcattttctagagataaactttaggtttttctttggaagggagtgttgagttgtgatccaaattcatttgcacttaataaaaaccagcttctgctagagcgaagtggaggccctgccggatcgtatcgtaatcccttttaaggtcccacctcatatatatacctcttgtaaatcgtcgtgcggcgttgtaaccttaccctgatatagtgaagatattttgctggctggtacccatggttttttctctccttctttaggagggttttccacgttaaatatcgtgtcatctatgattgatctattgttctttatcgtttgtttgcctatcgtttcctaacatggaggatcttcaaaacgaattcatgggagatgaactctgaaagtcttatgaaattatgtgtttcagaggattttacgtgtcttcgtggccttcaagaggaagatttgggttagcaaaacaaacccttatctacttatggaattggatcccgatgcatttttactctattatacgttatataagaaataggccaaccctaacccgtagggtgattgggtctgtgtctgttctttggccacccatactcatcatataggggtgtaccaatgtatatcttcttgagtgcacatgattctaaatagattgtccttctcgaactgatttatgcctatgttactcagtaattgaatcattagcatgtaatagaaccacacgtaatatttgttttgggtttgtcaccacctgttaactcatgggtaaaaacatccttaaccctagccccaaaaagttcaagtggtctaagcaactagcagtctagcactaaaaatccaaaacctagtatagaaccatcctactcggacatgctcaaccctagatgtattttctactgccacacataccgcacttgtatctagggagacaacaaggagggttcaacgagtcacgctcacgacaaacctctactctccgttgtatcgttgcctctcgtcctatccctatctcattcgaccgtgggtacaggttagggaaaaattttgcatccaagatttagagtggaaagatttagtttgtacaggtgggaatgaggcacgagaatctgacctgttaactcatatctactaatatcttaatatcttgtgtagtctcaccgtgcatgtttatttttttattttgtaaaacttttctttatttttaattaaaaataaataatattagaacttattttaaaatctaaaccttttaggtgcgccaaaaataaacattgtcagtgttatcttagcttgaaaaatgctttaggtttgaaaataagttttaggatgttttacttttaaaaataaaaattgaaaaggtttttaaaaacagaaaacctagacagtttcctgttggaacaagatacccttctatgagaccgtacctgatacatgatacctgttgtggtaccagctgcatggtacccgatatctgtgatacatgttacccggtacctgtgatatctaggatctgatacctgtaatatttgtgcaagagaatagttaatatgtctgttgtaacgggatcccattttataacagccgtctttaaaaaaaattgtaaatcccagaaataccagagtcaaccggtgactgcccatcttattattggggattggtggttttagccaatggccgtctcctctcctcacggagaactgactcgaaaccgctgagaggcaacagagaaaccgcacggactgaacgaggcggcggaaataaaacaactcgaggctggaggctggctggcttccttgccgctgcccggctgaaaaagcccccgaagcagaggcttccggttgaagcaaagcaagagcgcgagggcgccgtcgggcatggggatcgtggagacgtggatgcgggagaagcccatccgcaccttcctcgcccagctctccacccgccgggcggcggcgggggccgcggccctgctcgcttcctcctccgccgccgcggcgtccgccgacggcgagcccggcgaccggagcatcccgcagctctcctccatcgccaactccgtcgtctcccgctgctccaggtacgccgttatccggttccggggcgacgaatctgttgttctctactccactcggggtttggggttgggggatggaggttgatccaatccatttagtgactgttttgcttttgctcatccgcaacgacggcagcgcttagctcggccgatctgggtgctctcgatcggtgtgggttgcattactctaccccgcatgatcacgctgaaatagtactgaactgccagagattgcataggacccaaacttaactcgtatatttgctggtttgctcagcggatgctaaaatcagtgtatgctaatccatcattgcttattaggtaaattgatttggtttaccaatagaagagtagcgtgcttctatagttatattctcaaggccgatagacttgatttcaatgtactggcatactctccataggatcaatattgt

SEQ ID NO: 74476 - DNA, 1034 bp, Oryza sativa
tttgtcatatatatatagtgcgcaaaagcaagcccagggaactaacttgtgcggctactacgtgtgcgagtattgctactgccttgcataccaaatcatcaccacaagagagctcgatgtacatacaaataaattcaaaatttcattgggtacgtatcgatttgttgttgactaattaattcatataggttattcgcatgagggataacctcacacacaagtaatttatcgcggcggttcaagaacaactcatgggattcatcaacgaacaaatccttgatcccgagagaaatacaattcataggtcgttagcttctgagataacgcctactactacgtcgaagtcgtagctagctcggacatcataatgaattgtaattaatacatgtctatttttctatatgcatgtacacatttactttagtgtaaatatatattttggtcatatatatatgcacataaaatgttaagcgctttaatatatatatacatatgcatttgcataacatatatatatgtataaatacaaatatattatgcatgtatatgtattgaaacatatataaatataatatatctatatatacatacatatatatatatatctatatatacatacatatatatatatatatatattatgcatatatatgcatggtttatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatctatctatatatagatctctctatatagaaaaatatatatatatgtgtatatatatagagatacatatatatatatatacagatatatatatatatctttttttatttatatacacgcgcccaggtaagagggtttttc

SEQ ID NO: 74477 - DNA, 3531 bp, Oryza sativa
accaaaatatatgtacttaagtgctaagtatcaaagtgtgtgtggttttatgcaacttggactacaaaacgtgtagttttgtgaaatttactctttatttctggacacttggccattgtgagcatgtgatccctatatatatatagggcctgtttggttggtgacctgagtattgtgcctgagaaaattgcatgcctgagtttcacatgagttttgatgattatgcctgacagaaacttatttgattgctgacccgtgcctaagagatctagaaactatgattatctacattatttattcttaaacactaaattaaccatggattatttattcttcaactttgaatcaaccatagattatttactattaaactctgaattaatcttgttcagccaacactctacttatctaaagcaaacaggtctgaaggaggtcaacagaacacaaacaaataaaggcaacaacctgtagcgttgcaggatggttaattaatgcaataatcactgatcaagcactcatgctaacttgttaaggggagtactgagaatcatatgctagccacaattggatcaacttccatagcttactattgtctattgtagttatctttaatttttaaatacactgacatgatcatgtttctgctttgtttgaccactcttatatgatttaagttgtaatttcttgttatgcctgacaaacttctaacaagtttcttctcaaattaacattttcagggttcttgctcttgcaaccgaaaccttgcagcaaaactttgaagttgactatcccgatagttgtaaggagtctaatacatatgcaaaggaatttttagagtactgctgccacaaagctctccatgaagtaactacacgtccagatcatttggctgataagaatcttcgccgtttaatgtttgatatgatgcttgcgtgggaacacccggtgctgttgttgaggatgaattatcagaaaatgtgagaaacatttctttctgtagtttgttgtaatattcttacttcttcgttttatcaaaatgtttatatttcagcaaaagggaaaaatattgccaaatctgcatttttagtgtaaaactttcacaatgtatgagtttactctacgatgttcagcagtcattctaattgtgctatgatggtcagcattctgctttgcgtacaactgtggatattgaagatgatgacgagggatcaattttttatgcaaattccacaagattggcggttcaagttagttctgtttacaaactacattgctttttctaacctggaaataattcttcactgtgcacacacatgatcaattgcggtccattttcaggtcaatgacaagaagacagttggcttaggtgcttttgcacgaatagcaccttcatgccctataatagctgacttggttactgtccacaatctgttcgatgcactcacatgttcatctggtggccgcttgcactttttcgtgtttgacaagtatatcaaaagtttagacaagtaaggaatacaacttattagattattgcgctctcaaaattcattttcacttctgtttgtcaatgtcttctgaatctgtgcatagttatcttgtaatgaccgttgaaaacttgaaagagtgattgtgttgagttgaactatccgtgttctaactctgcatatggagtttcacagcagtaggtcttctgttgtaaaatggatcttctttccggaacataactggtcatttattatagataattgaattgctggttgggcaaaactggtgaatgtttcacatgtatcttggatattagtgacaaaatacgtggggagggggttctagatttttggtagttctttctgcttcaaatctatcgttgtgattgagtcaataaagacactgagaggagtattattgctattcttacgtacagggtattcagatctgtcaaaggtatattgcagtcaccgcttgcttcaagttttcatcttgatgctggggaatgtatcttagctatggatggagacaggcctattcatcctgtttttcaacacattggaatatcagcatggccaggtgaattagttaaatttgcatttgatttctcaatttgcaaccgtgcttcattttggcaagttactgatgttttcattctttttcgcaggaagattgattcttacaactcatgctctttactttcagagtatcaaagtgggttatggtgacaagattgttaaatatgatttagcaacagattctgatcaggttatcaagcgtgattttactgggccattgggtgttcgcctgtttgataaggctgtgatgtacaaatcaagcactttgtaagtattgaaaggggaatgattctccaataggaccaatttctgttttgctaagtattgattatacttctatgggttgccatcagaactaacaatacattatttgcagaacagagccaatttattttgacttccctgaattaggaggtccctcacgaagagactattggttagcaatcgctcgtgaagtattgcaggtgaataaattcatcaggaagttcaatcttgaaaacgttcagagagcggaagcactctcaaaagctatcctgggcatcttgagatactctgctgtgaaagaagcttttcatatttctccttctcactttaagacaacactcacttttagcttagcagaaaaacttccaaaaggagacatggtcttaaaagccttgtatgctaactactttcaactgttggacacttcgttgagtcatttggtgactgagtcacccgttgacaataggctgcagaaccattcattaccattttcattatatgctctctctagaatgggatttatattactgaagagaaaagatgaagctcaaagtgagataagcttttgtgctgtttgctttggtgtaacaaaatctctagaggctgctttggaagagtcaatttgttactctgagagaatagatgcagcacgtgcaactatagatcaagtaaaggtggaaggtgtggatgcaaatcttgccctcatgcaggtactttggtgataaatcaacttaaattgttcttattggtttgggattgaatggtttctagagtgcagcaagaaaagatagcacgtttcactagttatttggtgcaatttcatgaactttagtgtcacccagatgtctactacaatatcatgcacctttgttgtgacttgagttctgatggatcgcgcttatattccaggagttacttttcccattcactcaagtagtcaaactcacttactcattgaccaagtgggaagatcctctgaaatcatttctgttcttagcttttaccctgtatgttattcaaaggtaatttctttgtgacttttggatcttagaaagtatgcttagaaatatctcattgcctaacatattcctttttgttatgtaggggatttattgcttacatgttgccctcattttttttggcatttgctgttgttatgctctggcataagtacaatggaagggagcaattattgggagtg

SEQ ID NO: 74478 - DNA, 13215 bp, Oryza sativa
tggatgccgattgatggaataggtgttttttccattctacccaccatcggtcgaaggctgtacttctcagcatcctaaacttgatattatcaatactgcctagaggtggccctgacagatttagcagccgatccatcataaggaatgatgtaatctctcctctattttgaatttggcaaagaataagctaatcggcagttgacccatgccgaattgccttgcaacgcttgtcgggtggtagaatttgtaagtcatcttgatgcttttgccttggtgaatgccgacaggaatgatacaagggctgatagctgccgtaaagacttctctggatttatcgtatttttcagaattgactttgtcaaatcgaaaatcatctggcagttcaaaaataccatgtccttcgtatgcaaaccagattcttgaattcctgggaaacccgtcatagaagtgattgaaccactctccaaagggttcagtcgatagcttggatacagtactgaccgatgctgcttctccaaacgatctgcattggcgtgtattgattacttctccatcatcactggtgatcggctcaaatcttgggaagcttacatcggctaaaggtggtcaattggcaaccagtctagtatgcaagtttagccaagtctgaagtaaccaccatggacctcctgtaccgatcgtttttccagaggctatcttgtcagttgcagtattgagggtttgatatagatagccaagtagatacttggcaagaggaaagtgtttcttttctaccaggttttcagctatcctttgccagtttgcagttggaccacaacttgggccaccgaataagaatttttctaaccacatcatgataaaagctgtgtgttctctttgggttactggcccagttcccatatacttagccatgtagcaactccagcctccaatgcttctggttttgaactcatgggtgagttggttgttgaggctggacaggttagctgatgaggtgatatctaggccagtaatcatggtaacatctagcagagttgcggtcatcagtccttgtgagaataagaaggcattcatagcagtggaccagaagtaggtggatgctgccatcatgggttcatcccttgccatattagctgcagttaatgccaaagcttgggatatgccgatttcgtcccagtgagtggatttgctggccgacatcctcttgtaccaagcaggccaggtggtttcggcatatggccaagatttgaaggtacctttccactggctgagatctgggttagcaaatctgaaggggatccgattagtttcgccgtttataaactcaatggggtctaagttaccgattggaccaaggaaaagctgaagattatcggcaatgcttgggacagcaatttgatgggcaagatgctgcgaagaaggtagaatcgaagattgagaaaggaagtgtggagattatggatatcccatatctacacggcgacggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactccttcccatatataaggggggtccgggcgcctctaggggcggatgttgattttctctaaatcatacaatcaataacacactcggcggattcatccccggacaggagtagggtattacttcttttataagaaggcctgaacctgtataaaccctttgtcttcaaacccatacactttcctagcttgatagccacccccttttattattgccgaaatctagtttcgacagttggcgcgccaggtaggggtagcgtcaagcttttcgccgatcagtgcaatgggttccatctccggcatcgacgacctcgtcttcccacccgggcagacgtttcggttcggcagcctcgacttcatcaccaacaacttcggcaagatttctctcctcgactcggaatcagaccagtcgggagagaaccagatttcggtcccgtttggattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtcttcaccacgacagcgtcttcatcctgtaggcctaggcggaagtcggcttcaacaccgatttcgcctagcttcagggaagtcggcgtcatcctccaaccactcggcacggtttcgacagatcagctggatgactacaacagctctcccaccgtcgactcacgtcctactgacatcgtggagtacgacgaatttagttctcgctacaacgacttcgacgacttcgacggaagcctagatgacaactacacccctctctactttggcgttttcatggccaataatgagacggaggtgcaacgccaagcccgggagaccgaagaacgtcgctgactggaggaggagcatcaagcacaagaacaagaacggctacggcgcgagcagcaggaccgtgagcggactgcgaaggaggctgaggatcgacgtcagcgagctttggaagcagggcgccgagcgcgtgatctcatcggtcagcaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgattgcggcctcggtcccagttaactccgaaagcgtccacacgccgactggcagccgagttccccacttccgatctcatgactaccgtcatccaagcctcagcatcaccggcgcaggatccaaccgcaggagcaggggtcacgacgtgcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggaccgccacgacgacgaccttgacggagtagcagccttcaccgacgacctgcgtcgagtggattggccagccggcttcaaaccaactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggcacaattggatcttgggccgaactacgcgaccacttcatcgccaacttccaaggcaccttcgagcgtcccggcacacaatatgatctctacaacgtcattcagaagtccggagaatcccttcgagattacatccggcggttttctgaacaacgtaacaagatctccgacatcaccgacgacgtcatcatcgccgcgttcaccaaagggattcgccacgaagaactagtcggcaagtttgggcgtaagcctcccaggacagtcaagctcatgtttgaaaaagctaacgagtacaccaaagctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagagcaaagcacatcaaggaagaaggatgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctctttgccaagaccctggatgatatgcagatccctcgctccgagttaaaaccaagcaatgcgccttttcacggagtgattccaggattatccgcaactccactcggccagatcaccctcccggtcacttttggcactcgggaaaactttcgcacagagaatatcagcttcgaagtcgccgatttcgagacagcttaccatgccatactcggacgcccggcgttagccaagttcatggccgtcccgcactacacttacatgatgatgaagatgcctggtccccgaggagtgctatccttacggagcgacatcaagcaagccgtcacatgcgacaaggagagttgcgacatggcccaaactcgcgagatggcgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaaacgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaagtcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggactaaaaaacgcaggagcaacttatcaacgtatgattcagagatgcttttcaacacagatcggccgcaacgttgaagcctatgtggatgacgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctgttgaagaaaacagataacttccagtggggacccgaagcacagaaggccttcgaagatttcaagaaactcctcaccgagccaccaatcttagcctcaccacacccgcaggagccgttgttgctgtatgtatcagccacctcccaggttgtgagcacagtcttggtcgttgagcgcgaggaagaaggccatgtccaaaaagtccagcgaccgatttattttgtcagcgaggtcctagccgactccaaaacgaggtaccctcaggttcagaagctgttatatggtattctaattactactaggaagctatctcactactttcaaggtcactcggtaacggtggtcacatcatttccactcggtgatatactgcacaaccgcgaagcaaacggacgtattgctaagtgggctttggagttgatgtctttggacatatcattcaagcctcgaatttcaatcaagtcccaagcgttagccgattttgtcgccgaatggaccgagtgccaggaggatacccccgcggagaacatggagcactggaccatgcattttgacggatccaaacgactttcgggcactggagcaggagtggttttgatttccccaactggagaaagattaagttatgtgctttggatacacttttcggcgtcccacaacgttgccgagtatgaggccctccttcatgggctgcggattgcaatttccctagggataaagcgtttaattgttcgaggcgattcacagctggttgtcaaccaagttatgaaagagtggtcctgccttgacgacaacatgatggcatatcgacaagaggtacgcaaattggaagacaagttcgatggactcgagctcagtcacgttcttcgacacaacaatgaagccgccgacagacttgccaatttcggatccaagcgcgagatggcgccctcagatgttttcgtcgaacacctttatacaccgactgtacctcataaagatactactcaagatgcggacactcatgacgtagctctggttgaagccgactggcgagagcccttcatacgatttttaacttctcaagagctccctcaagataaagatgaagccgagcggatttcaaggcggagcaaactttatgctatgcatgaagctgagttatataagaaaagcccttcaggaattctgcaacgctgcgtatctttagaggaagggagacaattgctgaaagacatacattctgggatatgcggaaaccatgctgctgcacgcaccattgtcggcaaagcttaccggcagggtttcttttggcctactgcagtgtccgacgccgacaaaattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgataagttttccaagtggattgaagctaaaccggttgtcacaatcacagcagataatgctcgagacttcttcatcaacattgtgcatagatttggagtgcccaatcggatcatcactgataatggcacacaattcactggcggagtttttaaagacttttgtgaggactttggaatcaagatttgctatgcctcagtggcacaccccatgagcaatggacaggtggagcgagccaatggcatgatacttcaagggattaaggcacgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaagaccgagtggatgacttgcaccgattggaagaagcccgcgaagcagctttgattcggtcggctcgatatttacaagggttgcggcgctatcataatcgcaatgttcgatctcgtgcctttttagtcggtgacctggttttgaggaaaattcaaactacacgagaccggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaacatcaagttttcttcttgaagttgtcagtcgggggctatcatcataataatggagtgtgattttttatcaatttaatttgcttacttggtctatcattgccttgtttggttttttctacttagtttgcgaggactgaaagtttctaatagcttatttgggttttaggctcaacaaagcttgataaaaacttttaagaaatcaaagacttggctagaactatcaagcacagcataaatacaccagtatagtacaaattatgcctccatttgttccaatcatactcagtcagaatcagtcctttcatcatcagagttatcgttactcggctgaaggtcattgttgcggaattgatctaccacatcgcttgcaatcttgtcagccgcattttgagcattgttgataagatcaagagcagcttcttcgcttgtcccatctgcaaatccatcaatggtgtcgatttcaattctcgggtacaaggatttggtcatcgctaatgccatgctagctcccatgcttccagctttcttgatgttcttgaagtatacatccggtgcaactcttagcttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgagatttgattttacggtctacaaaatacatttataataagaatctgctgcattaaagagaggacagttcaaattgtcagttggcagtaccttcaacctccttcaaggctgagtccctttccgcagccagttctaccttgtctcttttcaaggcttcaatctgtttctccatctgagccattctggtggcttgcgctgtttgaaatccaagtgtttgaggatgcaattatgacagcataaatcaatggaacagatctggatgattaccttttgatgaaccacttagctcgaagtttgaatcctggagctgggcaattcgatcccttaactccttctctgtctttttggcgcactccttggcctcatgcagctggtccctaactgcttctagagttcccaaatgaggaaccagcttttccaaagttgtagtcttggcctcattgcgaagatggattctctgcatgatggatcatggttcagttctgctaaagagagaacaaagttattaaaggtagtcacccggaagatttacattcacaatgcgagtggcttctccaagtgctttcttcagttggcacacttcctcatcttctttttgacgatttataacgatgccggcgacttgcgagttctcgtcccaccatttgagcaagataggaggacgggagtcatcagccgcctttatgcgaggaattgtttcttcgtcatcgcctagtgttcctgatgtatttccaagacattagacgagtaagctgaagttatttaaatcggcatcacttgataagatatgttacctgaggatgttcctggctgaacatgaggtggtccttgttctttatttagagacccaatcattgagtctttaccagcctctggtccttgggaagttgtcgtttgcgcttcaacttcagggatttcttcatcgggacctacatccgactggtttccagtcgggggctcttgtgttgttgcagtttcagctgttgccgactggtctccagttggcggctggtcactcggatcggctttgtcgtccgaatcatgggtgccagtcggctgcctttcggcagtcggctggctttcggcagtcggctggttttcggcagacggctcagcgtctttggataaatttggctctgtcacagccggatcaggatcttttccagttggatctatgtcggacggtttcctgcaaagtgttctttcgatattcaacgtaatttctatgagagaagcatatcaaagggagatggtaccgagaagtttatacctggaagatgttctaatctttggcatttgacggccagccagttttttcctgggcatggtatgctttgggagtttgttgggtgtgcccttgtccccagatttgttgctgtcatcgccctcatcgtcattaagcaccagctttctcttgcgaggacctgtctgcccagccggtttggaggtttgaggttgtgggtctgacctgattgtcggccctccacttccctgaacggtgtgctggcgaggagatcggcgctgagcaattgggggatcagatttcattaatacgtattcctgaatgagatgcttccacggttagctaactcaacatgaagatgaaattatgttttggtcatgggttgaagatttcagatacatacctgcggaggcggattgaatgcgttatatggcacaactggcagctgatgtgagtagctaacgacgatggcatttgagaagattttatacattctctccttcatgattttgaaatccagagagtctggttcttcgcgattaggatcatgcttgccgtcaaactcaaaagctgtacgggatctttctttaattggcgccagtcggcatttgatgaaatgccgagtgatctgctctccttgcaagccttgttctttgagttttaacatgcgatccaacaattccaaggcttgggcagcttcatctccgattggaagagagttccaagtatcttggtacaccgggggaagacaagagtattcgggaagagcaggctcaggattctgaacataaaaccagttcgcatgccatcctttgtttgaagtcttgaagggcattgagaagtatttctggctcagagttcccctcagctgaaatccagcccctccgactacacatggcttactcttgtttggttggggtttaagaaagaagattcggcggaacagggcgaagtggggtttgattcctaagaaggcttcacagacatggatgaaattggcaatgtggactatggaattcgggtttaggtgatgcaagctgattccatagaagtttaatatcccgcggaaaaatttcgaggtcggaagagcgaagccgccatagaagaaatgcgagaagactacgatctcatgtgtatcaggggtcggaaaagcctcaccgcacgctggccgccacccgatgatctccttggctgggagaacgccgtgcgccaccatctccttcaggttctcttccgttgcgtcggacggcgcccattggccttcgaagctttccttctcttccgccatcgattttatccgaatgcgctgatttgattcgagggatggctagggagaaatgagggattaaggcggtggatcacgggaaggattttgatgcacttttcgaaggtggatttgagtggagtggtgaaccctagttcgccggcgcagttctgcactgtagcaaggagtggggaaaatggcgagagttccggcggggaagacgaagcgtcgcttggatctcgggatttattgttaagggtatcggaggtgcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacagaagctgtctgggttaatttggaatgacttgtttttatcatagtcacttccttggtatgttatatacctattttcattatggtaaatagtcatagcctaggctattagacttattcattaccataatttttataatacttggtgggtaatctttagagttttatattcggatgcctgtccagtgtgttcattcgtgaaccttttagagtgtaaaccactcggactcttttcattatggctaaaaagcagtcggctggcatgcctatctaggcgccgtgtatgcttttgtcatatgatgcacaattgtgttattattttgtttctcaactatatgtttagttcgttaactaatcacatagttgggggctacacctaattaggtgcatctattcgatgcaccatatttttatcttttcgccctttacagtcttcgtcttcgctactcggcaggccttggcatgataagttttgaagcactcggattattatctttgagaaggctctgatggttgactgcaaaggtctcgggggctactgtggagattatggatatcccatatctacacggcgacggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactccttcccatatataaggggggtccgggcgcctctaggggcggatgttgattttctctaaatcatacaatcaataacacactcggcggattcatccccggacaggagtagggtattacttcttttataagaaggcctgaacctgtataaaccctttgtcttcaaacccatacactttcctagcttgatagccacccccttttattattgccgaaatctagtttcgacaggaagaagaaccaatccaataacagagagaaaggagttttagccgatggggacatacctcaacatatttcgcggttgacgcgctcagagggctggcagaggacgacatgatcgcgaacagaagttgatgcttgcgagaattgcctctagatcaccggaaagctcgaaatcgtcaccggagagttcgaggagaaggattggggaaagttttggctagagcgctgaaaacgggagtaacgccgtgaaaaacaagaagagcggtggttattatttaaaagggagcgcggtaacggccaaaacagagtcggtaaagaaaaccctagatcggctcggagaaggagattaagcaaatccgccacactacaaatatagcggatttggggggcatgtgttgacaaccaaatttggtaagtcatgaaccgggttcgacattaggatcgaggcggat

SEQ ID NO: 74479 - DNA, 1448 bp, Oryza sativa
tggtggtgattggtgaagagtgatgactcaaagctttaaagtaaatgaggatggcagcattcacagtgaatggaagtagttggaggcggaagtggcgatggtgatttgggagtagaggaggacaacgacggtccagacgtgtgagggtagatgagtatgcagggttatggttaggctatgatagtttaaaagaaaatttcttaccatataaaacaggaaccatgagatgctgagcagcggtacaagatttggagcacagcaaactggtttgacaaacttgggacaacatatttgaagtagtcaatcctagcaacttgatcgtatcctcctcgcatgaatgttttctcctcgcactcactcgctaatcaatgccacaacatgggcggactactgctatccacacgtctatgggtggaacgttgtgtgcagacacgtctacctacagctagtgtttggctcgtgagtgcaggggcggctagggtttatcatgatggttcatgtacttgcatgtctcatttaccccctcaaccgtcgcccttgaatgaatagaacttctaattggacctccaaggaccattaggacgcttacctagatccctatccaatcaagtcatttcaatacattaaatgtgtgacccaataggttcgtgtacactcactacatgtatcataacagacctagatacttcctttatagcaatctagttacgtgcagtagcatttgacaacctaaagttagccaatatgcttgttgagaatcatgataccacctatgatatacaatcaaggaggatttagaaatagtagcatattagatgaagagtatcacgaataagtcacatattcattgatcaatagtaagtcatctatctcaaggaacacttcattataattctagacaaagtatgtgaaacaatcatctcaatgattgcctctagagcatatcactaataagggacaacaatgttgcttgtgctttggaggaaatggggatggtgatggtgttagtgtgtaggcgatttgggatcggtgtccaatgtgcggtgagcagagtaattgtgtgagggagatagatgagggtgacgaaaatgtgatgcttttgacaatggccagtggggcatgggtaaggaaatggtacatgtatgatagtacttagtgccataaggtttgtagtgtaaaatttgaacatttttagttaataaagggactaaaatggtcaaatagttaagggttgaaatgcaaaattttatagaggaagtgactttgtgctatagtctcatctatggttttacaagtcatgttctctcatacataaaccatctttacaagcggtcaaaacataaatttgtaaacgactatgaggcccacatgccccgaggtgtctgtgaaaatcggtattttcccaaacaggtagctgaaccgtgtacgaaaacagattttttgcataa

SEQ ID NO: 74480 - DNA, 10079 bp, Oryza sativa
ttagctctgttatgggatgagtcagtttttgtggatattaaaggaatgaatgaaaggtatattgatgcgtatgtgcgtttgtccccggatgctcctatatggcatgttacttttgtatatggtgaacctaaagttgagaacaaacatcacatgtggtctctgttgaacttgctgcgacaatcatctactttgccttggttggtgatgggcgattttaatgaaacactttggcagtttgaacacttctccaagaccccacggaatgaaagacagatgcaggcttttagggatgcccttcatatctgtgagctacatgatttgggtttcagggggctaccatatacgtatgacaataagagatagggagttaataatgtcagagtgcggctggatagggcggtggcagatgacaattggagtgatcggtttaaagagtcacaggttgaacatctggtgtccccatgttcggaccatgcccccattctgctgaaatttgcggttgaagagagccgacgggttaaacgcaaatgtctgcattatgaaatattctgggaaagagagaatgagctcccaaatattattgacgaggcctgggcagtagcaggtgataaaatgaacttatctgaggtccctgagcaaagtcatgatgtccttacacggctggagtaagaggaaatgcaagaatgtgggcagagaaattgagaaatgtcgaaaggagctagctgccctactggaatcaaactcggatagtttagcgattcggggagccacggataggctaaatgaacttctatacagggaagagatgttatggctccagcggtcgaggataaattggcttaaagaaggtgaccgtaatacacggttttttcatagtagggctgtatggcgtgcaaagaaaaacaaaatcaccaagcttcgggatgccaatggagttgttcatagttcgacaaaagtaatggagaatatggccacacaatattttgaatgtataagagagatgaaatgcttgatcactctcctataacccagcttatccaagggaaagtcacggcagcaatgaatgaggagttatgtaaggatttttcggacgatgaaattgcaacagcagtttttcagattggtccgctcaaagcgcctggtcctgatgggtttcctgcacgggtttatcagtggaattggggtcttttgaaggatgatatcagtaaggcagtgaaggttttctttgatacttgggtcatgccaaatggagttaatgagatggctataatactcatccctaaaatagaagccaatggaactaaaagactttagaccaatcagcctttgcaacattatctataaagttgtctccaaatgtctggtgaacaggttgagacctttgctggatgagttggtttctcaaagccagagcgcttttgtcccggggcgtatgataacggataatgcccttcttgcctttgaatgttttcacagtatccaaaagaatagtaatctgaataaaggagcttgcgcgtacaaactagacctctctaaggcttatgatcgagtggactagaaattcctggagcaggcgatatacaagttgggtttttcttgccggtgggttaactggatattggagtgtataaccacggtgaggtattcggttaaattcaatggaaccctgctatctacacttgctccttcgcatggacttcgtcagggagaccctttgtcaccctttctattcctgttcgtagccgatggtctatccttgctcctggatgataaagtggccaaaggagaattaacgcctgtgcatatctgtcaccgggcgccggggatatcgcacctcctgtttgcggatgatactttgctcttcttcaaagcaaacgtccaacaagcaaggatcatcaaaagagatatgcagcagcaacaagccaattgattaatcctgcaaaatgctcgattatgtttggagagtcatccccggtggaggtgagagaagctattaagcagaaactgcagatcgctaacaactcctttgaggataagtacctgggtttccccatcctagaaggaagaagaaacaaaggtaaattttagagtttacagaaaaagatctggaagagggtgctccaatggggagaaaacttgctgtcaagtggtgggacggaaattttcataaaatcggtattgcaggcaatccttgtttatgtcatggtgatttttcggctgccagattcggtctgtgaggacttaaacagattaactaggaacttttggtggggggctaccaatggggaaaggaagatacattgggggtcatgggacaacctgatcaaaccgaaaaaccaaggtggacttggttttagggatgttaagcttttcaatcaagcacttcttgcaagacaggcttggcatctcattgataaccctgaaagtctctgttctagggtcctcatggcaaagtacttccccaatgtttcccttgttgatacttggtttggaggcaatgcctctccggggtggaaggacatcgagtatggcccgtccttgctaaaagaaggaatcatctggcgcattggtaatgggagatgtgtgaggatctggagggatccatggctgccaaggaacttctcaaggagaccgatctcgcaaaagaacaactgcaggttaaaatgggtgtcagaccttactgcggatggtgtttggaatgaagagaaaatcaatgaacttttcctatcgatagatgctgaaataatttcaaaaattcgtatttcatctcgggaggaagatgttttccttgcgtggcatccagatgtacacggcaggttttcagtgaggagtgcatactatttggctctgaatctcgcgaaccagaatgtggctgggccgtcttcgggaggtggtaacaagtcttggcatctgatatggggatgtaatatcccccagaaggtgaaaatttttgcatggaagatagctaccaactcccttgctactttggttaacaaagcttaaaggaagctcgagcgtgttgccacttgtgtgatctgtgggttagaagaggaggatgcctagcatgctctttgccgctgcactcaatcaaaattcctgttactagcgatgcagagagccggttactttccaagattttcagatgattatagcgacaacccttcttggttttttatgcatctggaacggctttcggactcagagcgtgctgcttatatgatggtgatgtggcataattggttcatccgaaacgagattgtcgatgacaaaattcctccgtcgattgatgcctccaaaagattccttgagagctacattcaaacactgtttgaaatccgacaaaagtcgagggatgtgtcaggcaagggaagagttctgagattgattggaataggaagctccttgcttcctccgggcctggtttggcagcgaagaagagatgggtgaaaccatagcgagggtggatgaaagttaatgtggatggttcctttgatgccctgaatggaaatggggggattggtactgtcatgagggattgggaagggaaggtggtcttagcttcttggaaattcctcaagactggcagtagcgcacttaaagcagagctcttggcatgcaaggagggaattgcaatggcacgcacctggacaaactatccagtttaggtagaaacagattgtgatgtagctgtcaaaatgatgcagtccaaggacaaagagctctcagagctagcctatgtgatacgcgagattagagatctcctcgctggaaatcgggaatacacacccaggaagacttacagaagccaaaacttagtttttttttactggaaatactgtcaggactttgcctcgcagtgtaattttataaattgaaaaagttatttacaaattataagagaataaacaaaagagatcaaaggatcacattgtttgtaaccaatcaaaaacaatctgttttagcggatccttcattctgcacaaatgcagaagaacttcggctttgaattaagccctccaagaactgaacgagggaagctcattgtgaaatttttttccatttcatcgcttccaaatgtgccaagcagcaatgaagaaaatttccaagaaacctctctgattgaactgaatgcgagccaaaaccaccatctaaaaaaattctaggccaggattccatgtaattcccaaatgttgccagcaaagttgactgaaagggcagaagaaaaaaagatgttatcttgtctccttgatattattccggcataattcacaagtgagatcatctttttcctttgcacaatgtcgcctatccagcatatctcttgtgttaagtctgtctctgaataaaagccaagcaaaaactttaatcttcattgcacatttggtcttccagatccagacaaaaggcctcgacacatgcacatttgagtatgtcagcttatgaaacctcttagctgtgtatttgtcagagttccggatgaaagaccattcatcaccattaccgttcagcagagagagaagaccattcctcctctagaacagtgaattctccataagcctgggtgctcaggggcagtaaaaaacaatcctcaagaggagtagaacctatttgcttaatagagagagttttatctaaggcaaccatatataaagatggaaaagcattgcttcttatcttatcattccaaatgtcatcctagaaaagagctgaagatccagtcctgatatggcagtttgagattcccctgaaaacatcagtcagagccactatatccctccaccaaaaagatcctttattccaaactaaatgtggcactttagagctataataagagttccatatcagttgaacccacggcagatcatgtcctttgtaaaatttgactagatgtttaagcagaagcgctatattctgaactcttagattgatgactcctagtccaccttcatcctttggtctgcacactagatcccaagaggctagagatcttctggttgaagttggattgtttcccctccaaaggcaatttttccttgcagtgtcaatagcttttaccactgaaacaggcagctgcaaagaacacatgtagtatgttgggattgaggaaagcacagagtttatcaatgtgagtcttccaccttgtggcagaaattgtgagcttgctattaatcttctttctaccctgtctaccaagggtgcaaaatccactacccttggcctagttgttcccatgggcaaacccaaataagtaaaaggcattgtgcctatggtgcacccaagcacaccagcaaaaagccctgcattctcatgagataaatcgattgggtagagacaggacttatgataattcactttgaggccagtagagtgtgcaaatgaattcaacaatgccttgaaacaaaacacctctctctccgaagctttgagaagaattagagtgtcatcagcatactgtattactgggaaacccttctcatcaagttcattaattggcttggtcaatagactgttgacgtaaaacacgaggcctgggagatccgcttaactccagtgcaggtccaaagctcgcctttgggtttgttagcgtgccagttgatttgatcctgcaatcaacaagaaatagaaacaaagagatcgcggttaaatctataaatgatagccaatcagctaagtgccgatgacatatcatttatctttgagccgatgtcatatgtaaatcgatcggtgactataaatagataataaagaactaaacctactcgatcggctgtagatattaccaatatatagttcttatatcgatatatatttaaatcaagtgattgggatagatcggtcaccatgccgagacagtataaatcacttggatcgaaatatatattaataacaggactatatatgtttatagcatagccgatcatatagatctagcatgtatcggctaatactccgatactactctatatcaggatattaaaacaagtataatatatcaaacaaaagcttaatatacttaaatgaaataagatcttggcataaagggcggatttaacatgtcactgaagcatatagagcgaatatggttaaatcagataagaccgactgaagctccgatactaccctaatcggcaatcagaaggcaggctagagattgatattctaagcacgacttgatagatcaaactcaactaatgcagcattaagtataaaaaaatgaataatatctagacaatcaagccgctggaagtttcatagagtggtagatatcttatataatctaaatcaacatcaaaatctaacctaatcggctgccctctactaacagatgttagccgattataggttagatagcgatcttgccagagattatgtacgatatatgataacttgatgaattacgtaaacacgattagagtatcataaagatggaagcactaatcccgagaacacaagccgtcataacaagttttacctcttattgaagatcgaaaccgatgcagctcaacccgaaagcaagaacccgtcgaaataaaactaaagcaaaaaggtggcgatgcgccgaaattgtattgaacgtgtgtgttttttattacatagggctcggggtctatttatacccgagaattacaagatatgtccataccggacatgactattatctctaacaaactctaagataccataagtctttgcggcagacttttgccctaagcatatctctatggaaattacataaaacatcctaattaatagatacaattgccttttcaggtctctatccacgtgcggcaatcatcttgaagcatatcaactcaaacccaatgttggatacgagtcatattgctggaatcggctgtatcacctaacccagtctgattcagatttagccgattctagtcgtagccgatctggactccagccgattcttactctgttcccgcaacaatccttatctctggttccgcttcgatcccatcttcacctccgatgctgatattaccaaatttggtcgttaacacagacctaaggagcaagctttgttaattattctctgcagcaactcagcaccaagaacaaaaaagcaatggtgagagtggatctcattgcccaaccccccttctgcatttaaaagagtttctaggtaccccattaagtagtactgaaaaatgtgccgtagaaaaaatcatctgtatccactgtagccacttttcaggaaaccccatacatttcataatggatatcaaggtggagtgctctatagaatcaaatactttagcaatataatttctctctttgactactggcattgatgaatatactctaaagaccatgctaaacagtcttgaattgtcctgcctttgataaaaccatattggttctcatgaaccagtttaggcattacactctgcaacctatctgccatcaatttggttatgaactttaaactgatgcccatcagtgaaattggcctgtaatcattgactgtttctggagaggacttttttggcactaaggttatgtaagacatgtttagcagctgcagatctgtatagcaagcatgaaagtgagctgctaacctgtaaaagtcctgtgatatgatttgccaacatttcttaagaaagaacccattaaacccatcaggtccaggtgctttgtctgatggaatgaccttaataagactgtccacctcctaagtgtagaactgattaaccaaacaatccaagttttccggattggggaagagatccctcaaatcaaagtccattggaggcaagagcgaaattcccattctgtttttgaaactatgaaaaaacagatctgctttgtgattgtgtccagtggctatctgcccatgctgatcctgaacctgagaaatggagttcgatctatatctttccgtagcaatggcttggaagaatttagtattttcctcacccaataatatccatctattcgtgctcctttttttttccaataaagccttttaaactcaagaagcataaggatctgtattttgataatttctctgaagttccattcaaggatggacaagggccgatgctcttctattaggtctaggaaattgattacagcattacaattaaccaaaagggcagttaacttagacaagtttttactccaatgtagcaaacttttcctcaaacactttagcttgaagctaatgcattttgccggatcttcataaccagggtctattgcccatattctgctaacaagctcaaagaatccttccatttcaacccaataattctcaaatttgaaaattggagactttggaatcttggtatcaatttgatctacacagggcacatgatctgatatattcctggtcaatgggtggacagtagtgtttgggaaaaccaaagtccaagctggacttgtaaagatgtcacgcctagaaatttaacctaaatttccagactattttgcgtagtaaatccctgtccaggaccagccagggtacgcaaaacgacaagtaatatacagttccaaacgtaaataaagcgtaaaatacttacggaagagacacttagtcctcacaccgaaacagaacgacagcagcggaaaaaggcgatcctagcggggcttcagctccactccacaggcaaaactcaactggggtctgagccttggtcctctaacttcgtcttcagctcagaagaactacacttctgaaaaggggaaataatagcaaggctgagtacaaccaccgtactcagcaagccacaccaacgatgcagatgtgcaaggggatacaaggatggtttgtggctatttgcataaaggcagttgtaaaacattttattgagcaaaacagtaaaacggttgagtaattaaagtaatattgaatctccactgatcaacgctacaccacgttgaacaggcccaaccaacccacctggactacagtgcattgagtcgatttattaaggtgggactaatcacggtgaatctggtcgaccgcccataaccgcgggcacggctattcgaatagttttactctgatcagaggtgtacaactgtacccacaagacagccccacgacacgtttccgtgcaccgacatgccaccacgacatatcggaaagaggccgtgacaggacccttcgtataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccatgaagcatggccagatgtctcgagcacgcagctcattccgatactaaaaggtctaatactgtaattatcccatcaactgagctagtggtaattaagcatggctaagcatatagttctagctagttcacataagtaacatgagctagtcgattcattacccaaggttgacaaagaacaaatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggatcttctgaactcttatccttgcgaacgcgaacttccgaaacaacggattctacacgctggcgcgcaaaacgaggaaaactctaataaaaaccaaggaaacagtacataaaaactaaacaaacatgtagagctcaattttaaatgaattttgcaagttgaatggctcaattcggagttcgaatgaattagatatgaattttagaagttttgagccatttatatgaatttctagaattattcacgaattattgcgcaattattacttattttctcaa

SEQ ID NO: 74481 - DNA, 6167 bp, Oryza sativa
  unsure (1)..(6167): unsure at all n locations
caggattggctcataggatattttgcattaaaagcagcatttataaatcataagttgaaaatagtaaaacaatagataattaagaagtattaacatcatcactgtccaatgctaaaccacgttgcgataggcccaacccaaaaccacctgaactacaccagttcaagaagtcaaattattaaggtgagattaatcacggtgagctagatgaccgcccaataaccgcgggcacggctattagaattgttttactctgatcagaggtgtacaactttacccacaagacacaattccgcacatgaaaccatgcccccaagtaccgccacgatactgcaaagggataaatcgtgacaaaatcctccatataaccaccactaaccagtacacccacctccggtttcacccctatccccataaggcgatgggcagtccccgctcatgccttggtaaatccggaagcagcgtagaccccccccagcccatccatactccatcacgcctaccctcgccaatggtgtgctagctagaaaatataaaacttaagatttagcctggagcccatctggcttgtggttagtacaagcatatcttccagggattcccttgaaccggtccttaattgtcatgggcacgaccaccaaatgaatcatgcatgtacccacgacccaccaataaagcatatataattaattaaccatatgccaaaatggcacaatatcagcataaaaattaaggactgtattacagtgaatcttattgtgagctagttgatccaagcatggctaagcatccctagaccaatcatctagtcaaattattatcctaggctatcaatgaatcagggtaaacataggctgagtactggtaaattccatcccacatggcataataaaataatgcaaatttaagagaaaagcaggggttttgtaaataggctcaatatgatcaatgatattcatatgacttgccttgctcttgagctgacgggacctcagtgaccacttcaaaataaactggagcgtcggaactgctggagtctaaacgacaaacaaggcacacagtaagtacaagctaaaaagctactgaaacagcaaaagaaaccaattttattgaattcttgatattttagcgaatttactacaatttgaatgtgttaaaacggagctcagattatttaattatcaattttacaagatgctctgtgttattactaataacagaaaaaacttaatcatttgacagagattaatgtccaaaacaaaataagatcaaaggatagattgactggctagcgagcctcacgagataccgactcaacgagttgattctacgtgacaggggatcatcgaaatgatcaaccgaaactgacggctctgaacggctctaaactaaaggacaactcaacacggacgaatgaacgaaccacgggagcaccttgttcgaacgaacgagcgaacgactcaacaacggctgcggctaaaccggcgggctagacaggattcacggtaaagccttggtacggcaaacaataagccggtaggaacctagggttgcacctacggctagacaactcaactactgaggaacgggacaaaacaacggctaggttctagcaaagcgcaatcatgacacaacggcggcaagcggctcggcacgacaaggcggcggctcatcatgacgcggcgctgctcggcacggcagcgacgcggctcggcaaggcgtctaggtggggcaacatggctgtggcggcgcggcatggcggctcggcacggtggtagctcagctagacggagcggcacagcggcggctagggtttaggcggcacgattcaaaccaacaaaaacaaggggaaaaactaaccctaaaacagggggaaaaccttactggagagcaaaaccagcgagggagcacgacgacgatgtcggcggtccgtcggcaagcacgagattgatgatggaggcggtgctagagaggacacaacgggttatgttagacagggatataattgacattgggttcaaacaattcaattaagaggaaaaatggatcaccggtgacgcgaggcgacgacggcggctaggttattgagttgcagaaggacaaaaaaaggggagggatcccttatataggggaggactaaattaggaaatgtgcagtcctagggggagtaggattgagaggaggggagggaatcggagtcggcaaaggggaaggncggcgcgcgcacggaaggaggggnaggcgtacggttgaggggaaagtgggaaggaaaaaggaaacaaggggagactgggactttcccgaaaaggaaaagcaatgcagtgccattttaggaaaagaacggaaccggatattgttcgtcatgcaaaacgaaaccgcagaccgagaggggtgtgaattgggcacaattcacgagcaaaagcaaaggaagaaattattagcttgacacttttacttagcaacactgcctccattgttctaatatttactctttaggtcctgttagtgattttcagagcaaagagaatttgaaaaaaaaatttccctgacaattccgattactaaatgcattgttaattgggtttttctcctgattaaccaaagcaaattcttgaagccatttattagtgatttggaacctaagggaaggtaaaactcagggtgtgacaaacctacccccttaaacagaatatcatcctcgagattcggaagaactggcgaagagatggggatggatggctttcaactcatcttctctctcccaagttgcttcatcttccgaatgatggctccactgaactctacaaaacttgatcactttattcctggtgttcactttccacttgattcaaacttactcctttcttctgagttaatggagactgcatcactaccacttctccttttccattaactaacgtaactgtgcggcttgcacaatcaatgactccgttgtgttttgtcaaccaatccattcccagtatgacatctaggtctttgcactccacaaggataagattggctagaaaaggtgacacttggatttctatcatcgtagagggacaaaaactaactaatgttgagctatttcccggtgtattaactttcatgggagaactaagttccacttttcttaacccgtgtaccccaacaaatctcttggatataaatgaatacgtagcaccagaaaaaaaaaaactatagcaggaattgagttcgcagggaacgtacccaaaaccacttccagcgctgcttgagcttcttccgtagacacgtgattaacacgagcttgaacaatcttgggtccattgcgctttcgtttaggacacttacctgcaaaatgtccgggatctccgcagttgaaacatgtgaggggctttcctcctaactccttcggctgttggggctgcgaagcttgagactgtttcattggcgggcgcggaacgggattacggttgttctgatttccactattgccttggctgaaatttcctggctgatacggcctgtgctgtcgaacaatcatagtagttggaccattgtgttgacaatcatagtagttggaccattgtgctgtcaaggaccgtagcggagcttctattgtccatcttgctgactcctgaactgtatagctttcctcttgcgatccattttgttacgctagtcttcctgacgaatggctttgtccacaattctctgaaaatcagcataatctctagaaatcaactcgttagtcaactcatcatacaaacctgccaagaacttttcccatctctcagcatcggttcgcacatcctcaggggcataacgtgctagacgattaaactcatgcagatactcagtaacagtcatgtttccttgatgtagagacctaaactctcgcttcttctatgcaacaattccatcgggaacctgggctttcctgaaaacacgacaaaactcatccaagtaacttctattccggctgaataggtaatcatttaattatcccaccaagctaaagctagaccttgcaactgatgtgtggcaaacgcaaccttctcctgatcagtgcacttaagtagattaagtttcttctcaatggcgtacaaccaatcgtaagcctccattgggttacttgtgctcgagaaagtcagcggacggacacatcaaaactttggcaacttggactgagggggaccattgtgctgctggttctgctactgttgctgcatcatatgttgcatcatctgatgatactgttgttgcatctgatttatcatggttgtcattatctgagtctgtcttgctattgtctaggcaagcggaggattctctgatatatctcctgaaccatttcctaacagctgttcctcattgacattgtttccagaacgggtagtccttgtgttcaccatctgaagcagaagacgagaagagaaatagggaaggagaaaaacagttactagggaacctcattacttttttatttattgttcaactgtaattgttctgctctggtttaaaacacactaaaaaatccttaagtagaacgtcataccataggcacatggtatcgactgtcaactaaaccccacaagcaaacacacctaaacacaaaaatctaccaagcaatgagtaaacaaaacggtaaactagggtagcaagcctaatgcttggaacagctcctatgatcggcagagacgacatcgtcttcttcatcaccactcgaactgctgctactagagattgacacgatccacttcactgcatcactaactgttgcggctttggcggcggagagcatcggcaactgcgaagacgcgcgaactgggacgggaacgggatcgacggctaggacatcgactggggcgggacgccaactgcatgcgaatgggagctgtagacctcttcctcgacattgtccggattttggctcttcttggtgctggacgaccttggagcattgcgctctcgaccttgagacgatcaacctcatcttgcaaacgagctatttgaataagcttcttgtcgttcaacgtctctgaggctcggtgaagatcctggtgcatcttgtcaagcgctctcatcacagtcctcatgcgaccaaaagtagtatcattctcacttgaagctgaactgaaactactagcaatgcctcctgctgaacagcttggatgataacggtaagcaattccatcgaagatgaaaacaaacttctctcaaatcctggtcatcaccaaatatacggcttcctggcaagcatgctctattgttcctctagaagtctcaaccaccatattaaccagaggggtgcccaaactaccatgaacttccaagcgaactctatgcagcaactctccactgaggggctcaataactgtgtactctgaagcttcaatgtagccggcaaccaatgtcatatttgcgagctcagcacggtgaataggggggaaatcagccatctaaagagaagatagaaggaacaaagctgactccaatcagaaatgagatgctggcattaaaactagaagcaaaaaggaagaaaaagcactaaactgaaatcaaaagactaaagcaatatataaatatattttttaaaatactattttcagccaaatttttttaaataccaaaactctttttttaaaaaaataccaaaacctctcttttttttccgctgaaaaatccccctttttttaaccgaaacattttttttgccgaaatgttttttttaaaaaatagccgaaaacacattttctttgaaaatcaaaaaggcacaaagaaaaaatatatattttttgacgaaactcagaaactcaaaagaaaacagactcatatatttagactcactggaccacttcaaaatgtgggaataagagatttccaggggaagaagagaatttcagagggctctatgtgttttccgtttggtttgtcctacggtcaagatcagctctgatatcaacttgtcgcgcccagatattcgacaacccgaatcatcgctatctattgtgagctggttgaccgcacaataaccacgggcacggcaatttgaatagttttactctgatcagaggtctacaactttacccacaagacacgattccgcacatgaaaccatgccctgaagtaccgccacaatactacaaagggggaaatcatgacaaaatgatgtggactagggt

SEQ ID NO: 74482 - DNA, 3537 bp, Oryza sativa
atgcagacaactgaaatggtcgcagtggcatttcttgctgcatctgcatttcttatctttgtaccttggagacatctgctcctgattgcagtcctggaggtgtacacaagagagatgccgctaaggaaacagaacactgaaaagttccgccggcggattagagagtggtgggcccgcattccagccgctcctgtgcagatgatcaaacccaacgaaagcaagaaaaagagatgacaatgtgctccgtgctgttgcaaagagctcacaattttccctgtttcccattcctatttttcacctgaccagctaacctgtacatatctcaaaccctcttgcctcattgttacagagatattcttactgatcaaagctagccaaactagtaatcaattcaatgcatagtgccattgctatgagtgtacactgtacaaatatatgatcgaaaacaaattaatgctgtattttctttcgttgattgtgtaactttttgctgtgcatgcaagttcctgagttctgtgaacaaatctgggtgataaacatggacataatcagtttaaaaaggaaaaaaaatgaagttaatcttattgtattgatcatgaattaatgatgcgtccttcagtattgatattacaatccaatcttaagtgataaaaaagtggtgctgctttggttcatctggataggggaacactctggatgctaaattgctggtttccaagtgatctccaggtgctctggagaagccattgcacaatgatgttacagaggctgttttgagtcttcacaatgctggcgggtagcaactgtggtaggtagtgggagttcctacctacccctccctgtcttcctactaatttggtggtgcgcatcatgggttcaaggagcaatccggcggtttgacttctccgtccgcacctactctagcctttgttcagtggtacgaggcgccgcgcgagcctgccggaatggccgcggcgtcgtctccggcggcggccatcacctgccgaggtacgtacgagccccccctcggccgagttactccctgctccgttgcgtggttttgtggtggtgattttggtggatgggatatgcctgcgttgcgtgcagcggcggtggcgtgggcgcccggtcaggcgctggtgatggaggaggtggaggtggcgccgccggaggccatggagatccgcgtcaaggtcgtctccacctccatctgccgcagtgacgtcacccagtggcaatccacggtacgccggcctctctagctctgcttccatccagcccgatactcctgatgcgctcatcgattttgctgctgtttccgaaacgcaggctcaaaccgatctgttccccagaattttcgggcacgaagcatccgggtctgtatagtctatatatactgatctagcagtctcttttgctgttgccgccatgtctcgcaagttgctcggaacactgacattggaacgatctgatgtgtagtgtggttgagagtgttggtgaaggtgtgaccgagttcgaagtgggagaccatgtgctcaccgtcttcatcggagagtgcatgagctgcaagcactgcgtttcagggaagagcaacatgtgccagaagctcggcctggagaggaggggtgtcatgcacagcgatcagaagacccgcttctcgctcagggggaaacctgtgtaccattactgtgcagtgtcaagcttcagcgagtacacggttgtgcactccggttgcgcggtgaaggtcggcccaaccgtgccgatggacaggatatgcctgctgagctgtggtgtatctgcaggtgaattttaagggctcagatggcatcagtgtttttactttatcttccacgcctttctgtagcttatacttggtttactgatgctaagaattaggtgtgctatgttgttctgcacttctgcgcattttaaccgtgtctctgatcattcatgtcttcgttcatttctgtatttcactagggcttggtgcagcctggaaggttgctgatatctcgaaggggtcgagtgtggttatatttggccttggaactgtagggctttctgtaagtttctacagaggctatgctattagttaatgaaagcatattaggaaatgtaatatttatactcatatcttcctgacttaggttgctcaaggtgctaagctgcgcggggcttctataattatcggtgttgatactaatcctgaaaagcaagaaaagggtattttgcaaacttgcaatttcaatctaaacttcaattatgactttttcccatatacttacttttgttcatggcacagggaaagcttttggtgtcacagattttattaatccagaagaattgaatgaacctgttcagcaggtacatcatcatgtttgctgagaaaactgaactgctgatcactcgcagtttacaattttatctaaactgcatatttggtgttggtattccttttgcacaaactgttgtgctaaatcatagattgtgaactagaaatggaatcgtgataaataaatcaagaccttagaagtcatttgttcaggccttaaatagtaggattagaatatggcactgtgttgaacagacagattttgaatacatgcttttgccagtacgctcttataattacatgtttcatgacccaatttttgagggaaaataagtcaacagctcctgttgcactggtgtccaattggtagtttctaaaatcttgatcatatccctgatatacacagcataaagacattgttttcatactttcaggtggtgaagcggctgaccaatggaggtgcagattactcttttgagtgcgtgggtgatacaggagtagtgtcgactgcactgcaatcatgttctgatgtaatttttattcctttccattgcactacaattccacctattctgcccagatatattatcttctcatgttttggtcttcttagggttgggggctgactgtaactcttggtgtgccaaaagcaaagccagaggtttctgctcattatgcactacttctgtctggaagaacattgaaggggtctttgtttggaggatggagacctaaatctgatctacctttgttagtggacaagtatgcaaacaaggtacggagacaatgtgttgtagaagcaaacatcctaataaaactgaattctattttcagttaaaaatattaaattaagaagctgaacttcatcatatgtaattgtgtgaatggattatcctttactgtggtgcgaagtggttatcacaatcgaacataatagcatttatgtacaagatgtcatatttgatgtttggtcaatgatcacatagcaatatatttagttaatgtgatacatacaaaaaataccttgtttgtttttccaatatataggtctttcaccttttctgatatcaaatattgtttgggtagaatgttgactgatatcatgttacttcttctcaggaaatccaagtcgatgaccttgttacacatgatttgtcattcgattacatcaacaaggcacttgaactgatgctagaaaacaagtg

SEQ ID NO: 74483 - DNA, 19347 bp, Oryza sativa
aggtgcccggttaagggggggagggggaggggaaaaggaaacaaggggagactaggactttcctgaaaaggaaattcaatgcggtgccattttaggaaaagaacagaaacggtcccacgaactaaaacggatacggttcgtcatgcaaaacgaaaccgcggactgataggggagtgaattgagcacaattcacgaccaaaggcaagggaagacattattagcttgacacttttacttagcaacactgcctccgttgttccgatatttactctttaagtcctgttagaaaagctactaagattcctacctattagaaaagctactaagattcctaataagagcatctccaagagtcctataaacatgttcctaaagttaaatttcgtaaaaccccatctattatatatggtccaagttacacaaaaccataagaatcttaatacatgacatataacttcaaaaattatagttctaaaattttagaaaaccgcaccgttaaccatttttatatactcctatattcatatttaaaaaagctttacatacatgcatataaaatttataatggataaaacactcataaagttaattaagatgtgattgtagaactcaaaagtgtggttgatcaaagtcaaaatgatcaataccatggttttctgaaactttatggccagagtatctaaagttacgtgttacatgacaaaaatcgtgtgattttgtacaacttagatcataataatattcatggttaagtgagatttactctataacataagtcaaagacaaagctctctaacaagtaccaaaaccctctcccaatttttaggcacgaccaacagcgctccaataatcatattcagatgagaaatctcttgggcatattggtgcgaactggagctcagtggtgatgacacaggtatagcagttggcctggttagtaatttgaagaaatagcagggcaaaatcagaatttgtctctgataaaaaaaattgcaggtgcacttccacctagttctaatttcttgttgggttggaagaagaaaatagtgcagaaatacaacatttaattaataatatgaagaaaaaccggaagttctgaatggaacttgtcgaaacttctgacttttgggatcatcaagagctcaatgtgaaattccaatttgaacatcggaagttcctaactagtccaattctaatgcaaggtaaaatcagtgcccatttttcttcgatttgattttatctctagctgccaagcccaactagagaccctcaaacgcaaccattcacatcttatattttgttttaatttcctaggttttgggaaacttaagattttatagttttcctatagattgttccttatctcctaagaaattgatttaatctgccgtgatttgctcataattaaatcacttgttcttcacacaaaacatgacatgccctttcacaaaatgtgattatctcatcagcattagcacatgtaactagctgctgccatcgcaatcaccaatgccaccaccaaagctgtagtcactggaaccgctgccgccgctgtccgtcaactactctccgctgttcgcactccaatcctaggagataaggattagtggccatacaaaagagtgaaggcatgcacggctggaaagttgagcgggagggggataatacatttaccgtcatttacataggctcgtatttctttcctaatatttactagtgtgtcacttatctatattttagcttatataatataagacatgatcaaactcggcacggtctccataattaatttttactccctccattctataatataaggcacaaccacttttcttagatattctataatataaggtatacatgcaagcatgcaattaattatgacatcttctccattaaattattacttttttaaatcatccactctcatgttatctaatcctattggatgcatgcattagtatttattaggatgatccaaactacaagatgataataattatttcttggtctttaaattaagggtgattgtgccttatattttggaatggagggagtagcttataatttctcatattgtataaggtttataccaataaaaatataacctaaattcaaatgtcaattgaatgatattattttcaacaaataaaatttaattcatgttatattgattgttagttaaatgttttaaaaattgaatcttaaattgcacgcacatgttatattatgggttggaggaaatagtatctaaactaatttaatttatgtgcaattggcttgtttcttcgtttctaggttcctctagcgttaaaattaaggacgaaaagacgggggcaatatacactgttcaagggggttaccattcttcgggatggagaattcaatggcagatgcccctggttctgttgttggttacaaaggtgtcaaactatctacttttctaacacaacgttaactctattttcacccaattattatgattccaattcctttcctgataagttctgtatttgattttcataaaagatataattccactatatctgtcttgatatgaaacaataatgaattttcatatggaattctcctgctctagttttcctacgggattgaacattactgtgttttgtcgattggctggagtccattcgatgtatctcgccaggtgtgcatgcaccagagcttcatttcatttatccaatggttaaatgtacacatgctatacgctgataaatactttgtaattatgaacagcagctttgtatagggggctagcacaaaatctgtggtagtggagtcgtgatacatgactccttttgtgcatcagatcgtagtgccaacaagtattggatccaacaattatgcttactacaaacatttaatgcttcacggatttatacatgcaccaacaataagatttcttagagcatctcgagtagtagcccctacaatagagcctctaaaagtcaaatgggggctgcccccaattctttaggacactaaatatgtcatcaactctagcagtagccctcatatcttagctcctatttctttttctcttttattttattatataatttatgtttaaatacagtttaacaccataataattcaaacataaataattctagcacatggaattcaaccgtattcgaatttgcaatttcaaacaccatggttcaaatttgagttcaaaattttctaacatgaaaattgaaagtgcatctaggcccctaatgattttcatgattgattacaatgcgattagagaggactaacattttcattcaagcaaatgtgaaggttgttatgtcctcaatgtgttgcaatacaatccatatcccgtgaatgcgacatcgcgatgtaacgcggcaatgatcaaatggtatattgtatctttttcctcgcattgtgtcgtagaaaagccatactattatgggggatgatgcatagacatgtaaggagtgatgcgtgtgctcaaaatcatttttcctttcaagcatttctcttttggagcgttctggaaattttcggaagttccgaaaatacacagaagcgttctggaaatttttggaagttccgaaaatgtttttcggaagttccgaaaaatgcgttgacttcgattatttctcagatctggaattttcggaagttccgaaaattgtttcggaagttccgaaaattgcatttattgcactccaacgggcagatttgtgctgtgggtataaatacccacctcgcctcacttgtgagggctgctggttccattccaattatttgtgcccttggcttgctctctctctctctagttcatttgagccttgcttcctcgattcatctctccacctgtgtttgattcggatttggtgtgtgtgtgagagtgtggattcgagtttgtgtggatgctccttgtggtctttgtgaagatttgtgagcacttgcatcatctccgggagttctttgcatcatcttttactcttggaggttgaggactcctagacggctaagtgtcactcccgagccaccgatctacttgtggttggccgggagaagtttgtgaaggccggatctcgcctccgcaagggaagagatacctcttagtgaaaggagtgcttagtgcaacctcttgacgaaagggttagctaagacccggctcttagtgagctcctcaacggagagtagaatcccctcaaggatttgaactccgggaacaagtttgcaagcttcaccttggtgatatctctttatccctctcctctaactttgcttgcttgtgccgctattggtctagttgctgtatgtgcctttgtttacatgtggtagacttctagatctagatacttctttttgtgtgcgctgctctgtgcattaacggaagttccgaaaatcctttcggaagtttcaaaaattcccagcctagttccgaaaattactgctttcgctttacttaagtttttaaattagcctattcacccccctctaggcctaattgaccttttcaaaaataatataaggcaaagcctagacaagagtggcgtgttaagagcacagttacgacagccgatgaagctgaagccgataaggccaagaggctgcttaaaggaaaagccgttacatctacatcggtaaatatgatttttatgctacctgcagagtttgaagccaaagaagccgatgttgatgatgttgaagaggcctctgctaggttgattttgtcaccagatcaagcagtttttgagaaaccagaagggacataaaatcggcacataaaaccattgtatcttaatggatatgttaatggcaagccgatgtccaagatgtgagtcgatggtggggctgctgtaaacttgatgccatatactactttcaggaagttgggtaggaaatcagatgatctcatcaagacaaacatgattctcaaagattttggtggcaatccatctgaaaccaagggagttttgaatgtagagttgacaatcggtagcaaaactgttcctaccatgttttttgtcatcgatgggaaggggtcctacagcctgttgcttggaagggattggattcatgcgaattgttgtgttccttcgaccatgcatcagtgcttgattcaatggcaaggtgacaagattgagatcgtgccagccgataggtcagttaatgttaccagtgccaatttagctctttgggatatggatggtattgattgtttgtctggaaagatttgggatggaatttttctaaaagtgtccgattgtgatatacaaccaattgaagatggagagcccgaattattactttgagggcgtcgtggagggttcaaatgtctacaccaaggacacggtagatgatcttgatgacaagcaaggacgggattttatgtcggctgatgatttggaagaagttgatattggtccaggagataggccgaggctgacatttatcagtaagaatttatctgcagagttgaaccaagctgatagagctattaaaagaatatagagattgctttgcttgggaatattatgaaatgccagggctcagccgatcgattgttgaatatcggctttctatcaaaccagggtttaaaccgcatcaacaaccaccaaggaggtgcaaagccgatatgcatgatgctatcaaggctgagattactcgtttgtatgatactggttttattcggctatgccgatatgctgagtgggtttctaatatagttccagttattaagaagaatggcaaacttagggtgtgtattgattttcgagatttaaacaaggctacccctaaggatgagtacccaatgccagttgccgatcaattggttgatgctgcttcaggacataagattataagtttcatggatgacaatcagatttttatggccgaggaagatattcataagactgctttcaggtgtcctggtgcaatcggtttatatgagtgggttattgttgactgtcattatcaaccagtttcgaccgtcaatattaccaaaatagaggagaactagtgatgcttgcaacgcataaatgtgttagaataataatattccactagtattaggtatgctaacctttagtagagaataacactaaagtggaggagaatcgacatcaacatagatgataaatcagtcggacgatgtcgaggatcagacttatgtatgaatgggccaagaactccgaattgacacgatgaattgggccaaaattcacaagtctacataaaggagcaacgaaggaggccgccagccgaaaggtgggctggttgggccgacccatggttcggccgaacctccctcgtcgccgtttgatcctggttttggctggatggttgagatgaagccccaatgacggttggagggtattaccgaccattccaaccgtcacaaccgtcatagttcagctataaaatgagctcctcttctcacttcactcacacacatcaagcaagagctctctcatttttctcaagtttggtttagtagtatatagctggtggaataggaatatagtagaaatcaggagtccggaagccttcggaagagttcgggtatggctctggtagctttcctttcctcttttgtaagctttgtacttttattagaatactcttctatatacatttatggtattgaaatactttccgagtatatgaatgcctactttacattttgttcatgttatactgaatataaggctagcttatctgggagatgctttggtgcgggtataatgtttgcttatgcaattactctatgtcatgacgatgatattaaagtagtatctggtagtttagatgtggtgtctagattacgagatatcattatttggggttatatgctgcggatgagaggtgggccgctgatggtgacagctcagtacgggtattcctccgcgcctgtatatgatcctaagttaatttcatggggagggtattcctccgtatttagccccagttgtatggtcatgacgggctgtcgtaaggaacttggcaatcaggggtggcttctcgaagtatcaggagggcatcggatagagggtattagctagtatatcagataactagaatgtctgtatactatgtatattagaagtataggaataggttatctttctcttttctttccacctagcttagatgatatatcatgagaataagaagttaatgcttgtgtgttactctacccttggattatcttaacccctacttagaatatgattatcacaagtaatatataaattactagtcaagttatctctacatgatcttcccacgggataaaataaatacgatacccttggaatactctcgggtgcaatgctacaatggtatatccgtgcgcttgcggatgaactctgtcaccataatataccagaagtatttctgcgccattgctgggaattatatttctagtaatatcgttaagaaataccaacaagcatttctggcgccgttgctgaggaagattcataatagagattacctgaactaatactttatatttacctttgtataatcattttcctttgtaggctaaccttggttattttcacttttgttgtgaaaacagggtagtgcgtgactggtttcaactggccggaatacttcaacgaaaatccataagctttcttccgtagcgtcaggccgcgagtcgttgttccgtagaaaactctaccgacagagaaaccagccgtaccagcgccaccgaccttcaagactatggctaacaagactcttcgcgagttcgctgctccctctgctgagaatgtggccattgggccgcagatcaacatgggagatgtggatttcgacttggagttcagcctcatcacgatgtcgtaggctagcctgttctgtggcaagcctaatgaggatgccaatgctcatctgcaacagttcctggagatctgtagcacgtacaccataaaagggcgtcagtccagacgccgtcagggtatggctgttcccgttctccctcctcaggagagcgaagtagtggttctatgccaatcgtgctgctgtcaacacctaggacaaatgctctatggcattcctctcgaatttctttacaatgggcaaaaccaatgcccttcgtgggaggatttccagtttccagcagacaagggacgaatctattccggaagcatgggaacgactgcaggagtacatggccgcctgtcctcatcatgggatggatgactggctgatcctgcagaacttttataatggactcaccccgatgtcccacgatcacctggacgcggcagctagaggggccttcttctctaaaacggttcaaggagccgttgatctaatagagaagatggtttccaatatgtattggagcgaggaacgacttcagacccgtcagtgaggcatgcataccgtcaaggagacggaactgcttactgccaagctcgtgttgatgcaaaaaacacacagtggcctgggagatctgcttagctatagtgcaggtccaaaggatagtgagatgcgagtgtgccagtcagtttgatcctgcaactgacaagatatgcaaataatagatcaaacagccgatcggctgacaagctgatggagtagttccagccgatgccgataccagccgatagcgatagggtttaagcaatcagctatatgtccaaagtagataatgatataaaggcaatcggctgatgataatcaatataattaaacaatataatccagtagaaaccagtcggctaataatgatatgatagaataagcattgatctgaaggttaaagcatacatcggctgaaggtccgatgtcataaaatccacaagattaaataatgaaacctttgttgtcatcggctaaatccaacttatatgtatatgcaatccttgtaagccgatgcaacatatagatacctgatcagctgaaaccccgatgaaacccttattgacagtcaaaagcaggctaaggattatggttctaaacatgacttagtagatgaaatttaactgatgcaacactaagtatgaaaagaaacataatatctagacaatcaagtcgttgactgagttttcaggggggaagatgtctaagctaatcaaatctagcaacacgatttagccgataccagcataaaccctaaaacgagaagcagccaatagagctaaattgatatgctaagactagattaacagagacatatgataaataggtaggcaaatatatcatccaaaccagagcaatccaagaggtcgaatgtaatgatgcagccttgaacgacgccgacgtaaacgatacatttgcctgggccgatggtacattggacttaccccttcgccggagattgaacaccgatgcagccccacgtcgggtgccaagtcccgccggacgataaaataaagttgaaaaggtaaaaggtggtgatgcgccgaattgtattgatcgagattgatagattacatagaccccgggtgtacatatttgtacccatgggttgatacaagtccttgtcggacaagaaagaaactttcctaaagataaaaggaaaacataaagtccttatcagacactaaacacactttcctaaagataaaaggaactaacaaactattcctaattaatagataacttgccacgccgcatcctccttgaactcggactcttctggataaattccctttagttgatccgactccatcgaaaacacggttgctggcgatttgacgactcccatcggttgtttcctccaatcggctgattccagtactctaaagccgatattgactctaagccgatgataacttcgggctttaccaaatttcactgttaacagctggacctcctcatgaagcgattggacgaccacgacaaaaagccacaagggactgtcaaggtcttggactcacacgtcacgtgtgaggtctgcggcaacacgggtcattctggaaatgattgcctggatacccgtgaggcgatgtacatgggcaacaacaacgggtactgtccacaacgaggtcaggggtggaaccagccatgcccatatgttgacagaaaacatgaggcctgggaaatctgcttaactccagtgcaggtccaaaactcgccttcggatgtatgagcgtgccagttgatttgatcctgcaatcaacaagaaataaagacaagaaaaccgtagttaaatctataaatgatagctgatcggctaggtgccgatgacatatgatttatattaagccgatgtcatatgtacatcgatcggcaagtgtttaataaacaattcagaactaaatctactcgatcggctgtagatattaatgatatacaatccttatatcgatatatacttaaatcaagtgattgggatagatgggtcaccttaccgagacagtataaatcacttaaattgagatatatattaataatgagattatatatattcatagcatagccgatcagatagatttagcatgtatcggctaatactccgataccactctatattaagatattaaaacaagcagaatatatcaatcataagcctaatatacttaacagcaataagatcttaatatgaagggcagatttaacatatcaatcaagcatataaaataaaagtagttacatcagataagatcggctgaaactccgatgctaccctaatcggcaaccagaaagcaggctagagattgaagttctaaacatgacttaatagatcaaactcaactgatgcagtattaagtatgaaaagaagaacaatatctagacaatcaagccgctggatgtttcatagagtggtagatatgtcacgtaatctaagtcaacgtcgctatataacctaatcggctatcttctattaacagatattagccgattataggttacatgacgatactatcaacgattacgtgagatatatgataactcgacgaattacataaacaagattagagtatcatgaagatggaagcactaatctcgagaacacaaatcgtcataacaagctttacctcttgttgaagatcgacaccgatgcagcccaacccgaaagtaagaactcgtcgaaataaaactaaagcaaaaagggtggcgatgcgccgagattgtattgaacgtgtgttagcttgattatatagggctcggggtctatttatacccgagaattacaagatacgtccataccggacacgactattatctctaacaaactctaagataccataagtctttgcggcagacttttgcccaaacatatctctaaggaaattacatagaatatcctaactagtagatacaattgccttctcaggactctatccttgtgcggcaatcaccatgaagcacattaactcaacccgatgacgtacaccgaatcgtattgtcggaatcggctgtatcgactagccccgtctgactctaactctgtcgatcctgaccgtagccgatttggattgcagccgattcttgctctgtttctgcaacgatcttcgtcttggattccgtttcgatcggcccttcatctccgatactgaagttaccaaatttggtcgttaacaccatattatgaaggaggcaacaacaatggtaacttctctaaccagccctccttgaaggatcttgtttttgcgcaagccaaaactattgatgctttaagcaaaaacctcgctacaaatgacaagatcctagagaacataaatgttaagctagatggcttcgcttctgctttccaaaatcagctgagatttaataaaatgttagaaacccagctagctcagtttgcatccttagtccctgcaaatgaaactggtaagtccactcgtgagaatgttaaggcgatcacgttgagaatgttaaggcgatcacaacgaggggaggtaagtccactcgtgatccgccgtatcctaaccctgcaggaactaacggaattgcaaaagaagtgccatctagtgactcggctgacaaagaggttcagctagaaaagatagtgccgcaggagtactgcgacacatggttgctgtcgtttcatcaacggagtaggaaaccatcagtggacgagcaattcgctcgttttgctgaagtaatccagaagatccacatcaacgtaccgttgttggacgctatgcaagtgccaacatatgctcgttatctcaaggacatgctcaacaacaagagactgctcccaacaatggaggtggttaagctgacagaacaatgtagcagcgtgatactccacaagctcccggagaagaagaaagatccggggtgtcctacgatcacctgctcgatcggggcacaacagttcgaccaggccttttgcgacctcggagccagtatcagcgtcatgccaaaagacgtccccgacaagctcaacttcacggtgctgacaccaacactgatgtgcctccaactggctgatttgtcagtccattacccgacagggatagcggaagatgtgccagtcaagatacgggatttcttcatcccggttgatttcgtggtgctggatatggacatggggaaggagacgccgctcatcttggggcgtccgttccttagcaccgcgggagccaacattgacgtgggaatggggagtatccgtttcgacatcaacgggaaggaaaaaagtttgagtttcatccgaggacgggccgaacccacagaatattcaaatggtcgaagtggagccacccaagatggacagcctggtgagattcatgcagaattttctggagaaggaaacaacgatgcccaggaaccgttattggaggacgccggtaaaaccacccataccggccaagaagctagagcagtcggctccgaggaagccgccgtccgcacgaaagcgaaataaggtgtggagggagaagccaaagacgcccgctccatcacctccggagatgggaggaaaatccgtgagctaaatcagaaggaggtacagtcttgcacgtcggacttaaaatgacgcgacctttgtcaacaggtaaattggtatgtatccgcatatttatgttcaacaatttgaatttttgcatcaacacatgtttgaatttcaaaattgcatttaggatttttgaattttgaggaaattcttcaaatgaatttttttcagagcaaaccaaaataaaattttcaacaaaaatttactgtgccacgatcacactgaccattagaatccaacggccgaaagtggggccggttggcccaccagaggttcggccgaaccggccaggcaacggttacctgccacttttggcaaggtaatggctagtgggtctcacatgttatttctgaccgttgtgggtaccctataagagccaaccggccgagagagggaaatccaccccatttcaacacattttcattccctctccaaagtttgcgctcaagttcattcaagctttgatagtttcccccaaattcaaaacacttagttgcatatatacaagttgctttggtgaaactaaccggtgggtgcaactcttgtcatttctaacccctaccgagttagtccgttcgtgctccattgtccagaatgaggaggcgattgtctcgtttattctaggggtccgattcttcatcaagtcatcatgacgagtctagcactcgttcattagttgatgtctcgatggaagacaccgaagctccgtgacgactcctgaacgacaccaacctcgacattgtcggtgatcgggagagacaaacctactacatgctgagcgaccgggagtatgctcacacacgagactactcaccggagctgctgaaaaagataggtatagatgttgaattttgtgctatttggaaagctgttggttggcagagatttgttgtggtagatgagcctggttcttgtttgcttactatgcaatttctgtgcactttgaaagaaacagaagatggaatttcctttcgctttttccataagaagtatacacttatatggaaaggcttaagcacacttcttggtttttacgattcctgtaaaatcaatctctagaaagaaatttctaggttcgagaaaaataggttatgggaagatatttctggtgctccaatttgcaagaaacctaggacgaatgatatccataatcctacacttaggctcatgcacaaatggattgctatgactttgtttcctagaggtgatcttagacccattaggggggatgaattgattatcatgtttgcatggttagaaagatcaaaattgctcctgtgaaatatatgatacggcaatggtttgaataaggtagagagtgaggggaagctctggaggagtgcccggaagtttggcgctcatccgacttctacctagacgagtgtagcttcgtaggaggaattctagaggagtaccggagctgtcggtacactctgctccaggttcggaggacttcttctataaagtaagcatctgtgttcctttcttatgttatttaatcatttagtctgagtatgatatatttccatctttgcgggttcattgtttagtatatatactaagtgctctagtactaggactcgggataaaaaaggaagttcctgcgcgagtattagagtagtaattaataacttaagcgtggtgtctcggttagagattaccttcgtttgttgtgcatcccacggatttgttagaggtaggcggcatgtggtgacagccttgaatcccgtcccagtaatcctccacgttcgaatacatcatagagctatagccagaactacgcttccagaccagcaggggtcggtgcccgaagcaacaaataggaaattacctttgcttagcgtagataattaaaacacatagaaagtcctctctagcctagcctacatatcattagttgttgcccttggatagtcttagccttaggtaaattacacacgttccctgagttcgatatcctataggggttacccgaaggtgaagtgctactgcggtacgctgtgcgcttgcggatttatctgtggtcgaaagaaataccaacaagcatttctggcgccgttgccggggaacggttgctaatttatccgagtctaggtcatcctcgtatgtttatttttatttcttcttcttttattcctttccttgatggagcaacccacaattcaaaacctttctgctcctcgggctgatctttgtgagccatcctgttcttcaaaaccaaccctttcggatggctacgaaatcggtcctggctttatagccatgattcgagagcaaaccttctcttgtggtattagtgaagacctatacctccatcttcgggactttgagctagtgtgttcatgcctatccatcgtaggcatgacgcatgaaactctaaagtggaagttgtttcctttttcacttagagatgaagtgaagcaatggtacactctgtctgtcaagaaattccatggtgaatgagaggagctaaagtgcaaattttgccttgccttctttccatcaacccgtgtaattaatcttcgattagacatcctttctttctgatagaacgagaaggaatctctcagtgcagcctgggctaggttctcattattaactcagtctggcccagacttgtctttacccgatcatgtattgttacaacattttcaatacgggttagacatggagtctgccgaaaatctcgatatttctgccgaaggatcatttgcccacaagacaaccgccgaaggaagagaactcttatatctgatcttagagatcgaagtgaagccgtctcggaggtcgagattatcgatgaggaacctctgcacgtggagtcggaacccgactcaactgccgaatcctcattccaaatgctggagcctgaggaagaagaaattcatccttcggaaattccattccaattcaggggtgatctttatgatgattatgagaacaccctgaattattccagcaaaaaagaaggctcgtcccaaccatgagccgttcgaggaggtgatattgtttgtatctttgtccgtttcttctgaacctattatccatcttcatgaaactgaacgaccgtcatcaccctcgatcaagcctaagccttgtccctctggccctcataatgttgttcttgtttatcaccaagaaacaacccgattcttgcacgatccatctgttgagaacaagaaccttcaggccacgggcaagcttgagacattgactctggaggatgagagaaaacattccacatatgagcataaaagtttctattgcaaaatccctttggattcatgctcacataaggaatccctagagtcctgttcgattagtacaacttccctgtgtgaggaccaaaaccaccttccagtcctcatttctagcatgtttataaggatggttgtggatgcttacatttatcataaatactgcaaatctcgtatttgtttgtggcactaatcttgcaaagcgatgtctccatggtcgagcttgtgagcataaacaaagcactggcgggagataccccggattatcatggtaagctttcttcccaataaaaggaagaaccagtttttaggataatatgcaccttcgggtattcttggtcgctaaccattgtaggttgagattaagaacgagggtcatgcgatgcctaaggacacggtagctatatcaactgtacactttggtgatccttggtattgaaacacactctataggataatccgacatcacacacttggttttgatgtcttgtgacacaaaagtccaagtgtggggggaaggtcgacgagcttttcatgacgagttccatccactaaggccatcttggtttgaagtaggtgttagtcctagcttgctaaaaaaagaaaaaaaaagaaaaaaaaagaggacaaaagagagatagaagaaaagaaaaaaaataggaggagaagaaaagagcaagagagctgatgggctacatttggatcaatgaccacattaggtgcgtgtctttaaaatatggctatacaactcgctagtagcaatcgtgctgcctggctacacctagtcccgccttcaagctcatgcacaacttctcgctcccgcagcacctacgcgcaattaagtaagaggagttgccctcttcttttctaagcgtttgctgccactccagttggcacctgcatatttgcccaaaaagagagctatcctacgtctctacatcattttgccaatggatcacgccttcaaggcacaaggttcttgcacctgaggtgtgagcgtgaccaagttgcttgccagagttagcatggtcaaagcgtcgtcctccgatacaatctgcgtggagatggaggagaaatagacaatcatatgtgaccatgccactgccccatagatttcaaaatatacatcatgctggcagtaagtacactcaggtatgcgaaggacagaaaaaaattcaccacatcttttactcttacttatctctatttgaatgagacttgagtatacatggttatgtttcttatgtctatttgcatatgctctggtttgggtgttttcgcaagacacccatagactttttaaattaagcatggtgcttaggttaaactagtctactttaatcaaattagacatggtgtttagtttgactaatgaatttcatagttaatatgttcatagacattggatatatatcttccgtggactaacccctgcaggaaaattttcacattgacgggtgagtcctcaagttcaattcacaatggaggtaggtcagggccgggaacaaatcaattggtaacatgcaaaggagaaacatatcacctataaaggtccacggtgcgtatattactaattgctcctttaacatgttcaagcaaatttacctcagccttgtatgagttacacttaaacgaaaacttgctgaatattaaaaatttgaaaaaaaatattttcagaataaaaggactgtctctcgaaaataaaataaaatgttggcaacttctgggatccacgcttcttaagttttgaatccaatttcgttttagcgtggatgtgaacaattaatcttgaggcgatgatgaaatcttttcaaatctttgtagtccctcaagtatttgttgtccactaacctttttcaggaaataaaaagacaatcaaggagcagtgtacaataacttcaaatagttataacacgctccttatccatgagaaaagagatgcacagggaaccaagtagaacaaatgcaaaacttgttgcattcttgcattcggttcaaatcttggtaagaccaatctggtaagaatatcatacaccatgcgaatcctcatctcatgtctccatcttgccaggtgttggtatttcttaacgacattactagaaatataattcccagcaatggtgcagaaatacttatggtatattatggttacagagttcatccgcaagcgcacggatataccgttgtagcatttccgtcgtatttattttatcccgtgggaagatcatgtagagaagacttgactaataatttatatattgcttgtgataatcatattctaagtaggggttaagataatccaagggtagagtgacacacaagctttaactactcattctcataatatattatccaagctaggtggaaagaaaagagaaagataatctattcctatacttctaatatacatagtatacatatatcctagttagctgatatactagctaataccctctttccgatgccctcctggtacttcgagaagccacccctgactgccgagttccttaagacagcccgttatgaccatacaaccggggctagacaccacatcaaaactaccagatactactctaatatcatcgtcatgacatagagtaattgcataaggaaacattatacctgcaccaaagcatctcccagataagctagccgtatattctgtacaacaagaacataatgtaaagtaggtactcatatactcggaaagtatttcaataccataaatatatttagaagagtattctaataaaagtacaaggcttacaaaagagaaaaggaaagctactagagccgtacccgaactcttctgaagacttccggactcctgatttctactttattcctattccaccagctagatactactaaactaagcttgagagaaatgagagagctattgcttgaggtgtgtgtgaagtgaagagagtgagctccttatatagaggtagttatgacagttgtggaaggggaattgtccgaagtgccctccaaccgtcattgggatgcaatcctggacgtccaggtcaaaacctggatccaacggcgccaggattggtccaggttcggccgaacctagggatggcccaatccagcccaatttcggctggtgtcctcctctattgctccactccgtagacttgtgaattttggcccaattcattgtgtcagttc

SEQ ID NO: 74484 - DNA, 7270 bp, Oryza sativa
tacggccatccgttccgggctccggccgtagcccgcagcccgcacggcaacgcgcgctcgcgtcgatttgacctttaccggtgcctgtctgtccttgcctagccttgatgtgttccacaggggacccggccttctgcattcttgcatgtgccgccgctcttgcagatctgctcaacttcttggaattcttctcctcaatcaagtgccacttgatctcttgatctcgaacggagatgagtttttgttccttgagtgaaaagatgtttggtttgctcctaaagtttaccaaagattaccacatcttaggttagtcaagtttgaccaagttagcctattatttggtttatagccacacttgtggcaagattacttctcatctatttgggtcccacatgtcatcaactcatcaaagtgtggtacaatttaattttactagctaagttgtggctcgcaagcgtggcataaaaagtacggtgaattgtgacaaacttagtatagcatccacttgtgcatgtaatttcaaaatcaattattttttttaaaaaataatacaataatcatattatatgattgttactacctccatccagaatataacaattcaaatattttctatatatagtatttctatacatctaaagtttatacacctaaaattacccgattcaaatttgaatttgaattcaaatttgaatttgaattcaaatttgaatttgaattcaaattttttatacataaatttttctaactttttattcttttaaaaaaaatttggtgtactgtaataggaagagaagaaggggaggaggaagaggagaagggagcgggggcagggggggtggaccgatcgctgggcgatcgccctggcgatcgatcgtccattaggcccccttggcatgctagtcatcaaattccatctctcttcttccttctctaccctactctctctctcccccatgttttttcactggctggcccggcctctcgtgcccagggtttcccaaaccgtcgggggcggggttattgcgctccggcggtaagcacggttaccgcgcggtaaccgcgaaaaaccgtacgaaaccgtacaaaatttatcaaaaattcaaattattttttaaatttatttaaatttaaggaggttaccgtggtatttatattaccgtacccccgcggtaaggctaataaccgtggtacggtaagtcgtaccctgctcgtgcctcttctacgcagcggcggcggtggcatgacagtgaggaggaacgggcccattgcaggcagcgagcacggaggaggcctagcactcggtgcgatcagaagcacaaggagagaggggttcaccgtggcaagcgagagtacagcgagggagaccaccggtgcttggtccacagtggaggaaggtgttcacctcatccacgaagaccctcaccccccaaagctcatcaccatcgatcccacgatgcgcagatccatctcgcgcgcgcgtgctcatcctgcgcgatcaaacgatcgatccaactgtttgcattcgtcgtaggcacaagcaaagccatttctctagctccggttgcaagtcagcaaatggcacggtgtgtatgaatacagcaaccgtctcggaggagggacaataataccgaggcccgagcgtttgtaacgttgctgagaaaaacaaatgcttctcttgtacaacatctgaagactgaacactgaagtgagtacgtgaccctgtagaaagaaagagtaacagcaaagattccactatggcactgtcgtgttggtccctgacctttttcacctgctgtgctgtttggtaggaacacgaagaccatgcacagaatgaagggtctgaacacgccaaattgttcaaaactaccaccgctttaactttttcttaatagaacttctttcagtttaacctagtttataataaaatataacatatttttttaaaaaaaatatactatcgaaatatattaaattttagttatagtaaaactttggtgttatagaagttactaaaattttctataaacttgatcatacttagttcgattagaaaaaaaattaaaacaatttataatatgaaacgtgtagataatatgggtccgggatacttcgtacgggggaaaaaggccgcctcaaacccacgtggcgctttctgacctgagaagggttgcacccggggctggtgtgttggttgtaccccacgaaaggggtcgggccgccccgaccccctccatgcacggccacgcgtgcatggtttgggcgggcgtgtccaacgccaacccactgcatttattagaggagttggcgcgacaggtcgcattaaatgcggcatgtaggcgcactactcgcccgcccaaagtcggaatgattgatgtgatcgcgggcagagcgcctcgcgcgtgcgcctactgctgtcagggagcatggcctgcgccatgctccgtctaaattgccattaatgatgggctttttgtcttaagtttggatccagaccaaatcccctcgtaccggtccattcaaagtggtcatggctgaccggtgggaacggacgggaggaagtcgtcgttagtcaaagaaggaatgatgcgggtgtccgcccgtgtcgttcggtgtggtgggacgtgcccatactgcggtaaggcgcgcatggttctgcacgtccgaagacaagttacgcattaattgtctataaagaatgttttccttactcttaaagctaggttttgggtctttgtggtaaccccttaagatataaaaggagatccatgcccagtggagtgggggacgaatcccaaaaaaacaaaaaactcttgtattccttccaccaagatcaaccacatacagaaacggcccgaatatgtctaaaccatctgcattttccatcactcctgaggggcccgatcctcctgaggggcccgatccccctctcttttcctcattgatcctcgatctttcacccgtgtccccggtccgaaccggaaaggggctccacggtccctcgtttgaggagttcaccctccgacaaaacggaaggaaacggagggagtacgagggatgggctccaagcacgagtatacataacatgccgttctacaatagtaagtatgctagtagacactagtacagtacagtacagacacagtacatacgcaagtttaccatgggagtataagtatggcgtgcatggatcgtgtgaccttaagagcaggtacaatagcagtctataagccagctgcaaatatattttaagaagataaatgagaagagagaagggcagcgggctacagatttgtagctagctgtagcacgaattccaagatacagtgtgtatgacagatgagaccagatattaatagtgtaatatgtaactattgtataaatgagctattagtttagctatactattgaacttgctctaaccgatagcgtcccattttctttacatgccttttctggcgaaggaaaaagaagctcaatcaacgagggccatggcccatggatatgattgatgatgagctgatctactgcactccacagtccacagcttggtaggagtaggaccgttggaatccataggccatggccgaggaggactggacggaggagtcatcggcatgtctggggttggggcgcgggtcgttggatggaagggcgcgctagatctcggggtggatttgggcggtggagccgaagtgcatccaaaacgtctcgtagactagtactagaactctaccctttccgtttaaaaagaaaataactagtctattattactgtccaaaaaattttaaatctacaataaatctaaacacacatgtatctttgttgtctaaatttatttttagagctagatatttttaaagatataactctatctaaaatgaatctaaatagagtccttgtttaaattaaaaaaaaattgactaaaaacgtcacatcaaatagttgaacacatgaataaaatattaaatgtggggaaaaaaaccaattacacaatttatatgtaaattgcgagacgaatcttttgaaccaatgtgatgctacattaaatatttgctaatgacaaattaattaaacttaataaatttgtcttgcagtttacatgtatgatctataatttattttgttattagtctacgtttaatacttcgaatgtatgtccatatatttaaaaaaaactaaacacaccaaattttttttgaaccaacggggttggtcccagagcgctcccccaccctcaccctagcagtagcaggagtgcaggacagccaatgtcaccacctacggccatccgctccgggctccggccgtagcccgcagcccgcacggcaacgcgcgctcgcgtcgatttgacctttaccggtgcctgtctgtccttgcctagccttgatgtgttccacaggggacccggccttctgcattcttgcatgtgccgccgctcttgcagatctgctcaacttcttggaattcttctcctcaatcaagtgccacttgatctcttgatctcgaacggagatgagtttttgttccttgagtgaaaagatgtttggtttgctcctaaagtttaccaaagattaccacatcttaggttagtcaagtttgaccaagttagcctattatttggtttatagccacacttgtggcaagattacttctcatctatttgggtcccacatgtcatcaactcatcaaagtgtggtacaatttaattttactagctaagttgtggctcgcaagcgtggcataaaaagtacggtgaattgtgacaaacttagtatagcatccacttgtgcatgtaatttcaaaatcaattattttttttaaaaaataatacaataatcatattatatgattgttactacctccatccagaatataacaatttttagctatgaatctggacgcacaattatccagattcatagctaaaaatgtttatattttgagacggaagtagtattctagcctcatcgtttgctctatggcttataagccaaagccaaaatttgaattttaaaacataattttgaatttgattctctttcaacatagttttttttaaactttagcttttcaatcactaggaacatatatacaaaagttttactcacttatcatttttttaatcgctaataagccgttatggcttataataagactagaccaaccgacggggtccatataatttcgaattcaagtttgacttatataattagaaaacaaataataaatttaaccctaaattatgagttctattttatttatttttttacaattttatcattttttttacttgtgtaagttaaattttaatttgcatatgtaaagtaacgtatcagatagtgatattatgatatttttttttacttttaagtgacgtaaaaaatgagcggacattcctggagccacgccctttttaatagtctatgttaaactatcttcataattaaattaaactagcacggtggtccgcgcagattgcgctgctagcatcattatattttctcttatataatagcatatatgttttctcattatattattaaaatatattacaataacaatataattttaaattacgaaactactaatgtgtaatattcatattgtattttatataagtgttagttattaattatttttaatatccagtttttgttatttgtaaattatatatattcctatatggactctagaattgtattttaatattttttttaattctgattttttattatttctaattgtatttgtatgtggactttaaactcatctttcaatattctttaattttaaatttaaaatttaaaatttcagttacttctaaattgtattactatattgactttaaacacttcttcccatgtttttcttaatttagaattttagttatttgtaaattgtatttttatacgaactctaaaccctacttttaattttattatgtttattctgaattttagttagttttaaattcatatatggactttatactctacttgtaatatttcttattttttaattctgaatttctatatggactttatactctacttctaatattccttatttttaattccaaatttatattatttccttattgtatttctatatggactctagtctcttcttctaatattccttatttttaattctgaatttcagttatttcctaattgtatttctatgtggactctagtatcctcttctaatattccttattttttaattccgaatttaagctatttctaaattgtatttctatatggactctagtatcctcttctaatattcctaatttattttatttcctaattgtatttctatatggactctagtctcctcttctaatattccttatttttaattccgaatttcagttatttcctaattgtatttctatgtggactctagtatcctcttctaatattccttattttttaattctgaatttaagttatttctaaattgtatttctatatggactctagtatcctcttctaatattacttattttttaattccgaatttaagctatttctaaattgtatttctatatgaactctgcttttttttttctccgattaatatgagaatttctatatggactctagtctcctcttctaatattccttatttttaattccgaatttcagttatttcctaattgtatttctatgtggactctagtatcctcttctaatattccttattttttaattctgaatttaagttatttctaaattgtatttctatatggactttagtatcctcttctaatattacttattttttaattccgaatttaagctatttctaaattgtatttctatatgaactctgttttttttttctccgattaatgtgggaatttctagaccataagagcaaatgtggaggctcttttttctattcctttaataatataataataatagattttgatagtaagttacgtattcatctactactagttaatgttatgcttatgccgtgtctatccatatcttgccctgcttaccaacctagaagtatgactgtttcaagttgcacgggcagcagcatatatatttgttcttggcccttccaagccactcgtttatccattagcgagggacaggaacatgatccttccaccataaaaaaggttcgagtactaaggccgccagggataagatcgtttatcatgtgttctccaaaagcatctcaattgatccgtgcttttttccaaacgatccgatgttaaaagacgggctaaaatcagacaga

SEQ ID NO: 74485 - DNA, 2023 bp, Oryza sativa
atcaaatatcatatgtggaacaaatatgattagatgatcagcacatgtattaattgatgatcatgtctcatggatcatggtatagagataccaaattaataatgtggatacatgttagtgaacatgttgttggatagacccaacatgagacactgtaagagccatatgtgttgtgtaatcaatgatctcatttagtgttggtattgaatccttacacctgagattatcatggttcccaacatgtgtagtagcttacttagggactgctaaacgctactctgtaattgggtagttataaaagtagttttcgggtatgctatgaaacatgtagtgggatatgaataatcaagatgagatttgcccctactatggagagatatctctgggcccctcgatgatgtagattatggaagtgcatggccatgccaaaggtgattgaggagtcaatcacaagttatataatctatcaacaggttcgagtgaatgattgagctattagaagatggcacatatctagccttgagcttaatcgatatcgtgaggcaaaggggttcatacaagtatacactagaggttcagccgatatgatctttatgtatgcccggtgggtcaatacgttctgataggggccgctgttgacgcgtggaccgaaaaggagttttcgggtcacagccgagtatacatgaacctacagtgtcgcacgcttaatgggccggaataagaggattggatggagatctaatatgagcttaattcggatagggatccgaatagtagtcctacgggccttggaggcccgagtgatggatcctatatattcgtgaggggtatgaccggcggaggtattgcatcacgtgaaaaaccctagccgtcacttccctccccgagcaaaaccctagccgcgcagatgtgctagtgctagcacatctgcgcgtggcgtttcgtccctgtacgtgtggataccggtagaggtgccactgatttgcggtgctgatcggcatgggagtacggcgaagagaacacacgaggtggagaaggtcgagccagtgcgatcgactacttcctctatatcgacgcgcgctaattcgcgagaattccttcgacttcttagcgcctttttccgctgcacagcgcgtcgagtggtaacgatctatgatctaatacttgaatggttcctggtttacgcgatagaaaattttgatttatgctatcgtagcctatgcgtatcccaacaataatcagaatgtattcttcagcatacataaataaaattctctgctttgtcgtgcagtgagtttttgatgctaagtaagatgttcatatgtgcatatatatatatatatatgtgtgtgtgatgttgcagtgacaagcctgggaaccatgacttcaatctactgattgtcgaaacatgaattcggcaataataaaacgggatagcacacgagacctaaaagtggatggatgcggagacaaagggtttagacaggttcaggccctctcgatgagaggtaataccctactcctgtttggggatttgaatccgccgggtgtagtattgatctgacgatcaggttgtgtcatgccccctagagggcctcctgcccaccttttatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctc

SEQ ID NO: 74486 - DNA, 39532 bp, Oryza sativa
gctcttcctgtgatcaagacatatgaacacctcaatctgattggtgaatgcaacacagtagctccccagaaacacaaaagccgcactggggttaattgggcatgcaggcatacgtccaaattaccagcagtaagtaatactccaccattctgtagcaaaactctatgcaaacagacaacactaccactaatttgagtatcttctcacaataatctggcagcaacgccgtacggccggttcaattctttagggcttgtttagattatagccaaaataaagcttactaaaatttggtaatgctaaaattttgataatttgataatattgctaaaattttaacgggatttcttatgtatttaccaaatttagcaacaaactaaacgtagatatttttttaacaactttaaaaaaatgatgcggtaaaaaatgacatcaatataaacatccccttaatcttgctaaaaccaaatttggtacgattcgggcgatctcaaccagtggctgtggagagaacagagaattcaagcagcagtagtacttactgtgagcgggcgaccgtgatctgcgcctcgagcgtcatcaacttcccaatctgctctgctaatcaatacggagtactacactacaccgtcacacaaaagtgcacatgcaaatgcaattcgatttcactgccgcccccggttcttcaatcgtaagctgtccccggctctgccagtcctaggcaattaaggggaagaactgtggcagtactcctccactgggacactactagagctagtgtggcctactcaacctaactagaaaggttatatttttaggttattttttttacggagtgagtgtctttatttaggccatgtttaaatctcatcctaaaatttttcacctcgtcacattgaacatttgaacatatgtatgaagtattaaagataagcttaaaaattaattaattacacatattgcgactagtttgcgagacgaatttgtttttttagataatggaataaatattccggcctttactcattagagctacagccagttattacaaggaatcatacaaacaacgaatgaagttcaaataaaattaaacacacccaacaataaaaaaaccaaactaagaaaatgagcacacatttattcaagtctatttgtgaatctccatccatggttcgcaaatatttgcataaccgtcgtctccagtttacggcatgcaacattcgtaaactctccatcatcttcacgcttttgcagctttacctaaaatcggagccaatatgttgccttcaatattacctgcatatatgagatagatggtgatttgtcaaaaactatatcatttctactcatgctccaacaagtatgagtttactcattttcttgtcaaccccaaaaaccaaccatcaaacatatcttagatatggtaatagggaggtttaaaccaaaagaaaactgtactattctccaaacaaattttgcataatgacagtcaagaaaaagatgttgaatggtctcattttttatacagaaacaacatcttaaactgccattccagttccgtcttgccaaattgtccttagttagcaccacccctttaagtaagtaccacataaagatcttaatcttaagtagcgagatgaatctgttaagcctaattgctccatgatttgacaatgtggtgctacagtaaacatttactaataacgggttaattaggcttgataaattcgtctcatggtttactaacgtattttataattattttatttattagtgcttaaacaccctatacgacaccctatataatatctgatataacacactaaaatcttacaccattcgatctaaacaccagtacaacttctatggcaggaatgcaggatgccactattgctgaggacgacgtaaaaatagcccaggaatccaagccgcagctctctctcggctcggagcccaagaaattctcgccaatccacacccgccactacaccgtcgcagcgcacccacgtgacacgcagccacagtccatcccccgttgtcccgaatccaacgcccggtcccgctgcatgttcctgcgctcagtccagctacaaccgcagctgaagcagcctacactcgccaacaaaagtactaccacctcacgagatcgatgtttgttctcggactctagtagtcgtaggcgtactccactgacgtgaggagtagtacacggagtgctcattctgtcttaaaataaaatcaatttttaaagtttgatttttgtcttaatttgtatcggaattttgactctgaacgatcacaccctagtttagtttgttcagtgtactgtattatcccaggggagtaggagtagattttagaacattcctgtttcttttagtcgcacagtgcaacgccagctcgcactagggcagcgaagttcagcgcttagtacgactgtactactacgagactactactacgacgacgagtacaccatttcctgtcccacggcattaaccgagcgagacacaggcgttgaaaaagcgttgaaaaaaggtaaaggaggcatcgtttttttatatacgctttcccaagctccgcccggccaccatatcctctgcccactctgcctgcccaaacctaccacttcacactgccgccacagcccgcagccacagcgatcgagcccctctccctccgcgagccgtgtgcagcgggcgacgggataactaacaaaaatggcggccgtggtggcggcggtggaggcgggggtggtcgcggtggcgcgcgggcggggcagcggcaggctgctccggggaatctactggaggctccgagccgggatccggcggatgcagtcggagcgcgggaggtggcgcggcggcaggcgtgaccacgcccggttcagcttccactacgacgcgctcagctacgccctcaacttcgacgacggccgcgccgccgcggacttcgtcctagtatgagtccgacgcgacatggccggcgtttagccgcgcagtatgcaggtggtgtgtgtgtttgtctgcgtgttagtgcgtttctgcttagaggcccgtgtaattaacggaagctggcggtgtgtttgggtggttagtgtggccgcgtactctgctcttcttggtttaactaggagctagtactactatttttggtgaatgggaaggcagattctgtactattatttctaacaccacgatttgcaagggggaaagagtgcttctttgccgttttggtgcttgctttcatgttcttcctctcgttggcgttcagcgttgagtggcaaagagtgccgatgcctgtcataagtgcaactcgagtcgagtgtatgcgcagcgaaattagtgaattagtgtgaagtggttagtactgaatcgaaagcttacgagacataagagcaagtttaacagtataagccaactaccagctccaattcatctatagccaatctaatagcttattcatacaatagttatatactactccctccgtctcaaaaaaagacaaaccctgatttccgtgtccaacgtttgaacgtccgtcttatttgaaaaaattatgaaaaaaattaaaaagacaagtcatgcataaaatattaattatgttttatcatctaacaacaataaaaatacgaattataaaaaaatttcatataagacggacagtcaaagttggacacggaaacccagcgtttgcctttttttgacggagggagtacactattaatatttggtcccacctgtcatacacacactgcgtcttagagtccgtactacaactgactataaatctgtagcccgctgctcttctctttccttatttatcttcttaaaatatatttacagctggcttatagcctgctattgtaactgctctaatattcccatcctcttttactccataccacgatgaaaagaaaaccgacaaaagagtatgccgaccagctacagtcgacctagttggcttgatgcactgcaagaattcgagaaactgtaattttttcaggcactggtttatgctgggatggaagttttgaagtcagtatatctgttttctctgcaatcctactccagtggtatcatttttttcttttctttctactgcgttcgagagaacttcaattcttcaaaaaatacacctatcgttcaatcatgaaggaaacacaccaaccgcgctcgaagaaaagatggtaatgcggttaccgggcttggaagaaagttgaagcggagttggtctgaattctgaaaccgagctaaagcatgaaggccctttccacaggggagttgataggggcggcgactgaagtcacaaatcactttgggcgaaaggcaagacaggaagaggacatgaacccacaacccaccgggttgttactgcagagaaagcgaaggaatctgccttcccatcaatccattcctctccgtaagctctgaccttcctgacgtcaaaaatcatgaatgccgatgtgcaacggctgtagtatagtccaatcgttcttggcagggctacgatcgagctgatcagctgagaaagttgacggtactctgctcggactgaaacattactgctaggtcaactctaattctatgccctttttcctaggactaaatatttttgtaaagaattcctaaatggagtcctcctagaaaattttccattccttaccgaaaggctcgaactttgcagaactcgtttttgtcgggcagaaagcaaatcccggcagtaattgcagccatgccactgagaggctgacaggtgatctccatgtaatgtaagaatatgaggcgtgatcctacgtacgttgctcgcatcgcatctcgcacgctgccatcgtcaaccgcgaaagcaacgttgcttgttcggccatgccctgacggcatgaaggctgccatccgaaacgggcccaattgaattggcctatcgttcgcaatgattcacgaatcttgttggggtgcaacggcgacgatctgtcacgctcatgcacgataccagttctggacagtggacactcgtgaacatgcatggagcagcagattcagctcaaacacaaccaaagcgatcatgaaaatggtccgacatcatgaaaatgggccgactggaggagcccaaggagtccagcaagtgtcttctcaaaggtaaggagtgctcctttcagcaaagcccatcgtatctcttagtattatattacggaataataggatgtgtactatccaatcttagattatattttagaataaaaaagtatttaagattcggcttaattaatttatttaggattatatgcaaaataaccatattggttgtccgttggcgttcgcttcatgaacaaataatgtcagtgttcgttcgaccaagtgacgttgttctcgcgtggtcctcgttgccggtggcgcggaggccgagcgcatcctagacgcctggggacgcggcgatggtgttggggctgcatggcagcaggtagccggtccctaagttgcagccgttccgagagtcgcactcatcgatgaccaaggctgccacaatgttgtcgttgttgtagatttggatatacttgtggaagcaccacagtggtcatactccctccccctgagagcgcaaccacgaaacccccgggattgaatctgttgttgcactctctcatgtccacaatatgtacatcgtggcgctaggcggtcaaagtcgtgtagtgtcaccactcgcttggtcctagacagtggcggatccagtatggaggcggcggggtctcgagcccctactatactaagattataagagaccccacgaagacctcactaaaattttttaccatatgtagatgggaggggggactgtaactctatctagtttgctcagacccactgctatttatttctggatccgccactggtcctagaggtcgacctcggcggtgagcagtcgtacgttgggtaggtctggcttattcggcttcagctcctccgtgccacgcgatcggcatgcactcgtcggctgccacagctcgtgcccgcggcgagggttgatcgacgacatgagacaggctagggagggagacaaacatgaggcctacgattgcaagtgcaaaggaggcaattcaaacacacgctacccctccctctcccctatagatggctatatggcctgagtcccgatgacccggcccaaggcacggcaatttggcccgccccaatcacggtcgtgccttaggctactccctcggcacggtgagcctgcacaaccaaagaaaaaaaagttgagggatccatcaaagacttgattcggccatttgaggtacaacccaaagactggaggtatacaaaatagacttattccagtcatataagacacatcccaaagatagagggaataaaaatagacttatttaatagagaagcacaatgggctatcgtgccttcgtgcaggcccggcacaacccgagtcttgttgggccgtgtctgggctgggggcacagcctagcccggcgtgttggtcgggccgtgttagtctgactagcttcggcccacgcccgaacatgccaggccgggcggtccatttggccatctatactcccccccaccccccggcctgcacacacccgcatgcgcgactggacacgtggcatgcgtggaaaggggggctggacggtgcacttttcccttatttctttttttctttccccgtttcttttcgggtttttttctttcccatttattttgtggttttttaatacgtatgaataactttgtatagtaagtttatattcttgatcccgttctctctccttcacataatttaatttatagttagcttatactttatggattagccaactataaattcacgtgaaaagtgccaaatctttttcaaagtgtaacaacaataaccataaagttagctagtctgatgtgaaaagattgcattagtgacgatccaaatgaacaaacggctggtttgagaaggccttaggcccaacagctcgagcaagatatcataagctggatttatttaccttttggtcccttacaaaacttattttataaaataaactcctagaaaaaacttatttagaaatgaatctttttatgacgtcaatgtcatcgatgccgtggtccagcataatggtgtcattccctacccgcggaagccaagtaactaatatgaaggaatatatttatatttttttgaaaaatgacatatttgtaataaaaatatttataggcaggtacttagggtgtgtttggttgagctgtggcttttgaaaaagtagctgttggctgtagctttttgaaaagtagttatggaatatggactgtggcttttgaaaaagctagtttgctttaacacctgtggcttttaaaataactagtcccgctgacaagtgggccccgcatgtcatacatagaaaataaggggatggagatggcaacggcggcgtcgtcggcctcggcggcggcagcggctcggtgaggaggagcggcggcggtttggcgaggaggagcggcgacaacggcggttcggcgaggaggaggacacgcggcggtgacgccgccgctgtcaaccacctcaccaccttcgtctcccgcctccacggccggcgaacgaaggggtggcggcgggcggtgtctggcggcgccggtcggggatgggcaagagcggcgccgttgggttgggtggcggagtcggcctcgagcggcggcggggagcggcagtgcgcgcagcggcggaggagtcctcggcggcagcggctgcggttcggcgaggaggaggacgcgcggcggtgacgccgccgccgtcggccacctcaccaccttcgtctcccacctccacggccggcgaacgaaggggcggcaacaggcagcgtctggcggcgctggctcaggttgggcagcggagtcggcctcggcagcggtggattcggcctcgagcggcggcgaggagcggtagtgaggaaaccaactcaacttactgaatgaatatgtcttaaaatgatagtgagacttgactatagaatctaatggtgcatagcactccccttcttgaatattgtcatcgatcttcaaaacaaggttaggtaaatttatcccaatagcatcaacgttgtacgatccatttggttctcatatttttccatatttaaaggaggattcatatctaaacatatataaacacgatgcaccatataacatcctctattattatatttaccaatgacatgataattgttccaagaataacatggaaaatcataaattttcttctctaaggcatttagatcacaaagaacatcaaattcgatataacccaaagtacataaagaagacaataatttcagctcttcttggtcatcagcaataacaaagacacgtttattttgagtggtaaccaaatattcaaaaatataagtaacgtgttttttcactagttgtggcatgtgtataagtgaagcagtgcgcaactcttcttcattacaagcattatcaatatcaacacaatctgaatttttagcttgtgataaaagcaaattagaaatctgttccactagaggttgctctaatatagcataattagtggacaattgtagcatagcacaatctttcttaccttggtccagttgaccatcacttaaattacctgaaacgctctcttgacataatttaggtgcttcattgttcttctcttcaaaattgtttttaccttcctgcatgatattagataaaatagaaggagcaagaaaattctcatgtatcataggcatttttgtttctttctcaatctgactttcaatatcgcaagcatgcaaaagtaattgaaaaagatggctatgtgttttattctcaagcctatgctgaatttttaaattaagcccatgtaaaaatcttttaattgtatctcctctagactactctataacaccgtacaacatacaaattttaaactcccggtggtactctctcacggttctattcccttgtttcaaattttgcattttcttttgtaaatcacgaatataataatcaagtacaaatctagctctcatcattgtttttaagtcattccaagaataaggtttattaccgacaagacaaatatcactccaccaaagagatgcaaaagaagtaaaagaacttattgctgccttaactttttgttcctcagacaattcataatattcaagttcatcttccacttctaactcccaatcaatatagtccctaggattaaacttaccaacaaatgaaggcaacaatatcttattttcataaacctcatcatgtacctgttcttgatgtgaaagccaatgttttatatgctcaatcctgttctctttatacacacctgtcattgtcagtagcaaacaaggaaaataaacagatgcatgtaacttcttattaacaacaaattttgcttgtggggttgcaagtcactcaacactcaagcatataccaaattcttataatgttctcaaagaatgcaaagcaagtcaatcaccgtggctggttcgtggcacaatgacacgcttgatgagtggagcgattgtaaagccggacctgtaaaggttagtagtatgtgtatcttggtaggcttaactatatcacaacgaatagcaaaaatcaaacagatttgcgaaattgaataatagtccaaagtactagtcaaaattgctggcgtagcctagactcaatcctagcttaagcaagcaaatgatcatacttggacaaaacacaactcgctatatcaagcaactctctccaagattcgaaaaaaaattccacactttcttttcctgcatttttttcttttttctgattttttttgtgcggcactctttttttttttgcaccttctgccctttctctatttcttttcttcttcttcttcttttttttaaagtaattaactcaagcacatatacacgattgtgttgcatgcatgcctcggtcagaggagaaaaggatggatacctcctatttttgtggaacaaggaatatgggaatgataatttatatactttctatttgtgcgtggcagctcaaaagaaagaaatactgggaattgctattttttggcacatgcacttcggatagagacataagaactaactacgagataaccaagattaggttcctgatttgacgtgttttttacttggtaacgtaccagaattccacggcatgcatgcactaacacaggatgataaaaaatgatcagatctaatgttttcttctccttcaaccgagctcgaacgcaggggcggagctgggcctagggcaacttgggcccgggccctactcgtgaaaaaaaaaattaatacctataccttgtgatttttccgattttttcatatattcttggcccagccccactcgtatgcaggccggccctacactcggccttccaaaaaaaacgccttctccaccgaacagcccacgaaatagcaaacgccgaagcccattagcccactaaccagtgaaaaccctagcctgcagtgccgagtgccgactgaatccgaatcatgctctctctctctttgcctctctccgtctcttggtctctcttcgatctctccctacaggaggcgcggcgacgctcgatagggcggcggatggcggggaggcgcgaggcgacgtgcggcggcgggggcgcggctgcgcgaggcggcggcctgcaggctgcagcgtgcgggccgtgtggcggcggcgtgcggcgtggctgcgcgaggtggcggcctgcaggctgcaggcgtacgggtcgtgcggcggcggcggcggcgtgcgggcttgtggtggcggcggcgaacggagggtggcgacgtgcgggcttgtggtggcggcggcgtgcgggcgtgtggtggcggcgaacggcgtgcggcggtggcttgcggtcgtgcgggagtggaaggtcagtggttttttttttgttctctttcttcttcctttctcagttctcgaatctgaaatctcaaacctatagctttactgctttagtacatcacattactcaattagatttggtttgaattcatagatgaagagaagtaggacaataaaatcattctatcaagtccagtcctcaaatgaatccactccggcaactcaggaaacggaagaaaccaatgactccatcccaatgcctaattcagcagaaaccatggctagtaacaataagcaagatcgtattgtgctagaaccaaatgtggttgttgcacatttgtcatggcaagttttagcctttaatttgggccctagtcgtccgaagatcctggttccgccactgctcgaacgcacaggcaatgcacaaccaagatgcaaaactcaaaccaagacgaaactagaactaaaaccagcacttgacacaacagtggaccaaaactcaataaagcaaaattgaataacaattgcaaggctcaaaactaatgtttggtgaaggaaaaagtggtgtggcaatttgtagataatgggtagggaaaataaatatataaaactaaaatcctcaccaggcaaccgatactctgataccatctgataccaactgatgacgctctctcttgtggcccgatcttctggtgaggggataactctcgctttgattgagtgcgacgtttacgacgtggctaccaaccagaacaagtccaggacgccatgcaatcgctacaccacaaacgatgtcgtaccaaccatgacgcgcgggtgatgatccctgcaatgcaaacgagagaacattgcaagaacaagataagatgcaatctaaatattgcgaataggtaattagcacaaagaaatagttgcgattgaagtggtagatctaatcgacccggcaaatcaacacaccaactattgggggctctgaatcaatagtcgccgactaatcgaacgaggactagagacaaggtgaatggcacttggtaaaattcaactaaacaaaacccaaatgtttttgaggatgtacaaagctatttatagaggaaaataaagctagggttaagtgctaattcgtggaggtggagggagacacttccgagatgggcctagtctattacaaggcccaaggcccaagttcggtttcggtaataacactgtcttgttttggcgattcccgttgactcaagatgaatttggacatgagaccggatgcgtttgaaaggtaacgagataagctttccacgaagtctaagatcacccaaatcggagttggcatgaaggcgctaggtccgtttgaagtcagtgctgtctccgaaggccgaactggattccaaaactcattgaattttgatatcttgtagatcctccattcactcgatgaattctttggtcatgttttatatttctcatgcttggatgcatgcatatgcttgatggtcacatcagcggtggcggagaagtcctcggcggcggcagaggggaggttgacacgggcggtggtgtagtcggcctcaggcggcggcggggacaccggcacctcgtccttcatttcctcctccccttcgtactcctcttcctcctcctcctacacctcctcgtcggcggatctgggccagcgcaggacgagagtagcggcggcggcggcggcgacgtctcgtcgaggaggagcggcggcggcagggcgaggaggagtgacggcgacggcgaagtgaggaggaggaggagctatgccgatgggagaaagaaaaaaaaacaagcgaatcgtttttgtgtaatggcaaaggtgggtaattttttctctcaaaagcagctgaaagcaaggggagggctgcttttgatttgtactacaccaaaagctggctttgggtaaaagcagcagtgacttttggaccctttggttgatttttggcttttgcaaaagcaaaagtttgttgaaaagcccaaccaaacacacccttagtgttagtgtcattggtattgaggatatatttgtagatatttttaattaaaattagatcatttttaatttttttacttataggttcttaccgccaatgtaattttttttacagataggcccttagcgccattgacattggtgccgacctccttcatgttagtgacttagcttctggtcttgtgcggtctgcaggggtgcgagggggataacgccaacatcattagcactgttaggttggactatgacaccaatgacgctggcatcatgaaaatgtttcattcatggaatatgttttttcaagagtttgcttgtaaataaatttttaaaaaagacctcaaaggtaaaaaaaaaataatccagtaatcttaaggctgaaatgtgtggacaccctagtgcacggtggtgcttctcggaagtccatggtagggctctttttgtagcaatgcccatgtcctttattaaacgttgtaatatttattcctttcggatgtgaccgtactcgttattaagactttaatccacccgagtacgctacacgatctcttcgtcgatgatatgatgaaaaagtttggatttggaacagtatcacggaccggtcgatctcatgcgtccgaccaagtgatatcgtactcgccgacgtcttcgccggtgatgcggagcgcgtcccacacggcctgcgacgcgtcgacgacgttggggcggcacggcggctggtaggcgtgctccttgtcgcagccgtgcagggagtcgcactcgtcgacgaccttggcgagcacggacctgccgttggcgttgatccggatgttcttgttgcagcgcctgccgttggcgtaccaccccgtggacagcgccaccacgcgctccgtgttcttgtggaacttgccgtcgcactccgacgggtcgccgccgtcgccgccggcttcgaagtcgttcagcgtcatcaccgccttggtgctcccggtggtcgccggggagcaagcgtacgtcgggtaggaccggccggccttgcagcagtcctggcacgagtggctcctgctcgggcggagcgtgccgctcgggttgcacccgcccgccagctcgcggccgcggcgagcgtcgacgtcgccgcgcgagagtcctgggagggagacaagcacgaggcccgcgattgcgagcgcgaggaggcaattcgtcgtcgccatcgatcttgcgatatgttgttgtgtgtaagccagcggagagacgtcgtgtatttatagacccgtatttttgctgactactgtttgatccttgttgccgtggcatggaaagtcgtgcaagcatagtcaccttgtccttgtgaacgcaaagaagcggcatatcttaacttacgagaagaagtcaaggaatgaagagggacgtacgtgttgtactgcacattcacatggtgacattgtgtgataactgattgatcattagtttaggcgattcgtgagagagatgtcagtgttatgacaagataagcgtacagtacagatggaccgcgaggattagcgattagagcgggtgcaccgtgcacgcagggcgtcgatgacgataacagtatttttcaggggcgagcgatgtgatccacgtgatccgggtcacaatgtttgacgaagatttctgcctgttggaacgcggcaatccctaattcaggctcaaactattcatgccttagcacaggtacaacaatctttattagtggtctctctattaccatataagtaaatttgatgatataaaagaaagataaaggagtatggttgttatgcatgacaacagctcagagtcgactcttagcatttattagaacaaattttgttgcatggtggtgaaagaaaggaaagaagagtaagaaaaaatatttagatacattaatgattagagaccatattatctctaactattgtaggatactagtgtctacatgatatagagcttctatttgactctacctttgtacatgcccttattgaaacgggaaagtagtgaaagtacagccatcaactgttcatggcatattaaaacgggaaagcacagataataagagataaaaacagatgcgaaagggaaaaagaaaaactgaattggagatgcgggggatcgaaccccgtgcctctcgcatgcaaagcgagcgctctaccatttgagctacatccccacttgaactttatccaaaaatcatatgatctttacaaaattgtccagtacctgtggtcggatcagatgagcctttacgtaaagaacgtgtaccattttctgtagactctgaagtttgatccagttgcaaatgctttgcttggtttcatcgacataacgaaactgacgtcacaattcacctagtcacctctccgtcggtccaggctgtgcaaccaacgacccgcggcgttacacgcccacgcccgcggcgtcggggagtgacgcactggtcgttccttgcggcctcgaagcagccggatgcgactcctaggtcctcgcggccgcaacgaacttggcggccggtccatgattttaattggaataagttcaccaaccgttaatccactttacatacatcgagtctgtatgatatccctaatctctaatattagaaatctatatccctaaactatataaaatcatataaaaataagatcctataacagtatagatgtctaattttactgacgtggcattctagtcaacatatcttctagattatgggactcacatgtaagcgagtaacgtggggtctacatatcttctttcttctattttcttctcttctcttctcattttcaatgagctgggaggacaggggcggcgggggagaggcggccggcgagcgagagagggggaggcgtccagcgagcccgcctcgagaggccccatcgccgcctcaagcctgtgtaggccaacatcatctccggtgcgctcgtggagatcctggcttcgcgcgtgagcgccgccgtcgtgctccacgagcttgcctcctccggcgactgccatgccctagaggccatcctgaaatcccacagcatgtgcggtgcgctcgtcggcctcgtcagagcctcatctcctcgcaaagccaccaaggcctccctgttcacggcctactacctcgtccgccgagcttggcaccaagggagaggcggccgcccatgttcaccgctgccgccacacccgacgacgcacatgtgctaaagcccaggctcgccggcctcctttttctcctctcccaccagtacggccagccgcctctccctcccaggttcacggcgacgtcgactcggatctgagtctggatcgacgcaggtagcagccttgacagcggacgccagtggactagtggaggcggggctggggaagagtgcactggtggcctagggaggagcgcagcggatgagcccggtggtggggcgccgtgtcggcgaagttgagacccctggtggcgggatggtgccgatggacgatggtgtagagcaaaggatggcaccggcggacgtcgatgacagtcagagaggagctgaaggtggctgacgttgtgggggcgaccggtggcggacggtgcgtcgggccttgaggtcgtcgggcggcgtgggcctcatccccctgacggtagcaatggcggatggggatgccccaggatccagggggaggcccactggaggagacggtgctaggcaggcggttggggttcggaccggtcggcggcgggatccaatcggagaagagaagagagaagaaagatatgcgaaccccacattactcacttacatgtggatcccatattttttttattttgctgactagtatgccacgtcagtaaaaccagatatctatattcctataggatctcatttgtatggttttatatagtttaggggtggagatttatggtattggggattaggcatgtcatacatactcagatgcaaagttgagggatgctcgatgaacttattccattttaattcgacgtggggattgatggtggctgggcctactggaggcggagaatcactgagcctactgtccgccacttctggcccagtagaaccaacggtggcgattcgatcgacgggatcgggaacaatcctacgtggctacgctaagatcgtactccttctagaacctggttcaaacaccaccccgagtcacgtcagtttcgttatgtcgaaccacatcaccactgaaacaccatgcagcccccgcggtcgaacaaaaccagcgatcatgcgaatggcaaacatctggcactgatacctggacgtcgtgcacgcaaagcaggttaaattcggttcttcttcgtgcaggtcaaggcaggaacctgcactccaattctggacggcaaaaatcccaggtgtcacaacgcgaggcaacgcacacctaaacaccgcaagatccagaatcgccagcccgaacaattgggggagcacagtctagttgggagcttttccaaccgaacttggctgcctgatctgatttgttccctagcctgctggtgcactcggtgtatttctgctgtacgatgtcaccaaacacccttgagagccggtacaatagtagactataagccagctataaacatattttaaagagataaaagaagagagagaagaagagcgggctatagatctatagccagctgtagcacggactttaagacgtaatgtgtgtatgacaggtgggaccatatattaataatgtagtaagcaactattgtatgaattaactattacgttgactatagaaaatttggagctagtagttggctatactattaaacttacttgctctgacagaactagcacacaagttatctgctgattcctgcgacttttcgtgcactccaaactccgaaatacgaggaaggccgtgctagaattttgctactgcaacgtatacgagtcattttcaacccaagacagcgttaaaccaatagttttggccatttgttatgtcgaacactaccaacctcagttttagttttggacccttttcatgtcccggccagtagatggtagtctgtcttcatccgacagtaacgcgatgtctaagtatatatgattgatacagaaaagatatgtagatatgttttcgttgagtggttggccaagatcggaggtttggggccatactagattcgcaacctattcagagttgcaaaacccctactggattggcctatgccctgagtccctgatttgtatatggcgcccagtcagagctctcacactgaaaaggccaagactgcaggaactgccggtcgccgtctcaccccccgacataatcacgcagtttgcttagcagcggcagagcgatctagacactggacctgctagagcgtgcgctgcatgtggacgagtcatgagcgagcgaacgatcagcaaaggctagatcacacataaagcaaaaaataactaaactaaactaaaaatgcacagctcagttttgtagctgaatcagcagtgacacaaacggcaacgggggagttcagccgggaccagagcccaccatgacctgtcggcaatttgcaataatcttttgcactgtctcgatgctaattggcagcagggagcagccatgcacgcacatcctttccactggaacgcacaaacctacccaaaaagcttgcgtttttgttaatcacagacaccattatgctacaccaatgtacagaaatccatccttatctggagcaggggtggagcccgttctacttaaaatctatataagtgatcgtatctctcctgctttctgccgtgctttgagccgctttacaacaagcacaagccccttttgccatcagactgcaaccgtggaagtcagtggaggtcaatttcaaaagcttcttctttagatcgatcacctgcacgtacacgagcatttggatgcagggaattgaaaagcatccagccaggccgaccggtttaggggtttgatgccaccaatggctttgtatggatcacttgcacctcctgattaaggaaagaacagtgcaaaaggatggtcagtgttcctaggggttcccatgggtcattgtgtttcctagattacttactactactggttgctgattgataagttggtcactttatcttgaaagtgccaatctctagctagtagtagtatatagctttatatgagttattgggaattatatacttggttacatattagaatattgccccaaaaaatgattgcttagctctgaactgaaattgagccaccagtttctgaataaaaggcttcttcagtgaactggtagtggggatcgaaccctgatcttggccaatggatggattgttcacgaccgtgaccatgtgttgattctgtgtaagcttcttgcgtagttgacttgtattcctttaaagttcaacctgatgatttagactttcagatgtcttcaaattcctacatgtacctttaatcgtagtgcataccgtcacggcttcgttggttaatctttctgcccattggtatgtgattccttggttgaaagatgcagcaaggaactattgagtgtgcctcaagcttccatgctctgcattcctcgattcttttcccatttctttcagcttacggccaacatggtacagcaacaaaacaagttcacgttgaccctttcaagtttcaaccgccaaagatgtgtagctctacattcttcctacgcaacacgcaatagccaataagccaataaatataataagttcgtaactctagagtataccagtaaacagcaaataaaaaaaaaagatccgatcaagcactctagaacatcatgttatttttggcattctcccaattagtaaaccaaatccaaaagtcacgcacatttcattcacggcaagttgcattgttaccttagttataccctgaaactttaaaaatatataatgcaactatgcaagtacatccaccaataaacatcgagcttttatacaagaacaaaaaagcatcctttgagagaaggacaataaaagagattaaagtaaaaaaaaacaaacaaaagaagcaaggcaagttggttgagccaaccagagcaacgtacgcagcgctgtcaatagaaaaccttccaaatgggcgggtgactcggacgcgacgctgactagagctagtggcggtggcctccgtggccatagagcaaaggggctcggagaggaacgagcgaccgaaccggtgacggtgtcccttccaaatgttcgtgccaggtaggctccgctgcctcgtcaggggcacgtgtcgtcgtctccggcccgtggctttctgacggcggggacgacatggattgggagccaagattttgattcgatgccgatctcgctgtggccagtcgatcgaccggtttatttggaggaatgcaaaaggagtacttcctccgttctaaaatgaagtcatttttaaggttggcacggatattaagaaagtagatgagaatgattagaggaagtgtgtgattggttgaaaagagaaagtatgtgagaagaatggttgtgattggttgagaggaggaggtaggtgaagaaatagccttattttaggacaagacactgtgctaaaaatagctacattttgggacggagagagtacttattagtctgtgtttgcaagtcaagtttccaacctcctcattcactcgcttttcacgcgcacgaataccaaaatattaaatgagatgttttttttaaaaaaaacaatttataggaaatgtgctgaaaaaaatcatattaacgtatttttaagtttattaagttaaaacttaattattcagtgctaacaagtaatatgttttccatgcacaagaggttaccaccctctactcctaaacacagggtatgtacgtcctcataggcggataggcctagtttgattgtcccagatattatgctttgtgatgatatttgagattacaaacgaatgaactaactatattaaaagtcaaaacattgatttataaaagatattctactcaatctatataaacatggctttaataatagccccatcgtttgacctaaacagccaaagaataagccaaaatttgaatttttgaatttgatttggaagttgattttgaaatgcttttaacgtaatttttgttaatgttggcttttaagtcgctacaaacaaatctacaaaagttttacttataaattaattttaattttttaataagccaaataagccattttgaccaaatgggcaaccgatgggagcctaagtcgtattgtttataagcttgggaattttgtccatgacaatcagtccaaatgtaaggttgtgttggcactcccggcacggaaaacgaagcagcgattagcacgtgattaattaagtatttgatttttttttcaaaaatagattaatatgatttttaagcaacttttatatagaaactatttgaaaaaaaacacaccgtttagcagtttaaaaagcgtgcgcgcggataacgagtgtggggagttgggaaccccccgctaaagaacgcaaccagtataattagtcgtccctttgtttcagattatttatcattctatcattcatttttttaaaaaaataaaatatttatcattctcacgtcccatattattttttctagagatgatcttccatctcaacctttaattaatgcgggtatgcacatttgttaattagagttaatgctacttccggtaatagttgagatgtagttagtgaggaactaaggataataatgttgtcagagtataaaatatgtcatatcacttctgtcatggttatggataccacatatatttaatagtaatcgaataagttcggcggaacccaccatataccaagtcttacacgaaatcatacctcgtatatagaaggagttccggataagaaaggataagtagagttctatatggaaactataagtactactcggattgtatccatattggtctccctagttctacttggataatgggacttttatatatacaagaccccataagaggaggggggatagacagatcaacacacaagacagaatagacaccaacacacgccgccaaacattgacatcagagataagcctagacaaacccaatatggtgcctacggaggccgacaagagagatctagcaccatctctaatcttgatgagttcgtactcgaggaggaagactaccatgtcgtcgactacgtgttagttatctatgccgcaaagtcgacgacagctagatatgttatcccaaatattttacttgtgcaatttagatgaataaaggggggtgctaatgcgcgtgtacgcgccagcaatttagttggcgcacgcttttgttttttatttcgccgtttcttttcaattctttttcaatttttcacacacctctttataaatgtagaattgaaagttttaaattttgacgtgaaagatttcaaatcttgacttgaaagttttcaaattttgtgttgaaaatttttaaatctgggttgaatgttttcaaatctgggctgaaagttttcaaatttaggttaaattttttcaaatcagggttgaaagtttttcaaatttaggttaaaagttttcaattcagggttgagagtttttaaatctaggttgaaaattttcaaatttaggttaaatgttttcaaatctgggttgattgttttcaaatccggattgaaagttttaaatttgagttgaaattttttcaaatttgagatgaaaagtttaatgttttcaaaatttgacttcaaaaaattcaaattttgagttgaaagttttcaaattttgatttcacgtatagatttcttttcaatttgctacttaaaaaaatcttaaaaaaaagacaaatctacaaatcttaccttaattatggttattatcgaaaactaattggattaggtacgcatcaccgaaaaaaatccaaaaagaaaaaagaaacagcaccaaaaaaatcccaaaaaaattaatccctccgtgtgcgcgccgcctacgcgcgcgcgagttagctttctcgtgaataaagagcaacaccggcttcagccaacaggagtagagctattacctgtttgataagggatccaaacctgtataaaaatacttgtctccatctctttttctttaatctcgcatataccctggtaccgacgatcttcatatcatgcaaataccgtagttgaaacctcaaacgtcgacaacttcgatattggaaaatgttaaacgatcgtataaaacacttaggctgcgttctagaggatcccggcacgtaaaataaagcacgtattattgcatgattaattaagtattaacatttttttaagaaaatggattaatatgattttttaaaacaattttcgtatagaatttttttttcaaaaagaacacagcctttaacgtccattggaagattattccaagttaggaatcatatttcgatccgataagaagatctatacctaatttgaaaaacctacgctgctacggaacatctagactattactcctactaaactggagactaccaataatgtctctatgagtactcgaatacaacgagacataaggtataaatatactccctccgtcccaaaataattgtagttttacactattcatgtttaacgtttgaccgtccgtcttatttgaaaattttttatgattagtatttttattgctattagatgataaaacatgaatagtactttatatgtgactaaatgtttttaattttttcacaaaattttcaaataagacggacggtcaaacgttgaacgtgaatagtgtaaaactgcacttattttggaacggaggtagtactactttcagagggagcttaatagagacaacaaataaaaagagataacaacaccgaaccttcatcaaaccctaccaggattaattcctagatccgtacagtgcctaaggtgtttgactcccaatcatccgaccaccgtctcactgtaatttctaaagagaccaaaagataggtataggacaatgtcgaaggccgtgtaataaaattgtatatctaatatttcaggactaagggaaagagtatagaagtccatggagattttttggttataaaagtggcctgaattttgatctaactatactactagcattttggtcttaggccttagccataaagtaccttcgaccaacaattcggcttccacgttccaaatggcttgcaggcaacaaagcagagctgtaccagcccttgcacattttcttcctgctcatgcggtcaagccgttctgttatggtaccatctcatgatcgaatttcgccggacaccgaaaacctaatccgtctctgcatgcagagcacaaaataaatatgcacttgcgctaaacaagctcgataaatacagcgactttcacaaaaggctccacacacaaatacaaaaaagcatgacacacgaaaagctatgcgagggacccacgccctcgcgaaaattaggtagccaccagagcttttttttaacgcaaagcactctatcatgatgagaagatgagggctgttccatccattccaaattccaaagtgcggaattagagatagccaccgagacgccttggatctttctgggtgaaaagatgggcaccaaccctataaaagaagctttccctcttggcatttggaacctgagcctaccagggacagacaaccaccgcaaattggagggaacggagcagaaggtagcgaagcgaaccaagaagtcttcagtattccttccttgcaagcatcgttaatggaggggtcaacgagtcaagaccatgtgattgggatcccggtgagcaacaccgcctatggcatagaggagccggacttcgcagcggaggagacgaccacccctgatcatgccggtttcgttgttggttccttccaattcaacaacggtaagagttcgtttctgcttcatctgttcaagtgaaacttgatacgaatacagaacatgtttttgatgatcctatcgtttctgtgttatttcagatgcgaatagcccgacgacgacgacgacgacaaccgatcgggcgagcaaatatggcaggaagggggacaagattgcacagggcatcaaagaacatggtaagagcaatcatctttgattttttcaacacggaagaatataaattttgacgtgtttggaaaagtaagactgatgaactcgtcgttgttccaatggcttacagtgaccctcgggccgaagctatcggaaacggtcaaggggaagctcacgctgggcgcccggatcctccaggccggcggcgtggagaaggtgttccggcagtggttctccgtggacaagaacgagaagctgctcagggcgtcgcagtgctacctgtcgacgacggccgggccgatcgccggcatgctgttcgtgtcgacggagcgggtcgcgttccgcagcgaccggccgctggcggtgtccgccccgggcggcgacaaggtgcgcgtcccgtacaaggtgaccatcccgctgcggaaggtgaaggccgccaagccgagcgagaacaagcacaagcccgagcagaagtacatcgaggtcgtcaccaacgacggcttcgagttctggttcatgggcttcgtcagctaccaccgctcgctgcaccacctggagcaggccgtcgcgcaggcgcggcgatgacacgcacgaagcgcgcaagcgcgcgcacccatgtcgtggcggagctcgctctcgatcggatcggtctcttcgtgtcgtacgcttgtgtgtgtgcgtgcgtgcatctgtgtcactctagcttggtgatgcttagatgggttaggatttgtgtatgcgtagggttgatcgatcacaacatgtcgttgtgtgttgggtcgccatggctggcctgctggtggattgatcgatcggcatgcagttttgcaattgcatccagcaggttagatataggcggcttgattagggcatgcgatggcatgtgatgttttgtggggcgtgtgcggaattgaaattcatgaagaagttggatgagaaatggtttcggctgcaaatcggcaaatggcaaaagccccatcataagtgcatcgcgaatttctgataagatatgccaaaaatggaagtttcgcgataatcttcgtgttcttgttcatgttccctgttctggtgatgatggtgatgacatacatatgcaattcatctgcttaattccaaattcacaccgtgcagtgaggtgctggcaagattcagatatcttttgacatcaacatgcatttcatatactgtactcatgtaaggctaggatttcatcattacatagtttctgacataaactggaatatccaggacgatatcgaggtgatttcttaagattatttattgatttgatttgatgtccggccaattccgacattcttttggtaggacgaactgttcaattctgaccgaaagaatcaggtgtgttcatgacatttactgttgaagtagcacttatacaccatctctacagttggtacatatctgactgaaagagattgaattcaattctccgctttctttgcaaacctagcctgactcaggtcattaaattgctgtacacaatatacagtccagcctgcaaaattggagaaattcaattatctgctttctttgaaaacctagcctgagtcaggtcattaaattgttgtagacaacattcagaaaaataggagaacattcttccaggtaggacaatctcatgtcagacatacaaacaaatcatcagacacatcgccgacctgcacaatatattactaacttgcaaactaagttttcatcatcagtaccaaatctccttctcgattttttttaaacttttgtgacgagattctcctccacttagatacattaattcatatttcagggctttctgaacaagaaataaactacgggcagctgaatccgtcaagttggagcactgactttggctaagccggcaatgccaatacatccgcagcagcgttcaaatacttgaaggcttagcaacgaagcgcccaatggcagtgtcttgtttcggggccaagcagggggatatgcactttggcttttacagatgcatttgatccgtcccttttctttcagttatctcaacgttccatctttagctgaaccatttcctttgccctgtcggattggaccatcgggcgatcctcttttggaatcttcgcactgctaccgcttatcggatcagatgggctttcgatcagctcacaccctttcatggttttcaccccactatgaggcaaaagctacgacgaatcagtttatctcttgcctccgaagttatcggctcggctaccactacagtgaggaccggaggagcaccagcgccagtgggataggatataggaacactcacttcacaacttcagaagaacagactgaaaattcagagataaatatacaggctttggatattcaggacacagaaaattcaggcaacaaaaaaagagcagggaaaaaaatatggaaattcagctctgattcatcaaaaatgaatgattggaacaacttgtgtcttgtggtgccatcagagtactactgacagtctggaagagaaggccatggcacttgattttaacacctttttgttgaaaggacggccatttatgtatcgaaatggttccactccggatattccgaacatgtactgcactgaattgtatcacaaggactgaaaaaaaaatgcactactcctgctacttctcgaaaccgatcgaaacgcagaaaaagaaaaataagaggaggaacgcaactgatggaccgcggacaaggacggcagtgcgtccgtgccactcactcgatcacttgccctgtcagtctatcacacaccgtatcgcacgcgtgcatccatccgagagcgagatgcacgggcgcgcagtcgcgcacgcagccaagcggagcggagcggacgggcgagcgagagcgagagcgagcggccgtgctgactcggtgccgcgcgggcctcgacgcggatgcgcgcgcgcgcggtgactagcgcgcgacggttgggcggaatggtaggcgatcgatgggagtggatggagacttcgattgggagggaaaactggatggaaaaggagaccatatgcaccggtctacgatgactgttgcgcacttggggttgcgcgcgtccctggaaaaatctgagatgagattgtccagtttttttttttttgggctagctggaaaggtcgttgttttacacgttggatcatcttgcgtccacatcacccgcggggcctcactgtgtgatccgcagcaggccaggggagaaatctaaaatctgtgtgatcgatctgaacatgatctctttgacagacgcagttgatatttggactatcataattcataaatcatcgtatacgcgcttgtccagtagatttgtgtaggcgagacatctaaatcatatactagacgattttgatatctaataaatcgtataggataacacgccttcaattacacttggatactgaagctagtttttatttccagggaaaaaaaacgaacgttacgtaaaaaataaaaagaaaaaaagagaaccgtccattcatctattgatcattgtatcattccgtatgtaacccgttgccatgttcatataagaacactaccaactacttcagttttctgagacccaaaaaagggttcctggaaaagcctactggcaggtactctacagactacagaaaaaataaaaaggactaacgaccgatcaatcgatccaaaactcaatatgtttaagatccctgggcctggatccctggcgcccccacctccttttttcccataacccggagcaacaagattgtgcgagcacatgggctgccccttccaaagtggcaatgccaagccatccaccaccaccaccatgcatcaccacgtagacaaattcaatcaaccggctaccctcccggctgccgaaagagagaatatcctgcgcctcgctcgcggttcggttctccggttgggcgccggtcgatcggtcgcgcgcacgatcgggaagcggaagacacagccccacgcacgtaaagcagagcaagctctctcaagctcgggcacttttggcgaacgtggaccgcttgcttttccgggcgccgatcagcaggtgctgactccgcgcggggacgaatccgctgccctttccgctaaagatttcgtcacctcgccggctataaaacccgctcgctgcgcctccgctatccctccccccttctcctccttccgctctctctctctcgcccgcgttacagcttacgggctaaggaagcgagcttagctgtaagcgcggtgccgcggagagagagctagccatgacgaagtcgagctgcgcccatgtggtcggagtgcccgtcacctccaaggcgtacgccatcgaggaggcgacgacggcgagggacggtggcaagaaggtcgacggcgaccgcctcgccgtctcgttgacgcacccgagcccgtacacgtctttcggctacaagcacagtacgttattacctcctttgatctctcaagattatagtttaccgtcatgactgcacgtatgtactatatgtttgctaacgatcgggtttcaaattttgtgtttcgcaggcagtaagctccaggtgatccactgggtgaacaagctgggcagacgggctcagggtttcagggatcatggtgagttatcatgcatgcatgcaacctgaatgtttaaatttcaggctttgagcgatcaaaaacatgtgcgtgagcacgttgctaacctatgctctgtttcgccatgcgtgtgtgcagtgaccttggggccgaagctgtcggagacggtgagggggaagctgagcctgggcgcgaggatcctgcaggccggcggcgtggagcgcgtgttccggcaggccttctcggcggagaagggagagcggctggtgaaggccctccagtgctacctctacaccaccggcggccccatcgccgggatgctcttcgtctccaaccgcaagatcgccttccgcagcgaccggtcactcgccgtcacctccccggctggcgacgtcgtcgcccgggtgccctacaaggtggtggtgcccctgaggaggatcaagagggtgcggccgagcgagaacgccgacaagccggagcagaagtacatacacgtggccaccgtcgacgggttcgagttctggttcatgggattcgtgagctaccagagatgctgcaagtacatgcagcaggtgatctcagagctgtaatatgcttatatatgtagtacggtgcacgcatgtggtatttggctggccggcctcctaccttgtgggtggcactatatagtactaaaagcaaagtgtatgggctactgcacggcaacctcttgttggaacgtacgtacgtagacctgaactgctctaccaatttttgatgagagcgcgttccttcctcttgcgatttggcagatcgacgtgtggcctttgcaagtacaagtactctatgtttgtaacattgatgaaccaaggaacttggttttactgaatgaaaaatatcttaattcttctctcgacgagcatcgacaacgaattgaaacattgcattttcggccttgaaaaataacttacctaattcaagtcactgtcttgctcatcgagattagttgatataggctagctagaatagctagcttgctccccatttatactcgatgtgagagaaccctagatcaaacatataagctggagtacgactattaccaaccttaaggtccgaactattataaaatcgctttcttatgttctcttatttggtgttcatgtatacatttgtatcagtcgtcataccctgcattccttaaatatcattagtgcatttcatgtgtgagctatggtcacggaaggaggagtactgggtggaagggatcgcatggcagataatagagagagttcgtcggggcgagtgtgttcgggtgtggctctagctggaggacgatgctagagggggagaggagatcgtgggaacataacacgatttttggggacgtgaatccgatgcgattcgagggagcatctgaccatgtgtgtgcgaggaggggccgggggaggggtgaatggtcatgatgaatgatgttgctgcattaattatagggtacattacttaaaaaaattatattatgttaaccctcataagtggacatatcgatttcatattaattgtttgttcttaagttttttcatttattacatgtcaaaaagtttttctcatttattatgcgccaaatggatttttcatttatgtaccacaaacatatatgccttttaaatgttcctacatgcaagaataaggttccattgcatttatgtggagaacacataataaatgttagcaactatatcattgtccatataaacccatgccattgaggcctttgcaacaactccttcgaaaacatatcgtttgatccatgggtctagccatgaaacatcttttcctcctccttctgccgcttatcatgatcttcctcccatgcatcgcttgcgatgcaccccaactggtgtatgatgctggaggcgaggagctaagtagcgaacacaaatactacatcttcctggtaaataataggtctggtgggggtgccctctccatcatctatgctggcaatacacattgtgagcattttgtgttccataggaccgatgaggctctctagggcgcaaaagtgagattcacatcattgcacaattcaacagtcagtgatgcagtccgcttgtcgaccgatgtccagattgactttgtggacatcatctggttgtgcaaccgcccctcgacatggtacatctctaatttccaactgaaattgttaccaatgccaccatcatcgtcaacatctaagttgcaatatgtcgtggccaacacaaatatagagcctaactacccatcatcggctaaagtgttccgcattgagaggtacagtgatgatgacaatatgacgtacaagctattgacgtgcattacccatgggaagccttgcaaatatctagggtttcaggtcttcggggataataaattcctagtggcaacggacgagccattagcagttcaaatcgtcaaggaatacacatgatttatgcaagtgcttatgcttatgttatattctagcatgtacttgtagtttatataatgtgcgccatataatctatttgtgatggatcaatcttaagctgttatttcttttgatgtgcgaaatgttgaaactttgtgactcttaagctgttattctatcaatgaataagggagaatagctactttagtccctaaagtttctctataggatcagtttagtccctaaccttttaaatggtccaaaaaaatccttaacctttgtcataaggcctagaatagtccttgggtccaccaaaatcatcatatggatatgccatgtcatcattcatgcaaaatctatgatgaattgtccaatttacccttacgtatatcatagaaaaataaatataagggtgaattagacataaccataggaaaaaaatacttctttttttcacccttttgaggtatatttttgctcttacaaataccatatattttttaaactttttccttttgttttttatttttctgtgcgtaagggtaaattggacaaatcatatagattttgcataggaaggtgacatggcatgtccatgtggcattttggtgggaccaaggactatattagcccacatgacaaatttaaaggacttgtttggacaatataaaagattactgactagaatgacccatgagcgaaactttagggaccatattagctattctcccaatgaataatatctttagaagttctaatttcaattactaatcatgaaaaatatatacaagtatgtcaatgcttttggctgtgaaaaaaatatattaatatattttaaattttggcaagcaaattcatcttttcaaatccaacaacaaacatttgaaagcaatcaaaaggagttaaaggcagcagcggccaagtacaatccactcttcaggtcaggcataatgccaactggtgtgaatgatacaactattgtgcttataccaaagattgatcagccgatggagctccgagacgaggtctgtgtaatgtaatctataaagtggtatcaaaatgcttggtaaatagattgagaccctttctagatgagctggtgtctggtaatcagagtgcttttgtcccaggacgcctgattaccgataatgctttattagcttttgaatgcttccactttattcagaagaacaagaatcagggaaaggctgcctgtgcttacaaactggatttgtcgaaggcttacgaccgcgtggactggcgatttttggagcaggctatgtataaattgggatttgctcaccgatgggttagttggattatgacttgcataacctcggtgagatactcggtcaaatttaatggatcccttttgaatacatttgctcagtcgcgtggtttgcgtcagggcgacccgctttcaccgttcctattcttgtttgttgcggatggcatgtccctacttctagaggagaaagttgctcagggtgagctatcaccggtgtatgtgtgccgccgagctccttgtatttcgcatttgctgtttgcagatgatacattgcttttcttcaaagcaaacagattacaagcccgggtgattcacggcattttgggtgattatgctgcagccactggacagttgattaatccggcaaaatgttcgatcatgtttggagatgtctctccgacagagatcaaggatgacatcaggaatatcctgcaaatcggtagtaatgcttttgaggacagatatctgggtttcccaactccggaaggtcgaatgaataaaggtaaattccagccgttgcatgacaaattgtggaagagactaatccaatggggggagaattatttgtcggtgggaggtaaggaaattcttattaaagcggtcattcaagctattcctatttacgtgatgggtttgtttaagcttcccgactctgtctgcgacgacttgacaaatcttacccgcaatttctggtggggagctgggaaaggagaaagaaagacccattggaaagcttgggatcatctaacccgacctaaactttgtggtggcctgggtttcagagactatcggttgttcaatcaagccctcttagctagacaagcctggcgtttaattcagtcaccggagagtttgtgtgcacgggtgctaaaagcgaaatattatccaaatggctctttggtggatacatgttttgcgagcagtgcctcccccggatggaggggaattgaatatggccttaaattgttgaagaaaggaattatttggagaattggaaatggtcgatctatccgtgtctggagagacccatgggtgcctcgcaattttaccagaaggccaatcactgggaaacgtaattgcagaattaagtgggtttctgaacttttgacagaaaatggcgcttgggatgctataaaggtgaaccaaaatttcctccccattgatgctgaggtaatcttacagatgctgatttcttctagagatgaggaggatttcattgcttggcattctgataaattcggaaggttttctgttagaagcgcatacaagttagcacagtcgttggagcaaatggaggagagagctagttcaagtgctgcatccacaactatcccttgtaacctaatttggaaatgtaatatccctcagaaggttaaaatctttgcatggaaggcagctactaactgtttagcaactatggagaataaaaagaaaaggaagatgtaatcttcagatatctgtgttatatgtggcagggagaaggaggatacaagacatgcgctcaccaggtgcccacttgctcgtgctcttttgcaggctttgtaggaggatcactgtttcatttccgacaatttagctcctactgattatggccattggttgtttgattgcctggagaacctggcggattcagggcgttctctgctcctgatggtgctgtggcggaactggtttagtcgtaatgaaatcatgcatgggaagtctgcacccacgattgaagcgtctaagaatttcctgctgagttatgtcaatactcttggaaatcaaacagcatccccaggttaatcagatgaagggcaaacatgtgatcaattactggggtttgaagaaggatagtcagcaaagactgtacaatggaagcactaccgactgggagaagccgcagcaaggttggatgaaggttaatgttgatgggtcatatgatgcacaaacggggactggaggtatcgaagtggtgcttagggactcggaagtagggatggcaatcgggcgcgacgggcacgggtagtgcctacccatacccatgcccgtgagattatttgtgcccgtgggtatacccattactacatgacgggtaagaatggttgcccatgcccattgcccgcgggcgccttatgcccgcgggcgtgcccgtttacccgccacaacaaaagcagtggaacaaaaagtctacaagctactaagttcgaatcgaacttaaaacatcaaatattctccgcctcggtgtcgtgtctctcctctggcggcgatagagtaagaggagagaaataataagggaaataaaagggaaaccgtagaaaacaaagaacgtggcttatgtattctagtggattttgctcctagcctacatgtaagttagatttcgcgggtaaacgggcaaagcgggcatgtgtagtgattacccatacccatgcccattacccatcgggcatagcttttgacccaataagatatccatgggtataaaatagagaacaaacccaaccctaatagggtttttacccgcgggtaaatgggcaaacgggcacaattgccatccctactcggaaggaaatgtgattgctgcttcctgtaagcagctggccagttgccggaacgcacttgaggcggaactccttgcttgcaaagaaggagctgtccttgcgttacaatggactttcctgccgtttgtgctcgaaacggattgtttggtggcaatacaaatgatccagtccaaggagaaggatatctctgaattagcgtatcttataagagaggtgaaagagcttcttggcagtaatagaaagtcaagatctgtaaggctctgcgtagccaaaaccgggttggccatagtttagcgaataaagtccggtgtgattctttgtccggtctgtggactgggaatggctgtaatttcatttcacggttggtctgtgaagacgccgtgtctaagtaatatatgccttttccccgaaaaaaaaaatccactcctcacacttcctcagtcacgcggcctcatcctgcttctgctcacgaaaagagaaaaatcggaggaggagagagagagaagaggggaggggcagaggagagggaggctctctactcctagcactgcccatgtcggcggcatcgtcgagcggcgccggcggcgccctcatcaacgacgtgctcaccgacgacgtgctccgcgcggtgctggcgcggctggtgcccgaggcggagcgggacgcgttcgggctcgtgtgccgccgctggctccggatccagagctccgatcggcggcgcctgcgcgcgcgcgccggcccggccatgctgcgccgcctcgctgcgcgcttccccgggatcctcgagctggacctctcccagtcgccgtcccgctcgttctaccccggcgtcatcgacgacgacctggacgtcgtcgccgggggcttccgcaatctgcgcgtcctcgctctgcagaattgcaaaggtgcgaccttaatctctgtacgactgtagccgtctgtcaacgctgcttgtccgtctcgattaacaaacagcaattgggaattcggatcagaaaaagggtactgaatagtaggatttatggcttaccggttctttccatctgctagatggcagaaaggtaaaacttttttttgttccttttttttcttgtctctgctaagcttgttggaatcgagatcgactgttcttctttcttctcaaccttcatgcttttcattcttttccaacatggcattgtgctgatgtcttgcttgtatcatttcagttttgtgaattcagaactgtttgcatacatgggaaaaaaaactctgcaacgttgtaaaccacatctgatgcatagctgcatatggttcgctcccggaccagatgtagatagtaatgaactaatgatccttggttttgttcgccgaagaacatgccgcccattgtgaagaggaacgccacctttaactaccttacagcctccgttggttcatttctggaaaaaaatagcctgaacttttgaaaaaggttaaaagcagcactgatgatcatctctagttttgctagttttcattctatttgaatagagactagggaaagctgagagctatataattccccactaggtgtgtttttgtataacaatattattcatctaagaatgtgatcctttctaatgttccctgagaggctgagatagtacttaatatatgctagttttctatgacttgaatgtacgattgctgcatgaagctgctgtcctaggttttgatgcataatgcaatgatactcagaagcgaaatcaacatcttctcaatgttcttttggctttaggcatataatttagagaatggactgaagcctttggtgtttatcttttctcgaatctagatggatgttcgaaattacatgtaatgcatagttaagatttgagattttggtactatgtttgataaattacccatctattagtcataccagtggctttgttttgtactccaattaaaaacaagcaaactctgcttaggtctgaaactactgtttttattatcccttgatatgatgataaatccactgatatttggaccgctcttgtgtctcgtaggtgtaactgatgttggaatggcaaaaataggagatagactgccctctctgcaatccatagatgtttcccactgcagaaagcttagtgacaaaggtctaaaggcagttttactggggtgtcaaaacttgaggcagctggtcattgctggttgcagattaataactgataatttgttgattgctctatcaaaaagttgcatacatttggaagatcttgtggctgcaggatgtaacaacataacagatgcagggatctcaggtctagctgatggttgtcacaagatgaagtcactagacatgagcaaatgcaataaagtcggggatcctggagtctgtaaatttgctgaggtctcttcatcgtcattggtatcattaaaactgttggattgcaacaaagtgggtgataagtccatacatgcactagctaagttctgccataacctggagacactcgtcattggtggatgtcgtgatgttactgatgcgtccatagaagcactggcttttgcctgctatagcagactaaagtgcttaagaatggattggtgcttgaagataacagactcctcactgagaagtctattgtctaactgtaaacttcttgtggctattgatgtggggtgctgtgaccaaattacagatgcagcatttcaggatatggatgcaaatggatttcaatctgcactgagacttctgaagatcagcagctgtgttaggatcacagttgcaggagtcaggaatgtgatcgaatcctgtatggcccttgagcacctagatgttcggtcatgccctcaggtcacaaggcagagctgtgagcaagctgggctgcaatttcctggtagctgcaaggtaaactttgaaggcagcttatctgagtctgatccatctgttgctatattcttttaggacgatcaatagcgtcccataattcttttctagatttcgccgaagaacttgagaactcatcatgtcaaaatgtacctgatattgtggttggttttgggcgtgtgttgcacaatttgaggtagaactggatgatgccgtggatgaaaaaatgtgcaggtgtgcactgttcaattctcatgtgctgtacctgtagtcctgtactatgtagaaagtagcacactacagattcttggaatctgttggttagtacttagtagttagcttttgagaatatagagaaactggcttctagttcatgattctacaactacattttcttagaatttaggcgacaatctggatttctttgggtgagccgaatattccatgagaaactgcagaagcttctcaaactagacctataagttgtgcgctgtacatgcacgttatagggaaatgctgcttgaggttgatatatactctgatttatttattcgtacacattgtggatttgtggtgccatggctttttcggctgtcaacactctgttagatcagagtaaatttgcaaaaaaacggagaaccatcgaggttttttttttcagcctttatcgtcttcttgcaaggctgacgcctgacggtcgccatcgacgcgctccgacgaccggcgccgcctctcctccgtgctttgtcgccggcgctgctccaccgccgccacacagtccgcttcggttccccgtttccgcctgtgccgtggccaccgagaagaatttcagctgctaaggaacagaacaatatgctaccaaccacgtaaacaaatgtgaaaaaagttagttttgagatgcaacgtcgtatttgaggtttgaaacctcgggaa

SEQ ID NO: 74487 - DNA, 12078 bp, Oryza sativa
aaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtgatatagaccatgtgatctgagtgattatcccttatgggatactccaaaatagatataaaaattgaatcccgactggcgcaagtattcggttgataacccttacggggaataataaatagtccagtctttgagcatagaaaatagacccatgatcataaattcatgttgcatgtatccggaacaagtccaaattggagacataatacttgtgtttgaactagtaagcccctgagcatatagcttgtccttatgtcgtagtcacaattgtctattgatggtagctgacgcagttggcatagagacaagacgaccaatatagagataatattgcccagcagaggtgacaaaaatattgatggtagtgaagatagtgataccaatcaaaattactgaagtcgcatagccatggaggcgaagaaaccagtcagcgacagacagatcaaatgatgaagataacgatgtcggtgatccagtcaatagcagtgtagcaaccaatgataatgacaaagacgctcatcagcatttgcatagtaggtcaaccgtgaaggtgaaataataagtcggtgaagacataatcatccattagcaacagcggagatgtcagggccgatgaagcaaaggtgctggtgatgatgtcagtgacaataatccttcaaattaatgttatagctgttgtagatgcttcacttggagttgttgaagtagattgtctgctccgaagtaaagatgaagataatgactcctggagttgactcgttggctgattaattgattgctccatctttgacataaagcttgtcgaattttgagccatgtatttgtgtagcccccgactctttgtttagttgggaaacaactgaacatagagtcgagaattatagcttcttatcgtcgagtagtcattgcttgattgaagataagtgttgaagatgtccaagtagaaatccatgatgacaaagttgcattgccatgatgaagtgacagaagcaaactggtagtgaagacgcgcaattgtgacgataaaagcgccagtcggcggcagacgtagacagcttgcgttgaagatgatgacgcatattagcggtgacggcgacgtagccaaccgtgaagaagatagcatcagtcggcgtcataacaggccagctatgcaggcggaaacaccagtcggcggtggacgaggcggccggtcggtgaagacgtagacgcccaacaacggcggcataataggccagccgtgcaggcggaaacaccagtcggcggcagcgaaggcaagccggtcgatgaagacgtagacgcccaacaacggcggcataataggccagccgtgcaggcggaaacaccagtcggcggctgacgaggcggccggtcggtgaagacgtagacgcccaacaacggcggcataataggccagccgtgcaggcggagacaccagtcggcggcgacgaaggcaagccggtcggtgaagacgtagacgcccaacatcggtggtgtgaccaatcaaccgtataggcgaagacaccagtcggcggcgatgacggcaagccggtggtgatgttctgactgatccattcctggagcgtaagagataagcttaaagccatgaatccgtcgcaagcaatcaagataaatattatgaaaattgtttaaaaaatacaatataacatctatagcccccgactcactagtcaacggcgaaccagttgatgtagtgaggcgaaggaaaagacaaaatatcatataaagaataaaataaatgatgacttagctttgtaatattccctcggtgacagcaaaagtagccgatgtgggaacgaagcagtccatcaatggtgacaaaaacaccagtcggcgccagtggaaccaagccagtggtgtagatgatgaagcccattaacagcggcgaagtccgccaaccgtataggcaaaaacaccagtcggcagcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcggcggcataataggctagccgtgtaggcggaggcaccactcggcggcaacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacagcagcggcataataggccagccgtgtaggcggaggcaccactcggcggcgacgaaggcaggccggcggtgaagtcgttgttgttatcagcaatggcggtggcgaagacaagccggcaaagtggactcgcggccgatcgaccggaaagctgagacgcctcgactccatgaccagcattaatcgcctcaatagtgccgcgtaattatatgcgaacaacaacaaaaaataacaagagattaatctgagattaaaaatcaatatgataaataatgataaaactaggcgtccggcgctggacgagtagttagcatgagtagatataaaaaaattgctcaatggaaaatatcacataaagaggaaaaataaaggcacttagcttttttctcagtgtcctccgtatatatgtgttaatgggtggacaggagatcatatcggcagcttgtgacagacatgcaatacatgcatgagtgctgcacttccctgtgtgaaaattgctcctattgattggctcagattccacgtcgactccaatttagattagtaattgaatatcgccaggagatttgacatcatcagatgatggactcggcatgtcaaacgatcaagttgacgactgacgtcccgtcggaatttccggcggcggcgatgcaagccgaactccagaagaaaagaaccggtccgaagatgaaggcggtgctgacggcagccataggagattgaatctgaaacttgccgcggtagattgttgtaatccctcgattgagtttccccttgactgatttggatcaagtcagagaagaggagcttgaagaagtggtcgacggaaaggaagtgaaaactcccgaagcgaaaacgaagtcggcgactcatgaagttaattccatcgcgctcgttgataggaaactcgacgcagcccctacctggcgcgccaactgtcgaaacatgaattcggcaataataaaacgggatagcgcacgagacctaaaagtggatggatgcggagacaaagggtttagacaggttcaggccctctcgatgagaggtaataccctactcctgtttggggatttgaatccgccgggtgtagtattgatctgacgatcaagttgtgtcatgccccctagagggcctcctgcccaccttatatagggtgggggggcaggattacaagatagaaaccttaacccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacactgatgaagctggttcttcctgacggatcgatcccgtgagccaaacttcctgagatgcaagacgatccagtccgtcgtcggtgcggtcatcgtcgctatggcgtggacaaccatgacgttgctgagcagctgcagcgcgccgcgcagtcctcaatgacgtacgggcctctgccgctgctcgcctgctcctgcggtcgcgggtagtttgggtcacacgacggcgccatttccgattgcacgcgcgtacgcttggctgcgggcggagtcatgtgtcgtcaacttctacttctccccgccggtcgccgcatgtcgatgacgtcccggcgccactccccttccgccggccgccacgcgctgaaaatgaaaaatgaagaagtcatgctagagtcctctcagcataaatgcacgtcctctcagcgagatccatacagatattgcgtagataagtcacgcataaagtattaatcatattttatcatctaacaataatgaaaatactaattataaaaaaatttcatataagatggacagtcaaacgttggcacgaaaacccacggtttgccttaagtatgttagctactacagtactggagtagttcagtgctacagtagttgtccgtactcttttctccatttctacaaatattgtgcctctacgaatactatgctgcgccagtagtacagactactactagtacacatcgtagcggtattcggcaatttactgcactgccagtctggcgcgaattcggagcctcgacgcaggtcaagacccgatcgtgaacgtaccggacccgttaagcacagggtgcggataagcgtgcgatggtagtaggtgcagacaaaggatagtggaaggctctggagggccgtcacatcaaccaccaattattgcaggagcactcaaacaacatgagcagcagcacaagcacaactactacgcgatgcttgcttggtgattaggacaccattaatctgacaactgtctcttaatcaactctggaggaaatgattgtcattgccacaccaaggcaaagccaccggaacaacggatatagttagaactagtaccaactaacggataatactagaatcaagctgatgctcgcactagcaatacatggaaaactgcaatccaacagcaacaaaagcagatggcaattggtggtggaagttcttacagcggttttacaagggtggtcgactgaacttaaaaagccgaagcagtttgtatctctaataattactaacaccggttacacaaacaagcgaaactaaattaatcaaggtagtacatacatacatacaacaaatcccaccggtttgattaacaacagtaacggtgatgataatttaagctggaaacaacaaatcatgcacctggctgactggcaccccccaccctctctcacacacactccctcacatgcaaacgatatgaccaagtccaaccaggccagcagcagcagagcagccatggccatctaagctcagttgctggggttgctccggaaggagcccagcgccttgatggctgccgcccggaggatgtactggtgatacgccgccgccgccagcgctccgatgaacggccccgcccagaagatccactgcaattaagcatatgcaggcataagcacttggtgaaatgaacacaagaacagagtgttgcagtgagaggtgagcagcttacgtggtcgtcccatgccttcttctggttgtagatgacggcggcgccgatgctccgggcagggttgatgcccgtgccggtgatggggatggtggccaggtgcaccatgaacacggcgaacccgatgggcagcggcgcgagcacctacacaaacaagcatgtaagctacgtagtactagtaaagctggctagctgagacggaccctggagagtacaaaggtggcgtggtgtgattataaagatacgtaccgggacgtgggagtcgcgggcattgcgctttgggtcggtggcggagaagacggtgtagacgaggacgaaggtgccgatgatttcggcgccgagggcggtgccggtggagtagccgctggccaccatgttggcgccgccgccgttggcgttgtactggtgcttcatgatgcccttcacgatgcccacgcccacgatgccgcccaggcactgcgccacgatgtacatcaccgcgcgaatcaccgacaccttcctcgccagcagcagcccgaacgtcaccgcggggttaatgtgccctcctgcacgccacgcatggccaaatttagctcaacgtacgggcattgtttcaagctatttagtaacaaaagaaaacattactagtacggaccggagatgccggcggtgcagtagacgaggatgaagatcatgccaccgaaggcccaggcgatgccgagggtgccgacgccgccgcactggtcggcggacgactgcactttgtacccaatgacggtggcgacggtgatgtataggaacaggagcgtggcgatgaactccgcaatgagcgcccggtagaaggaccacagccggagctcgccgacgtcgaacagcggcgccggcggcgggtcggtgtagtccttgggccgcacgtgctccggctcctcgctcacctccttcgacattgccgctcccttcagcaagctcaacacgctactcactctgagctagcttagctctgctctctcttctctacctctctcttctctgatggatgcggagaggaggggagcgtgggactggccggttttattgagagcgcggtgctgtcattaatggaaaaaaaaccggcccaggtacaagagaagagaaggaaaggtgtgtgtgggcttgtgccatcgaagcacttcttgtctttacaacctggagtagattagcttgcttgctgttgctgttgccgttgcttctccatgattagaagccaaacttagcacttgataatgatcatgttagtgatgaagtcatggataagtttgttggttctatttaaatgattttagtgctggtataacacaacattaaatacttgacaaaattctctctatgtggaacatgcatgaaatatattcccagtatgcatgctttgcggctgtagttggtgaagctaaagcaatggggggtttataagtcgaggacaagtatcatatcttaatataaagttattctccactaaattcttaagcttaacatgcaaagatgctatatcatcatccactaacaagatgtcacatcatcatccactaattaacaagatgccacatcatcatctactaacaaccatcacatttaaacatcatgcaaacatgccatatctttatagtttttaaaacttaagagctttttcaaatatgaacatgttaaattatcattcaacataattcacataatgttttaatgtatatctttattatgttttatgatatcatttatacttatatagttcatcctcacttagttagtgcttaaatgattaatttatggtccaaattatctttctcattgtttcctctaattaagtcatatcacatcaattgtttttatcctttagatgattaatctaaggtccaaactatctcccttcatttcttcttccatgaagtcataccaccttactttttacgtttgaatcaccattctacatactatttaaatttaaattattataaaccacattaatttacttaatctgatgttatctagctattttacacattatttttttattattatcatactaaattcccacaacaatgcgcggggtttcacctagtgatgaaccctgagttcctctcgacactcaaggctgttgttggcccgatctttcggtgagttgtgataactacgatttgggagaaacgttgatgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaccccagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcatgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcatcctccccttcttcacagaaaaccgtcctcgttttttccatatggtgctcttcgcgcagtccactgaaaacaacctgtttcttgcaatcaaaacaagacaaactcgagacaatatgactagcagtaacatgtctctctagcttgcatattttatccggaactacaagatgttctaaatctgaacaaatgtaaactctatgtaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacattagtgataggaggcacaagcatatcttgttgctccattggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcataaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacactcaagcttttaaccaagctcttacaagatcttaccaatgcaagtggaatggtgacatacaccgactcaaccaagcaccccaatgaaggttggatgtatcaatgccttggcaaacacttgcggtacggctgtaatcaaatatgtggagctctaggtaggcttaaatatgtagcaaaggaatagcaaatgctcaaatcagataatgcaaagttgaataattgttcaaagtcgagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttttctttccttttcttttctgtttttttttggtgcggctttttttttctttttttttgcacctttctgcctttttttttcactttttttttgattttttttaacaaaaactgactcaaggcccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggacttggccaggaggtggagtggatggcagccgaatttggtgtatgggataaaaaggaaactgatttttaaccaatccaatctactgtatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcaacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgatgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaataccaatgataagttggggttccgaagaacaagcagacggacgg

SEQ ID NO: 74488 - DNA, 7225 bp, Oryza sativa
gaggaggaagaggaggcgatcggacagagaggagaaaagcgggggatttgggtcggggccgaggcgtgtgattttggggagggattgattggagtattggagtgtaggtgcagggatgaggagaggaggcagcccggtctggtcaggtcaggtctggtcaggtcctgatgagttgcaactgcgactttgcagtcgatgggatggaacatgtcttttgtgttcgaatctcaattttatttttttaaaatgcttgttttctgaataataatttatataagggcacagtgcttgtttaaaaaaacaaaattgctttttaaaaacatattaatctgtttttcaagttttaatagtaataaatatttaattaataatgcgctttcgagtaagcgtttttacgtgcacggaagagaagtttccaaccgaatctccggaacacggcctaatattgtatctaaaaggaaggggaaagaagagtattgaggagatccgtaaaatgagatgaaccgttagcatatgattacaaacttgaaatatggattaatatgatttttaaagcaacttttttatagatctttttttaaaaaaaatgtatcatttaacagtttgggaatcaccagcacaaaagaacgaggacaatttcttcctctacgtgcttctctcgaacacttcctaatagttcgttcttcctccctttaagaatacaagtaaatttattcacgagactaataagaggttaaattaaataaatattggttgtgattgactaagataaaaaagcatgtggaaaaattaaagcaaattattattacaatgcgctgagatagtaaataggaatagaaactaaggcatttttttaccgtttggttgtctttagctctaagagaggcagaggtagccaaccaaacggttttagtttcacccagaaaaagagcgaagcatgcaaatgtaatctaatctagagtgtagttcaggctactacataactccactctagactatgctccttgagttataaggagttgagccctgccaaatatgccctaaatactatgtagagaagtagttgctccctccgctccaatgtataagcatttataagaacaaaattaaggtaaagattagaagtggttgctactttcaattttattcccattatctaatcatcaacagaaagttaccatacacgatacactattttctaacagcaactaccctatgttttcccttcttgtagtttgcgttgagtttgctttttgcatgcaagacaactccactcattctctgtcctttttcttacttcacctcaccatccaatcatatgatctttgaggttgtattataggtttgttatgtttcctctaaattgtttagatcaggttaagatcgagcataagagattttgatgacctcattaaattaggtatgtttgggtttaatatgggaataaattagaattggagataactgatggaataagtagtatcaaaacagtgttggaagtgcttacatttagtgtaaaatttaaatgctataagtgcttatatttcggaatggatggagtttttttttttttgcatctgtgtgactatttttcttccatttcctttgaccctcttattttctcttattttctctagtgaagattacagtagctgtacagttagtagtactagtaatcataggttttggttggagctagcttgtgttttgtttcatgcagatgtagaagtaggagtacgtgcataagacaggcatatgtgaggaaaaaagattggtgataataactgagttggtgcattaaccaagtggtgtttggttctttgtctcctttttcttgagaagcattgcagcaatgtataggtgctgtttgggaaggagagactaaactttagtctctctcataaaagcataagtccctatgagagagactaaaatttttatgagaagactaagctttaatccctcctactgaaacaccaccatagtacgaaggtcccgggcaagtggacgtgcgcagagagaaggaaacgatccagatgtgatgtgttgtttcgcatgccatttcaccaccccaaacaaacccaaatcaatcacaccttcggttcatcttaattgggcttaatgtccagagagcccattatagatttagagcccactaacgaatcaatttggtgtgaaaaggagtctaattttaatctctcaaccgcaaaactgggtataacgcacgattcctctggctgttaaaaccgatataaaataactactcccagacaatattgaaggtgatatttattgactgtgtagtccactcatcacatgtttttttagaggtgggcccacatgccatcccctatcgcccttcgttctctcgtctcctctctccctccccctttatgtccacgatccacatcaaggaaaccaccttcacaccaatcttaacaatttggggttcgaaatatattttattgtgatcaaaggatatgaatcggattagaccaataattgagggtgcgttcccaacttaggttgcgttcgttagctctagtgcccaacttccctcccttgttttccacgtgcacgctttttaaactgctaaacggtgcgttttttaaaatatatatatatacaaaagttgtttaaaaaatcatattaatctatttttgaaaaaaatagtaaatacttaattagcaaatacttaactaatcgctgctccgttttccatgccggagggaaacagagcctaaccatgtggtgtcttagtatcttatagcacactaactatatacagcccatataagccatagctatatctgggctcgtgatcggcagttagttgggcctgtgcctcctcaacgaccatttcgatggagaccgtacggacatggggcacatgcataaatgcattgcaaaagcttcaagttggcagaagtaggagaatcctgtacactgtactataaaccaatcgatctgcattgttgacatttgttgaggctttgaacgggacacggccgggagcacataaacaaagcaatatttcggcaatcattagttactccctccgttttctattatatgcgccgttgattattttagatatatttaacattcatcttattaaaaaatatataattattatttattttattgtgacttatttattatcaaatgctttttaaacataatattatatttttatatttgcacgaaaattttaaataagacgaataatgaaaagtttgttaaaaaatcagcggtgtcatatattaaaaacggagggagtataatacttgtagaaaaacatcttactatagattttatatatgtgttgtccctataagtaaatcaaagaagcaaaattctccttttggaatatgacgtgctatctctgtgtgacacatgtgcgaatttgagccgtcaacacatctccatcgccaggcaccgaaaagggccaatttaattttaatgttctattacaccatatatatgcttctatcaacggtctttattgagtttttcctctgtcggaacaaaattatacaggacctcggtcctttgcatatttggaaagaatttgcttctccactgccacgtgtccgcaccaatcttagaccacctatcttttacctctagctcaagtgcttttttctcattctctcctcttctctgcttatcatcaaccgaagcaatggagccccatcttcgcacgtggaatacgttccccgggcatggatggagagctcacccaactattccccatgtctcctctccactctcactacctctcttccactttttcttccccgtagaagacccaaagtttagctagggtccgatgcgtagctacggcggcggcgacgccctcatccaaccgcaggggcatgggatggccgacttagcacgctcccttgccgggaacatactcagtctcaactagacatagtactcatgtaccacattgcattttgcgtcgtaacagtgaggaggaggaggcgagggagcgtgttttcacgctagatatgaggctccagccgagaagcaaaagaagatgcagcgtggagcgtgtttttgcgctggagatggagggctccaaccaagaagaacagaggaaggggatgtggggactggggagagtggcgaggagagagaatgggaaatttggcattttggctagaggtagaagatatgtactataagatcagtacttgaaaggttatatttttttttaacatagggaatacacataaattaaagatgttgttgccagccaaacctactactttcagtaaaaaaaattaacttatgttagaatatgactaaccctaaaaaatcttaggatatgtcacatactatatatactagtactttcttgaaccgcaccgagaaaatacaccaatcgacacacgatggtcggccctcatggaactcctcatcacatgcagttgggcatgagatgaggggaagggaggtgctgatccaacccgcgttgccaccgcaatcacgggaacaaactaatttttttaaaggatttttttttgatttttgaaaggaggaagaatctaaatttaatttgcatcactagataaactcaccatgagtgacaaatcgaaaacgacactggacacaggacagtacgtaggatgtacacctttcaaattaaaaacaaattaagggacactgttgattgaaaagtttttgttgcttctcctagcaaatgatccacatatactccgtattaatttgccagatctggaccgaaggcgaaattgaaaaggcaaattgatgggattgatggctacgttattcctagaaattaagtggttaaaaccattgatcccgaaaaggaatagtggtgtagtatgaaaatgggctgtcacagtcagtgtagtaaaagtcggccgactatatatatacggccgtatatacgtacggtcgtacggatacgtcggctaaaccgttccgtatagttggaaaatgctcaaatatggccattttgttcgcttaatcacccaatttttcataatcaccggattggacttactgtatgttataattaagtttcattggaacctgttttaaattgttagcaatccacaagacctagtacaacccttctgctggtatataagctagtaagaaaattactgtctgtttcagtataatcacatggtgagatacgaacacattatctcattttgacaatataatatgttaagaatctctagaactacaagaaattatctaatatattggtattagtgtgaacatgagtaattgcttgacggtacccattccgttcgaacaccgtattccgttctttacaacactggttacagtgcatgaacacatcaatatattatactctctccgttctatattatacctaatctcaccagtacttgtgaagaaagagcaaaattagatcgaactagaccctagcgaagtttaatatacaaggggcaaatattcgtttaacaccatatcaaattacttcgtgtacacatcttgtgccaaaaaagacatatataaccctagttagctgcattgcgtttgtttatgcaacatgcatatatagtaaatttgaatggttcaaaatgtagtaactagtactcctacaattaatccaaattaaactaccacgtacgtactatagctaaatggcagcgaactgaatcaaaatttgcaggtcctgaatcctgattaatatatatgccaatatataaagcttcaaactatttgatcgaatatatatatatatagttggacagtacaagtgtacaacttggttgacaataatcttcaagaggaaaaacaaaacaagcaaaaaaaaaaaaagctagccaattgagtcgatgcattgatcatcgatccatgcattgagattgagagtgagaaatatactaatatatcacaactactctactaacttgcatgcatgcgttgatcatatgcatcatcttccattacagacacgtacgtagatcaatgtgtatatatactcacttcttttcaggtaatctataattaaataaatttttataatatatttatcttaagttaagaatattattatttttttataaaattagttaaacttatagtagtttaattttgaccaaagttaaagcgtattataacctaaaacagagggactaatagattagctagctagttcgatctagccatgtatcactgccattgatcagctcgagctagcaagagctaggtcgtgtcggcgagctgcagcgtgtgcagcagcgcggcgcggaggcgggcttcgtcctggagcgcggcgggcacgtcgtccaccatcacgtcctgcaccgtcgcgccgcccacgcgcgccaccgacgcgtgctgcaccgccaggttcagcgcccgcaccgcgcacatcatgcgcgccggggcgtgccgcgccgccgccgccgccgtcgtcaggcgcagtatggcggcgtcacgcccgatcatccgcaccacgagatcatcccggccgatggcgccggcgcccagccccgcggcccaggcggcggcggcggcagcggagggagccagcggcgccctccgcgcctcggcctcgagccgctcgacgcggcggcgcagctcggcgatgtagtcaacggcgtcggcgaggagggacgccttgtccatccgtgacacggtgggcacggcggcgcggagttcgcagaaccggcggttgagcttctccctccgctgccgctcggcctccacgtggccgatcgggggcgcgccgccgccgccggagcgtggccctggcttccgcccccgccgcttcgtcgtcgtcgtcgtggcgggcgggttcctgggcacgtcgtcgttgctcgccgattgcgaggccgctgccgccgccaaggcggaggcggcggcatccttgtcgagctcgtcgtgtccgagtcccagcagccattggtcggggacctcgcagaactcgaagtcaagcgtcgggaagcaggccgtggcggagaaggaggaaggggagagtacaagctcgtccatggccggggtggctagctcgtcggtagacgtggcgctatgctccaccaccaccaccactaggccacgtcaactgttgtatagtgctaaaagtggaatacctttgctgcagccaggtagcagtatacggagtatatagcagcagtgtgagagtgtgagccatggaggaatcaatagcagcaaagctagggacctcacctacatgtttggctacagt

SEQ ID NO: 74489 - DNA, 17014 bp, Oryza sativa
aatggtaattctagaggttttagttctttcactttttcttttattaatcttactaatttaatgtcttcagaattaaaatatttctgaccattttttcttaatttagcgtataaaggtcctgctagctttgctaaattgttgatgtgatttctagcataatttacaagtcctaggaattgctgtaatttctttttgtcattcatagcatcaggaaattgtaaaattttcttagcaatatgttcttgcaaatgaattttgccttctcctatttcatgtccaaggaagttaactttttctttgcatatctccatcttcttttttgataggattaaaccattttgctcaacctttctaaaaaataattctaggtgagcaatatgatccttataagtttttgaaaatattaacaagtcatctatatatactaacacaaattcttgattatcgttaaaaatgttttgcatttttctttgaaatagggcaggtgcattttttaatcctagtggcattactagccattcatagtgtccctggggacaggtgaatgcagtccattctatagactcttctgccatttttacttgccaaaacccagcttttaagtcaaatttcgagaaatatttgctaccttgtatcctattaatccattcttgcttatttgggatattataggcatcttctatagtattatcatttagccttttataatttatgaccatcctagatttacctctaacttcttccgcatgatttcttactataaatgctgcagacctatgtggacttctactctctcttattgctcctagtttcagcagttcttctatatgcatcttaaattcttctatatctttcggagttgcttctattgggctggtcttaataatatattctgggtttattatattaattttacactcgatagcatttttctcccaatatttcataggaatttctcctataatttggatatcctctaatctttgaacaattttttctatatcctttttagacttaatatccctataccaatttggtgcaaatgcttgtaatcctatgcactctatattggaatttgatatataatagatgtctatattctcactaagttcatattcattaatagatgtctatattcatgtatatatatatatatgtatatatatatatatatgtatatatatatgtatatatatatatatgtatatatatatatatatatatatgtatatatatatatatatatatatgtatatgtatatatatatatgtatatgtatatgtatgtatatatatacatatatgtatatgtatatgtaaatatatatatacatacatacatatatatatatatatatgtatgtatgtgtatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtataggttattcagtctctttctttgcaaatctatcgagttcatccaagtccattgcatataattcaattcatcgaaatcatgacatttttttactatcttaccagctatgtaactcgggatatgttcttatgtttttcattgcttttttggagctatggccctgagttacatagcttgataagaaaatagcgtaggttgcagtcttgcagagatctcagtgtaaatttgattctaatggatgaattgatggtgtggcgtatgtgatagttacttacttagatggtgtggcgtcccgcgccttcccgccgcctacgacgtggagctccgtcgggctgctgccggcgccgccctcctcctctcccgccgaccatcctacgggcagagagagagagatacgaggaaccgagaaagagaagagtgggggagagagatgacacagcctaacatgtgggtcccacgctgactcagccgcaacataggataaaaccggtgtcaaaaccaccaaaggacatattgtcaccggttttgattagttgtggatatctggttttctggtttggatgacaagttgagggaccttcggtgtactttttcctctgggaaacccaatcaggcattcaggcctaagccattcagcccaactatcaaccatgtaaccctagctctaggtgctctccagtctctctcctgctctccacccacacagccgcccgccagcatctgcatctgcatctccctctgcgccagcgacggccggcgcgccccatcgccgcctccgccgtcgacttgccccatcaccgccaacgaggcgttctgccgcctggcgccgctcgtcacgtacgaggacatcctccgcatcgccaacggcgacacctcaccatcctatccggcaagcctgtcagcgagttcctcaccaggtaagtgctcgatctactccctgcatgcgtacatggtcgaccacttcgggagggaagaggaatataactatgtactgtgactctgcgagtccatggttgtgtttagttcacgctaaaattaaaagtttggttgaaattgaaacgatgtgacagaaaagttataagtttatgtgtgtagaaaagtttttatgtgatggaaaagttaaaagtttgaagaaaaagttgggaactaaacaagggtatgactgctatgtgctaatgagtaatgacctgatgtgtgtgactatgtcagtgtgtgatactgtgatgtgtgtgagtcagtgagtgactatgttagtgtgtgcaagtttgtgctaatgacctaatgttaatctgtgtgactatgtcagccgtcagcgtgtgcaagtttgtggatgtttgtcgatatggtattattaatcgctaaaacttgaaaatgttgacattttctattagaaaaaataatgaagttatatttcttcgttgatttgtgatgcttagtttgaggggtttttatgttccgattaatatttgtcaccgcattcgtttcgtttcgtattcgctccgtatctgtattcgataatattcaatcctgttttcatatccggttctgattccaattttgaaaaaataatatgaaaacaaatatgatagagctagtttctgaccgtattcgatccgctttcatccctaatcccagcagtttagtatgcattgcagccaatattttctcatggacaaggcgctgaagtgagagacgacagacgaagaggtgaaaaaaatggagtcatgttttgtaacgccccacgaggacacgccagagacgatagaagaagaggtgaaagagatggagtcttgttttgtaacgccccacgaggacacgccaaggcaagggctctggctctctcccctcgacatagtcatggtcagcagaggccatacccctactgtgtacttctaccaacgtgacactgccactgttgctgccgattttttcgaggtaggcaggcttaaggaggctatggcaaaggccctagtggccttctaccccttggcaggccgtctcagtgtagatggtgatggtaggcctgaaattgactgcaatgccgagggtgcgctctttgttgtggctcagtcaaaactcaccgttgatgccttcagcgaccttaagccatcaccagagttgaggaggttgtttgccccccgtattgagccagcatccatcatgcttggagtacaggtcagtatatatctagtttgtgtgtgtatgtgtgtatattcaattgtatagagctagctttggactagtgtggtgatatgtacctaggtgcacattaattattccttgcaggtgactttcttgagttgtggtggtgtggcattagggacggtgttgcaccatgtcgccatcgatgcccttagcgcgttccatttcttccagacatggtcttctttctgccgagatggtgaagccgccatgttggagctgccctgccatgaacgcaccctcctccgcacacgctccccacctatcgtccacccggatgtgcactcaatgttcagtctaaagctcaacttctgtgagccatcagaccctatatccaccaagatattcgtcatctccaagaaccagctcgatgcccttaaacaaatatgtggtggattgagcacattttgtgccatgagcgcccttgtatggcagtgcatgtgcattgctcggcaactccctctagacgccgagacacgcgtcatcttcccagtcaacattcggcgccgtgtgaagccacctctcccagatcgctacttcggcaatgcacttgtcgacttgaaagtagcctccacagttagggacattgtcttggggacactggatgtaactgctgcccagataaagaacgcattgggacgccttgacgatgagatgctgcagtcggcgatagactacaatgagatggcagggatgcccaacaagcataccaagggaaacctgccagatacagaattacgaatggtctcttggctaggcatgccagtttatgatgcggattttgggtgggggaagccggagatgatgtctcgtgcggagtctgtgcgtggcggatttgtttatatgatggatggcattgacaacgatgggggtggcgtgcgtgtgctcatgtgtatggaggcacgaaagatggaggagttcgagcgactgttttatgccaagtttgcacaatgaagaaactacctagctagaacatgatgcatgttttctgttctattatcaataatggatgtttcatgtaataatataaccaaatacctccatatattttggtggcatggttgtttcagacatgacagggtgtggttgatttacgcggacaccacaaaaatgtggttgatttacaccaatgagctttttttaagataattaaaatggattatatccctaggcccccagcccctgccgttagggtaagtttggtcacaggaaatcgggatggacagtaatcttaatgtaatcctaaccatggcaatcaggcaatagagaatgtaaacattcgtagaagcgtactccctccgttaaaaaaaaaatcaacttctagagtttgaattttatctcacaaaaaaccaatttttatactcctacctaccctccgcacgtaaaacgagaagttttattccttcaataccctttaacaacatgtcactcttactatttttttaatgattaaatgtattttagtcattctcactctctgctaattttatctagggatgctaggaattgactctttgtgggaccgagggagtaggcgttaattcctaatgccgtgtattaattcccagaatgttggttagccggaatatcctatatctctaactaacattcctggtggttttatcaaacataggaatcaactagaattactccacgatttatgggaatatatataatcaacattcttgtaaccaaacacacactagaccaatggaaatgttttttttaaaaaaaaatccaagtctcaggtgttatatataggttattcagtttcttcctttgcaatctatcgagttcatccaagtccaattcatatataattcaattcatcgaagtcatgccatctttttactatcttaccagctcctcatcagggttggcatctaatttttagagctatgtaactaaggatatattcttgtgcttttttggagctatgtaactcaggatataaaaaaacattttttatcaagctatacttaataaaaatacaagtacatagcctgataaaataaattaggggtagattgtagtcaaaataaaccttaccaaattttgacaatttgacaatattgtcaagttttggcagaatttcttatgtatttactaaagttcgattaaaaaaactaaataaatgcacatgtttaacaactttagcaataatagtatttgaaatagcatcaatctgaacagcttgtagatgtcaccatttccgatcttcgtagcctggaacatttttagatagaggccattgcagcctgtaactgaagttctcatctgtatgctgagaagatgtgccaccttgctatccaacagcgtctagcaaacacaactataaacaagcgctgaaaagaagtaaaaaatggaagtggttgataacttggtaggagctatattttgatggattattcaactactgttaatagttgaacaagatgatggaatagcagcaacgtacgcacctcaatcaggtactagcagtcagcagaaggggaggaacctcttgcgatagtacctttctgaaaatattattgatttatctggaatggaggagagcaagtcaaaatactcaccaccttctttgcaacgtcttacaagctgatcattgctgacactgcaggaatataaatgtaggtattcgagggtcgggagccgctggaggagaccctccggaaatttctctatccccgacaaccatcaagatgtaatttcctcagggaagtgaggccatccattccatcgggcagcaatttcagggactcacactttattacgatgaaattccttagacttgccaaatttccaaggtttggaggcagtggtacgaccaaattctggcaactttgaataaacaattcctcgagcgatgcaggcaacttcgggatctccactattccggaacaactagttatatttaattcctctagacaggataaataaaggatttcctcggacaaagaaaaatttattcccaggctggtaaacttaaaaatatgaagggagcggaggcgaatcaagcacctgagctcctccgttggccagcggacaatatcatggcaatctccaatcaccaaatgctccacaaaggcaaagtgtacccatatcccatggtgcaattcagagaaaccggataccgtcgtgaagcatttggggccatgtagattcaaacgccgaagatttacgagattactttctccttggttttgttggtcctccagagaaatcaccatgtttgcgagagaccttacttttaatctcatgagtgatgaccatgagcccagcggcatggtcatagaatcaaagccttctgcgtcgtaactgagataggacaaacttgttacgtgtgcgagcgagctgacagcaatatttgaacatctatctatattcaggtctcttagaaccgggcaatctggaatgcctgcaagtttagggcagtcactgattcttagtatctcgagctggggaagcgtgatgaagctactaggatctcctgaaatattgactgcccatctctccaagtttggtagatttcttaagaacatcttcttaagcttggggaaaatttgcagagaggtaccacatccctcagcttctacatcatcattcgtacataatgtggttaggttatccatgcaagacaaggacaactcctcaagagagaccaagagccatactggtggtagatccttgcatcttggacagtttgaaatgttgagttttgatatacgctggaacgtgtgtgggtctctcatccattcagggatttcaacaccaccatatccatgtaactccaaaactttgaggttactacaataaggtgcaagtgactccaacacacgctcctcgttataggcattgtcattaggcatgcaacgtttttgtcggccccagaaaaacaatacttcacttagatttttcttctggtacatattggcttgttttgccttctcttcgctttttactttgtgcaaattgtacagttccaacctgttggtaaggtgttgcaagtctttgagctcctcaattccacagcctgcttcagtgtccacaacatatgttgtcagagtacgaagattattcagcagaccgatatttgggggcatccgtcgcaaactgtcacaccaatatagataaatatggataagcttcctcattgttctcataccttttggcaaatattctagctcatcgcaactattgagcctcagtgattgtaagttatataacatgcatattgaatctggcaatctaacgatactagtctcggaaaggtcgagaaaccgtatatgctttgcatttgtgatagcactattgataacagaacaacgcaatgctctcactgatgccaaattgaattccacactaacattccataatgttgatcgccatgatcggtctatcagagtatgcagagatgatgtgcctttgaataactcggtcatcgtttcttccatttcttcaggaattcgcaagtgacggacatcttttatcgagcctttcagctgatccaactcttttgttgtactagcacattcatcagtaacatcttttgctaggtcatgcattaaatcatgcattttacaaacaattgaatcacagtgataaccgattatgaactcctctttcacgtcttggaggaacgatctccataccaaatcatggaagatcatttctcctttatgtgtcaaatccatgttctcctcttcttgaataaaaccatttgccatccatagttggattagttcgtctttaaccatctcgtaatcttgggggaaaattgcacagaacgcaaagcattgcttcatttcaggtgataggtgtctatagctcaatttcaatatgtccatgacatcatttttaccttggaccctagccccaatattactttctgcaatgacctcccattctgagactgattgctttgaactcataaggccacccatcgtcttgagagcaagaggcacccccctgcatttcttgacaatacgtgtgccgatggaaaccaactttgcttgctcctgtacttgtttaccaaacgctctcttggagaacacctcccacgaatcatcttcattcagacaccgtagctcataaggttcaagtgtgcccattatagatgccactcgttggctccgagttgtgacgacaatgacacttcctgcaccgccaacagagttcagtagtggctttaggtcatcagcccacttgttttcctcgtcgttccatacatcgtcaagaacaagtagaaaccttcttcggccaaaggcttcctcaagttgccgtcgcaacagctcgatggtgttgattagttggcatcttctatttgtagccaattcaacgatggatttcagaagggaaccaacttcaaagttctctgagacacagtgccacatcttcagttggaaatgttcctggacactggggtcattgtatatcagcttggcaagcgtcgtcttgcccaaacctcccatccccacgatggggagaacctgcaaattctgctgatcatgctgatccagcgtcagtttcaccaacacctctttgtcatgctctcgcccaaatatgtctgctgactcgtccagccccgagtgtgttagccgataaggaagctgtggcacctctacgtgttccatcaggccaaacttgttcatctcttcgaccagctcgttgatcttcttgaggacatcacccagcttcctactcatggtaacacggaacaggagtgggctatgcggcgtgaagaagccgagtaccttgcgggtggtggagtcgccgatcttgacctcgcggcgcagcgcctcgtactcgaagtcgtcgaggacgtcgtcggcctcgtaggcgacggccttgaggtccttcatccagcgcttgacggcggggttggtctcgctcttcgcctcggcatcggccagcttgcactggacggccagaagctggcgctccagcttgcggcggtcgccgtcgatgccgcacatgcgagtgacgctctggacgagcgcgtcggccgccttgccggccaccccacgcaccaccgggagaagtagcgattccgccatgttgcgttgcacagcattacagtcacagcatgaggcgttctcagctgcaaagcacggtggaattaatgaagatgaaaggcaaagcatgaagcgctctgggcctctggtgcgtaattcaagcggacatgtttggtccgtatgagtataatatgacaacttgactataacttttgcgatgtaaaactgaaagctcgactatcttttgcctagtgcattcgtgtcgtggaatccaccagtttggttgcagtttcgttgaaagctcctcggccctcgccgtcttattcttatcagcaaaaacacacttttgctgaaacaaactggcacggtagtcggcaatgccttcgggcttcgaatatgaatgatcctgttgagacgaatgcatcagaattcagaatgcatcagaccccgcgcaccactaggagaagcagttaaatgagacaattttaaatgaaacataattaaagtttgacacgaaaacttatagctacgcttaaaataagacagagggagaccctgactgatttttcctccgatgcaacccatgtaagacaattgttactataaaacgctgtacaccccatgtaagacaattgttactaaaaaacgctggtactgtatagatgctggctaaaattcaacagtttaaaatgtggcgtaacaccatggaagggcacagatgctatcattcgggtgccccacgccacggcacgcaggcatagacaagttacaatggttgcaaaacttcctcagtattttctgatcgggaactagtttcagtacaacttgccaaaacatggcccaatacaggcgctgcgaaaagcaattggtgcggaattaaattcacaacaattcattctggtcatcttcgacttcaacccttttaaaccttaaaccaaaacatagcttcacatgatttgctcactgcccttcaaaccaactggacctgcaatgagagaaaaaaaattgaagcatgtgatgctgagttccatatacaaacaacgtgtgtcagataatactctacatatagcctgataaaagaaactagacgccgatgtaaaatgtatatggtactgtagtttgctaattactctcattcaacactatggtactatacttgtctaattctaaaccttctactccctccatttcaaattgcttgtcattctagatttgtcctaagtcaaacatatactttgacaattaatttttggaaatccatgtagtttaataacatgtcaattacttattatgaaagtatttctcatggtgaatttaaaaatataaatctcatgatgttaaactatatgagtatattgaaattggcggtcaaagattaaaatgattacttaggacaaacgtaaaacgacaagtaatttgaaatagagggtgtatgagctaacatcacctatatccaattgcctctagaaacagaataacagtagtaaataaatctacaaaagcatagtaacttgactaacttctaaacaaaaaataactactccgtaattaccaaaatagcaatagcagctcctactttttacaccagagtatgaaatcgtaccgaacgacaagccacttgctcatcttctggaaatgtatgcaggccccgtagacctggtacatacaaggaatttacagtaaatcagcactaagaaacaagaaagactgtctaactacaataacacataaaaatggttcataccttccctgttgcttcccaccataaccatgcctggtattacctgcaggaaggccagatcgttcctgtctgactccatttgcagaaacagcatgcatggatgactgcccaggtcgaacttcatctgaaaagccattctcctggatgtcttttactttacttgcaattgttacatcaccaatcccctgaacaatgttataaccaacactatcgttgggttttgggatatgtccacccttgtcaaactgatctccaaagctagcagtggtagacccatttctagatggcattacatttgaagatctggaatcaacaacaggtcctctcttttgcctagtgctttgtgccacgggagtgacagcaactgaaggtaacaatgagtaaggagccgaagatgcaacagcggcaattttggcggcagctgtagtagctgaaatgatctgctgtgctccttcccgaaggtgaatgaagtctccttcaatcacaaagagctgcagaacaaacacaacaatcaataacaagaattacccacggttattttacttaatgattgtgaaaatagacctctggatggctagccacaaaatcatctagcttcccatagtgcttcttatagtcatgccaatgaagaggagccaacattttgccaagcctatttggtagctgaaaaaaaaatttgcacatgagtcagtaaatgttccattagacaacaatatatacagttcccactagtcaggaactcaatcataagcatgcatgtataactcacagttgtgctaatcttgattcggccatcaggtccagcaggaactgcacgtacaatgcaagccagaagggatctctcatctagaagggaaggctcctttggtatgcgaggtaagagtgaacccaaaccaccaccagcagaagtatgcgtgtcagtctgattcccaacgttagcagtgaactctgctgcaccacctttcaagtggatttgagtagttgatgcatcaaaatctgaagctttatgctgatgcctagctacctgctcctccgactggttgcccgatgcaactttttcatcctggtgtacatagagctttgatataagatgcttacacatcaaatagaaatttacaaaagaaacaatggtaaatattttaaccttgaattcatttgtttgctcttgatgttcaaattttcgaatagggctgacaattgaagatgaatcctgggccttttgttgctcattgtaaactaaatgttcagttacattggattccacaacctgtaactgttctagaaagaattagattttaaacagtgttaaattgtatgagtacacaaaacgaacaacaagaaaacagactagtaaccttttgttcatgagtggattcagaaaccacacttgggaaacgttgttgttgctgttgtttcccatgggctgtagctgtaagatgttctgcacgggttgcctgattctgcttcaaagaaagctcatcattattaccagcagcttgttgcaatgccttctgatctggtggggatgtgtgatagtttgtttcatctggtgtctgagaggcattctgagcttcctaattgacaaaaaaattgtttccgcgttagaaattataggtggtcaaaatgtcaacagaaacaggatacaataataaaatgctacacagtattgtgtacctgttgattgggccactgcatgtttggttgaattgtcgactgtgactggaaactaccaaactgaggaacagcggagttaggcgatgctaaagatggaggaacaccttgaggatgcatcatataagaatgcatcccggcaatctgcgcagaaggaacaaaaccacctatacccaacagtgatgaaggaacaacaggtacaggagaggcattactgtttccctgaaagcaacaaatattgcagttccattgagaatattcttcttgagtgaaatagaagtgtccacataaaccaatatgatacagtttaactgaatagaagtaagaccaacacaaatcatggatactgaccacatactaaggaagtcgactgaccaatatcaaactatattttgcaccttccatgataagcactgaaaaatgtttcaggaagctacaataaaaaacaaccatacgtccatacctttgtggaacaatctggaactccattacttttcactgactgactactatctgttgttccactaccatttgcagccatgttgttccctttgttctgaccaagtgttgactcggccgaactctcctgtgcagtttgtgaaccatcttttggtgctccagttcggtctcttaattcatttagttctagctgaagttgttgtatggtatgcagaaaacccctttgcatctcaacatactggggaaaagcaagaggacagggtgaagagaatgttaatataacgcagtcaagacatacgcaaacagtagaatgaaggcatctaatgaaccacacatcgtacctgttgttggaaactaatccaatattgattgaattgctcagtacgatcacgtaactcagcttgcattgtctgagactgtaaagtatccatttcttgaactcgtgccatccaagcatgagcttccctcaattgttcatctttgtaaataatgttatcttgagcagccctatgctgtaaataaaatgctcgtcagggagtggctggatgctaatttgaggaaggcaatcatgcaacaaaattattgaccattgatttagaaattctcacaaagaaataaatgttagattgttcatgcatggatacaaagcactagctcaatgcctcaatgttgataatgctttaatattctccctgaaggtaagactatatttgcagcaacagaaaaacaaggagaagccatgtcattggaaaggaattaaaactatcataaagtgtttaaaaccctagttcaacaatatacattgcataacattagaaatgaactgcagtaaactcatcctatgatactaagttacactttctgtaagagtctatcatgttaatcattcaaaagtgaataactaggatactgttataagcacattgtcagtaaagatgtttatgtatcttttgtagtatgactatgcgcatagagacatacagtcatacacaatctaaaatagaatggaaacaagagggttgaaaaaagaatacctgttcctctaatgcaagcatttggctttccttttctcgcagatgttcttggagatcatggatttgtttaagatgctgtgccctttcagcttcagaattgtcacgttcccttctgcagaagataagaaaataccaaacacattttattttctacaacaaagattttgctcaaaccaaaaaaaaaatgtcctggtcagggattgcaaatgactacatgattttttttatttgttatgttcttttgcacaataaaactattttatcatgcataaatgggcatcacatgattcacaaaaaagaaaagaaaagaaaagaaaagaaaagggaatcaacatcacatgcgggtttttcattgagtaagaaaacaagcaattcagcaagtccataaacaactctaatactttgatgaggtgcaactcagctgctttgttgctctaactagtaataaatacggtcatcccacatgatactgaaatgaatcagtagtacctaaaagttgcaagctcttttgtctgttctctaagaagatcttgatttgcccacacctgccaaaaggaaacaaagatggtgagagatcacaacctctaaatctcactggtgcaacacagagcactaaccgtttgatggtcaatcttcaaagcatccagttccctgtccttgtcatccaatttcatttcgagctcaaggatgtacttttcccgttcatgcagttgttcctgtacaattcgaaatcagtattttttttcccactaaaaaggacaaggcaatctgcagtatgtacatcaatcatgtaatgtaccccctccatcccagattataagggatttaggatggatgggataggggcacatcctagtactgcgaatctggacagactactaggatgtgtaccatctatcctaaatccctttatattttgggacagagggagtatagatcatgacttgtgtgtgaaccgtaaactaacattacttgagctaacaagcaaggcactgcacgcatcaaatcaaacacaataacagatatactcagtcaacaacagaacaccacataaccatcattaaggtattagccaaaatttggtaaaaaagaataaatgcataaatttatcacagcataaagaaatatttgatactacgtacttcattctgtaagaagcagcaaagaagctaccgaggtcacccactaagcaacatcctagacatcaaaataaaaaggaacaattcccacttcacgacagtgtaaccatctgtagcaatactgatcatcatgccaacagaaataatgaatgagtgagtagcactcataagcagccaataaccgcagtacaggccaaatcatgtgcaattagtaagttacatgtactcagttcccacctaatgcatgatacgactggcaacacgaagtgcgtgtaagtggaaagcaaaatcagaaccttcagctttgccgcggccgttacatgctccttggcagcagcctcgaagctgcgctgcgcctcgatgatctgcgggtgggcgatgacctgagctcgcagctccatctcaagccgctgaagctcctcccgctgatgcacgacgctctgcaggcgctgctggatgatgtcctcgctgaggcccccgcttccgtcgatggtgatcgagcagtaatcatccagtcttccacccccgtcctgcagcaaaacaaaaagaaaaaaacaatccatcgatcgtctcaaaccgctccacagctcaatccacaaaccaaaaacaacacgggtggcgatgacgaagggagaagtgtggcgcgcacgcacctcgtacatggctctgtcctcggattgccccatcttgccatgctccccgggatcctgcgcaccaagcaacaacaacaacagcacagcacagatgagtacactcaccagcagcagcagcaaccaagggatgggaggggaggggaggggaaccgacgtcggcgccattggagcggagcggggcgtcggggacggcgcgccactccttgcgcgccgccgcggcgtccatccctgcgcgcggggccccttccccccacaagcgggatcgggatctgggcgacggggggtgctagggttttgggggtccctatctctcccccgcacgcgcggggtcggggtcgaggcggggagcgacgtcgccctcaccgcggtcaagctggagcgcgagcgtggcggtggcggtggcggtggtggtggcgatggctagggtttacggcggccgcggcggatggaggaggaagaggaggcgatcggacagagaggagaaaagcgggggatttgggtcggggccgaggcgtgtgattttggggagggattggattggagtattggagtgtaggtgcagggatgaggagaggaggcagcccggtctggt

SEQ ID NO: 74490 - DNA, 4474 bp, Oryza sativa
  unsure (1)..(4474): unsure at all n locations
ttgtgcacgggtcccccaaaccaattggtgttgncggattggcccgccgttgggtgaacaancggtgcggccggccggagctcnccggaaaccgccggtgcgtgggaccggcgtggggaggggaaagagagcncggctggctcgggtaaggaggggaaaagagagaggatgctccggggttcgttttgatagggtcggagcggcggaaacggggccgagaggggcggcaaccggcgcggaagtggggcgccgacggggggtggtggtggctcggccggcgccggtttttgtgggacgagcggggaaaatggtggaggacgtggaggggatcgtgcccacgtcgttggatgcgagctcgggtgcgggagggcgccggattttgcggcgacgtgggcggcaatggcggttggggttggccggcgagaggtaggaggaggagctgataggtggggcccacggtcccacctgtcggccggatggagagagaggagggaaaccgggggacgtaaagtagactttcgcaaggcgcgggccggccgagagagggaggtggcgcacggcccacgggagtggaggggaaggcttgggccaagcccaaaagggaagggaggggattttatttgttttctttttttttaattgattaaatgaactttgtgctattaaaattatttcttgagctccgaaaattcacagaaaatttcagagagtattttagggcaaaagaatattgcaaaatattcctggccaatgatttttaagggaaaattttaattctcccattaattcactcgaataaattgctttaacttttaatataatttcttgaaatgcattattaaatgattttaaaacccgaacgaaaatcggggcgttacaaaagacccaatcaagccgctccaggagaggactgttctgcatattgctccaggtaaaacttctcccttttaaaggaatttctagcagaccaagagaactaattacatcattaaaaatgaatatatcattcatgtcggcttccggcttatttctgtcctcaactgatcggtagaaattaaagtctcctagaaaaatcctattatccattgtcccaaaagacatatttttcagccaactaacaaactctgtacattctgggccactacatgggccatatatgcaggttaaggcccaagcttctgaagattgccttgaaacaaagtttactgtaacagaaaaactatttatttcccctggggttcccgaaaacactttagaggcccaaaccactaatattccacgtgaagcacctcttgagggtgagaaagcaaacacatcaaaacgcttagaagcaaaagtcctaatatcagccaaagagaaattttgttttttggtctctcggacatagaaaacctggcagccactttcctctatcttttgcctcaaagaaaatagtttggtatcagcattcatgcctcttatgttctagcacagcacattctaggatttaaacacattattcatgaggaaaacatttaggagtgcatatagatacagagctaactaaattagcctgcatagagccatataaaataagttcccagcaaacacaaaaggaactgacactgatcacagtccgacagtactgaaaaacaaaagatcctgctctgagcaaagaaacattattcattcctaatcatccatgtttggtcggggaagcttcttccttttttctccccctaagcttgattcagccacatcctcaggattcaggccacatagatccacccccatcttttgcaacaaagataaagaacaatcagaaggggaagaatctgagtttatatcatcttccagaacattgaaatcagattcagtaatcttgctgccagggataaggatttttgatatacctgccaactccttcagctttttagctgactttccccttggcttgcctattcccagtcgatgatcaaatttgagctattggttggcattaagaagcctagagctatgccttctagtaggattgtacataatagtcttcccatccctttttttcacaggagcaataggaatctgaagcactgctgggatgacttctggacttgatggctaggcttgcaaaggtgcaacatctaaaatctcctgatcagaatgcccatcatcagagggggaagacaataaagcccagctagaatgtgctctttttactacaggaggagcatgatcaaacattgccttccgctttaggagtaccagggtcatgaaaggggaactgaatggcagagatgtggggctaggaatttgagctgcctgcatgatttctttagctttgcatagatggtcaattttctccagcaatcctgccataggataaaaagatgggtgctttggtccttccctgtcagctatatccttgagcctggccagaaacagctgcacttgttgctcttgatcaatcagattaagctcctgctcctcttgattaggcaagataatcaattgccccgagttttcttcgacctggcccattgggtgatcctgaccccaagcatcctctatttctgcttccgcagcctgttgctgttgcacgagatcatcccaaacaccacctcccccctgattaccaggatgtcctagttgccaaatatttccatcatctgggtcatcggcattatcatcattaggcccaggctgtggtccagcaggaggtaaatcatcttcaggtgggatgtttgcaaaatctccatctagtacaaaaacagaaatagtccatgattcacctccaccaccattacccaaaggttcctgtaacactatctttcgggggacagagtcaagatccctatactttgctctcacaaacactcttcccaacatctgatctctatcaagctagaaagaaagttgtccaaaagaagctaccgctagatttatatggtgacgatcaacaaaatctagcgggaaatccaagagaagaaaccagccttctcgattaaagtggcaagcacgccagttctgcccttggtcatgcttcacaagctcaacagtatgcatcccatcatatgcagcagggggagagtttactaaggcatctctatgcatgactgaacgaagctggaacataccaactgtcgaagggtgacggtaagcagtacgaacctcatacatgtgtacttcaaagatataatccgagataagcgcccggtgatgatcccattcatgctcagggatggccggctctacaatggtgatgcaaacatcctcatgtcttcgaggcggatgctgtgggatggtgagatcaacacgcggcacacgcaagttaccaccttgatgaaccacttgcgcttgacgaagaaaacattgcggggtagggttgagatcagccattgcaagcgaggggaaattttgcggattagattgaacagtgttcctgggagaggaaggtatatggggagaaaccgccgtctttttggccggagaagatttagatctccaaactaagttatcctcagaactcagtttcggaaacttccccacaggttgatgggccttagtgggcctagtggcacagaagcaggacatatgaccagcctccaggcaggaatgacaccgaacaggcccagagcaattagaagcaatatggcccttatccaaacaacgcacacaggaaggcaagaaatttgaattcaagtaacgcagagaaataggatcatccttcgtgattggctccaccgtcttggtnnnnnnnnnnnnnnnnnnnnnnnnnnccttcaacccttgaagtctcgtgaaaaccgatcttctctcctggagaagggccttcaaacattgaaacacgaatttaaccgagacgtctctttgttgaacagcttgggcataagatttgtctttctgaaccttagaacttttgtgcactgacctcttcttagaaggcaccaatgcccactcctcagcacaatcacggctccaagactcaaattcccactgccaattaggacccccatttctccagagataaaagcgaagggaaaaatcatcacaggaaaaagatctaagacgataaatccatagaccaacttgcttagagaaaacatcaaaagaaaaactccggtctaacaaatgctggacattgagatccgcaggagaaccaccaatggcggctcttaaagccaaagccacagaagaattggttaaccggaaattagctctcaggagatcaacagctaaccggtagtgcatagggctgaacttcaaagagaaatgcaccggagaacgaaatcgaagacgaactttctctcgaactgcatcaccaggggagaagtcccaacccctcggcggtgccggcattaccattacggtgatcactagaaatcgcccatctcatcgcctccgtgaaatccggaagatcccccactgttctcaacacaactaaatcttgagagccaaaagggtaccgagctgtaatatcatttcaaatgggcccagg

SEQ ID NO: 74491 - DNA, 2602 bp, Oryza sativa
  unsure (1)..(2602): unsure at all n locations
ccgcgccattgatgatcgnattcctgctcggtacccaatacaaaatggaagagggaattgctccttgaggggtgtttgtgaagtgaagtgagctcctctatttataccatccaaatgatggttgtatggtggttactggtccgctaaccgtgcataaccgccattggggtgcagcaggaagcaacacgtggaggatcaggccgagtggtgccaaccagggttcagcaaccaggccaaccgtcatactccaccgacttttgtcggtcgatgacgggtgggcccctatgatggttcctgggtggttggttccgccctgagtcggtttgagctgacttgtggggcgttcaatctgtgtgctcacacgtgattctccaggtgtttccttgaaggccagcttcatttctccttcactttgatgtataattcctgcatccaagttaattctccaatcctaatgcaactattatttattattggtacgcatgtaagaaatgctaatttttcctttattcattgtgctagttagcggtcaaaaatgatatttaagaaccgtcaacacaatataggactacacaacacttggtaacacatcgggccaaacagtgaagggcatgaaagcatgtgtgaggtgcctgattcaaataggaggcatgtggctgaatcactggcggaagaccgtgtacatgcaccatccgaggttccttaggctgaatcatccgtaccgccaaaatacaagtgatttcgacgggatggtggaagagggagcacgtccaaagttcataatcggtagtgatatatgggatgaggtgaatgatctcgaagttttatgtggtaaagggagtggaagcacacctgcatccacatcaagcggtgagagccctctttggaaaaagaagtctatctatcgtactggaaagactcccgtcacgcagttgatgtgatgcacgtggaaagattgtgtgcaaaaacatgctctgagtattgttgaacacatcggtcaagacgaaggacagtttgcaagcacgaagagaccttgaagacatgaatatcaggaaagagctgcatcctcaggacaaaggaaatgaccgctactacctccctccagcatgctatactcttagtgctgcagaaaaaatgagtacgtcagaatgtctgtagggtgtcaaagtcacatccggttagctgctaccactcacaatcaaaggtattcttccagataaggcctgagatccaatcagcaagttgtgttagttcttcaaagtgatgaatcacaaggttatcgattcagcttcgttggacaagcttcaggaggacgagattcgaactctttgccagctcgagatgttgttctctctctcatttttcaatatcattgtgaatcttgttgctcatcttgtggaacaagttaagatgctaggtccaatgcatctgcatagcatgtgtgtttttaagacgtttctgggcatcgtaaagaaatatgtccggaatagatcgaggcctggagacagtaaagtcaagggttgaattatagattacgtggatttgtaacttatcggtgtatctgtgccatgtcatgagggcaaaatgtttggaaaaggaacattagggcataagagaaccactgccgacaaaccacgagcatgtcgtgtaatattggagtacgtaaaatggctcatatgtccttatgttttcacacaaagctcatttgtccttattgtttcacataaaaggaacggttagagtataaatgcatattatctcatgaacgaaacttttgagttgcactgatttgtataccatattagcgtatcaggcacagatgtcccgagtcgaattttagctgagacatgagtgtggcctgaggaaggtcgatgaattgtttctttactcgttaaatcaaacttataaaatgttgaacgtactggtgagtggatcaagtctataggattacctgcactactgcacaggaaaagcaatcaaggcagggatttaggtatctcaacgaatcattcgtacggatcagcgctgcaaacctggagtcccgtcaggttttcactcctattaaactaatagtttcgcatatatatttggtgaatgtcacgtaatttgataatccgtgacagtcaccaggggcataaacacttaccgtcaaatggattttactcgtctgtgtgtagatctgtagctagagcaattaatttaattttttatactgcgatggcattggcagcagtacctaacacgttccatgtacgtacggcacgataacaacaaaatatactttttgaacagtaatattcgaggcaaacactgaaccactgatgaatcatgaatggatacatttttaattagattcctgcagatttcatcgtagaaacttccgtagtattatatactggagtagtttactttgtacacggtagtaaactagtaaaatgtagaagcagtcacagctgtaaaaagttcaattgggtctaattaatatttccatatggcaatggaatgttttttgaaggttatatatatgtgcatggttatgtgatattccgtcggagataagtctcacggcctcatctttttctttatacttatcaaccaaaaa

SEQ ID NO: 74492 - DNA, 13765 bp, Oryza sativa
ccgcccgccgctctcggtcccatcccaccgtcgccatcacctgcctccggtggatccgcccgggctggatccgcgacctccggccgtcgagccctctcatggctgctcccgcccacgacatacctcttctgagcccactaccgccgctctcgaccgctctcgcccaccgagggcccaggccacccaccactcgcctctcacctctcactgtcgaccagtgagagagaggagaggagttgagaaaggcagagaggatgatgaatgagagagaggatgtgggtggataagaatgagaaggtgagagatagagatagagggggataaggatgaaaattttcaaagtgttgagacagaaaagatctagagaggagggagcttatttttgcatgcggtcctcctaaacgggcgcatgcgactccttaggaggaccgcatgtgaaaatatgctatatttgcatgtggctagttaagagatccgtttgtgaaaatagtttttttacgtgggtctcttaaaaaactgtatgtgaaaatacgggtctcattcaaataattttgcctacctgttaagttacccttgctcaacaaataaggttatcacctatggaatgcgcttcgttcatgctaggcgtgcgcgcataatggtccaacggcacacatggagatggagtattgggatttgttggttcagatttcagagtaggctattattgggttaacatcagttgctttgtttattatactgtacttatatactctctgttctaaattataacatctatattttttacacaacttataatgatattgtttgaccactaatttatttcatattataccatcaataactacaatattagtgtcacctgaaagtattttaaaatataaatctaattatagaatatatatgatacttggtatatactgtatattgttagtccgaatttgaatttttaaaaaataagtgtttataatttagagccgagggagtacatttaagagtataggaaattttttcagagctcaaattgaacgagctttttgttttaaaaaaatgtagtactccgctactctctttaaaaaaaactcaacttttagagtttaaattttgtcccacgaaaaatcaatgagaagctttatccctttaataccttgatctatttatcactttcactattttttaagtgattaagggtattttagttattctcactgtccactatttttaccttacgatgttagcaatagattttttttttgacgagtgagcagatatatctgcttcattgtttttgcggagactctggacatgaaagtgatgcctatacctgaccgcctgtcagctttgtaagttactgtgctccgtagccatacagcaggactggctttcacgttccctacgggttcttttgtttgcgctggggcaagcttggtaggtagcgacaacatcataggagagagaaggatgaagatggggcaggtctgggcccgaggtacagcgaggccatgtgagtgacctggcgacgagaattggagcgggccgccgtggatataatcaaagcaatgaatgcatatggctccattggccgttgcggccgcccacccgactgtcttcttcccaggtttctcaactcacctgtcatgtttttcacacgcgctcattttaaattgctaaattatgtgtttttaaaaaaattgctatataaaagttgttttaaattatattaatttatttttttaaaaataatacttaattaatcatataatgatacgtgtttcgttttgcgtgcccaggagaaggggttcccaaacacaacccaagtggaagtggaggcgccgcgcctcgtgcgcatcggtaggaataggttcactttggttccttaaacttgatgacagtaagtgatttgtatccgtgaagcacaatatcattgtcacgtcccaaaacgactctaaaatacatcctctaaattatgtctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataacaattattaagaaataaacaaagttaaaatggttttataaaaagaaaaactctaaaaagtcccctttccctccctctccctcttgggccggctcggcccatctccctccccctccctctcctctcccgcggccccatacggcctctccccgcacgcgcgccactgacgggcgggcccgcccgccacccgagctgacgggtggggcccacccgtcatcccctttctcacgccgctcccgccgtctacacgtgcaataaagagggggaaatcactccccgtgatcccctctccctttcccccatttttccctctctctctcgcgttcaaacgggcggatttgcccccgcaaatctcgccggcgccattgatggcggccggacctcccgcgccggtttcctcccttccccggccaccctctctcgacccggctctatttaaaccctccccgctcctcctccttcagtttccgcctctcgccgcccttcctcctcgccggaatcaaggtcgcgccgtcgctctctccctccgccgtcgccatcgagctccggtccgccgccgtcgtcgtcccggatcacctcccacctcggcgccgcctccttcggctttgccgcatcctcgccgacctcgtccacccctccgtttcggtcgccgaccgccggaacgccgtcgaccccgtcgactcgagccgcgccgccgccttcctccgctccggccgcctttttcgtcgtcgccgtcgacctagggtgagccgtggaccgccgcttcttttcccccttcccttcccctctctcggccgccgctccgccgtgcctatggccgccgccggcgaccataggggcgcgggcgccgcctcccgccggccgcaccggcttggccgccctcgggcgcaccgagtggctgccgcgtggggcccggccgtcagccgcccgcgcccttaggtgcggctgacgcgtgggacccacggtgccggccggtgtgagcccgggtgcacccggtccaccgtggaccgtgaggctgccgcgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaggttgaagccgacgttttggaaagcgagcaaggcaagtcacatcatccttgaacatattgaatcccagtttagaaaattattttgatttaaattattgcattattgctttatttaaattcccgcgttatcactgttttatctagccatgcctatttacctttgttatgaccttattattgttattgttattatttccttgttcaccctagaataaacaaaaccccaactagtggacactctactcatggtactactagtatgattttaggtagatgcttcgctggttaattaggcaacattaggtggttttacaactctagactttgggatattcgtatcacctggacaatatggaatggtttgattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaatgcaggttcgtgtgggttcacggccttgattaataatattgtatagctctaggaccatgtttacaaaatagctttgagcaactaagtgacttttaatgctgtttactgcaaaccctaaccctttatattataactcccttgtactcccttgcatttattctgcacttgtgggtgtgtcttgttgagtacggtggttgtactcagtcttgctcaatttttcccaaactcatgtcacatcctaatttttgtttcaggatttataaattatttaataaattattattagaagttatattaaatgttcattaatttacaagtgaagttaaatatgggaaataaaatttcctaaatataaagcatggatggatttaatttttattaaattctccatgattaagtatactttctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggagtaattagaaatgatcttaaaagcctaaaagagaagatctaattttaatttgctaaatttcaatataaaattgggctagataaaattttgttaaatacttctcttgaatctttagttcctagatttttctgggatttatttgagccaaggaagtatttttaatcaatggaatatcatttcatgaataatttaaatagaaaaaggttttaaaatctttcttttggttttgggccgaaagtcagcccaagtctctctttccttctgcctctctcctccccggcccagtcggcccagtctgcgagccgccgctctcctctctctctctcgctgacaggtaggtcccacctgtcagtcttcgtcttcctcgcgccgccaccgccacccgaaccctagcgccgcgccgccgtcgtccccttccaaattcggccgcgcctttccttctccggtgaaatcaatagaggggaaatgatctccgggatctcctccaccttttctcttttggaatcatcatctttttcgctttggaagttcgtggattcgaggtcgaatcggatcggtctctttcctccgaaccctaacctttccttctcgtcgccggtcgccgtgggcctctgtcgccgctcgctagcccctttaaaaggacccccgagctctccgctacccgccgccaccctcgccttcatctctcgccgtcggaagcgccctagcgccgtgtaaccttgtgccgttgtcgtcgccgccgctccagccgtgcttcgccgtcgctccagtcgtcgccgtcgctcgggaaggttgccatcgtggtcgccgtcgcgtcgctgtcctcgtccgccccttcgccgtcgctgaagaccgccggagcatcgccgtcgtcgtcaagccgaaggactccgccgccttttcctcgacgccgccgccgtccgttcatcttccaccgtcgttttggtcatcggtgagttcgccgcgtcgctctctacgtccaggtgccctccgttcgcgtcctcgcgccgtcgttcgccggcgagcttgcgctcccgagccgccgccggtgatgacgtcatcgccgacgtcatcgttgccatccgtcgtagaccggtcgtggaccgttcgatctcggccgtccgttttggataggatcgatctcggccgttcgtttccttagaccgtcccgtgcacccggtccaccgcaaaccctagccgctgacgcaataattcccttttccttttcaaaaataattcattattgcgtcataattcaattaaaatccatataaatgctttaatccgatttaatctttgaaaattcataactaattcattgtaactcagtttaatgtggttcaagttgcaaaagttgtataaaataaagatctacatattaaaattatccataaattgaattaaatttatttaattctttttaaatgggatttaattagatttaatctagtaaaattcataataaattcatttgaagtcagaatgaggtcgttcaagtctcataattcatctaaaattatgatctacatgtttgtttactttttatgtattgtttatttggtttttattagtcttttccttgttttgcgtgttagcttgtcgtttccgtcgttgcgaaggttcgcgagtgcgtcggaaatgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagctatgattgcttagccatgcttagaaacattagcacactattgggataacttatgactcactattatttaatgatggcttaataatagttcacgatggtcaatcgtgattggttaattaattacttgccaactaaaacttgataatggtgggttgtgagcacatggttttgagtgtcgtgctcatgacaattaaggaccggttcgcgagctactgttgtgaaacattaaccgtgccaaccacaagccagcgtgggcaacagctttatcttttgtacagcatgattcattgcggagcaccagactgagaagtggtggagataagcccacgggggtcgctagggagtccatgccttgtttataagggggtgattatgatccaggaaaggtgcgctgtggtggattgtgttgtgcaaggggtattgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctagtaataatttgcttagctcctggtttggagttagatctgtacagctgggcatggttgttcaggatggttgggcctgtgcagcatgggtgtgctgttaagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggtttataccccagttgagctgcctgtgggagtggagccggagcttcgttagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaactcataaaaggagttcctggaagatgaaggctttggtgtctagctcgtgcctgccgttaagcacctgtggtcgtcgccctagtcttccgctgtttcccgtttgtctttgtgtgtgctgggccttcgccgcccatgtaataaattagctatttacgcttccgcttgttaaactctgaactgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagcaatatttttaaaataaaaatcctttcttatttgtgaaaatcctttagtctctctctgtcctgctgcttcatttatcgtcaaaatctgatctttaaaatgttgcttgtctcttttgtttgtagatggccggcagcatcaatcgtcgtggtctggacctgactggcttcgttttggagctgcggggcatgtgcgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattccttctccgccgcttgccagaacgccgcactcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctagcgcgcatggtggaggcgtacgacgcggcccgtatggacttccatcagatggtgcgccgcgggttggtcgagaacaacatgaagatcctggagctgcgtcaggagaatctgcagctgaagaaggacctagacgtagtggaggcgcagctgtgtcagctcaagatcgcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgccgagcccgcgcccgtggttcctcaggaggatggagtctccggcgttggcagcacggaggatgcgctgctgctcaccttccgccctggcccgttgcagaagtagacgagcagttagtaggcttgcgcgtgtgttcttctcgtttgtttttctgctagagtcgtttggggcatggttatgccggtgtgtggtatgactgtgtcggagcctgtctttattttatttgcttaagcaacttgaaccttaataaaccaatttaatagcaataataaattcaagaattttggtagtcgtgggtggttagttttaatagtctgttctctctcttggctggttctgtatgggatatttcagatggtgacaaccaggagaagtgctgctaccggtgatggcaaccaacccgtaggcagcaaccacaacaaccatggcagcccacctccacctcctcccccgcctccaccaccaccactagacaccaacaccatcctcacccaaatcatcgcccagcgggccaacatgatggctgctttcctccaccacatccaaaatccgccacaacataatgctccaccaccacccccacaacactctaaactcgccgagttcctccgcatccgtccacctaccttctctagctccaataaccccgtggatgctttggattggttgcatgccgtggggaaaaagttagacaccgtgcagtgcaacgatgaggagaaagtcatctttgccgctcactaactgcaggggcccgcatctctatggtgggaccacttccaggctacgtagccagaggggcagcctattacttgggcccgcttcaccgcctctttccagagaacccatgtgcccgtcggagtcatggcccttaagaaaagggaattctgagagttgaagcaaggcaaccgctccatgatggagtatttgcatgagtttaacaacctggcccggtacgccccggaggatgttcgtgaagatgaggagaagcaagagaagttcttggcaggaatggaccctgagctgtccgtgcgtctggtctccggggactatccggatttccaacgtctggtggacaagagcatccgcttggaagccaagcacaaggaactggagtcgcacaagcgtcgcttggcgaatttccgcaaccaacagggggctaaccaaagggtccgctacaccaatccctatccagggggatcctcctcgcagcagcagcagcagcagcaacctcgctccacgtcccgacctcaattcgtggtgcatgtcccacagccgcagcaacagcagagtcagcaagggactcgtgcgccccgtcctcctacgccagccgtgcagcctgttcaaggccgcagggacgctcaaggtcagcagcgtctgtgcttcaactgcttcgagcctgggcactttgcggataaatgcccaaagccgaggtgccagcaaggccaagcgcctccccgctccaacaacggtggtaaggatgtcattcggggtcgtgtgaaccacgtgacggccgagaacgtgctgacaactccagacgtcatcgttggtacgttcctcattcattccatccctgctaccatttttgtcacgtcccaaaacgactctaaaatacatcctctaaattatgcctagaataattaaaatccgtgtgaaagccttcaacaaataaaatgtgcaaagttaaaagtcaaataaggcttggaggatttttgtatatttcctagaaagcctaaaatgcgtaaataaattttagtggaattttcagagcacaaataataattattaagaaataaacaaagttaaaatggttttataaaaagaaaagctctaaaaagtcctttttccccccctccccctcttgggccagctcggcccacctctctccctctctctcctcttccccgcggcccattcggcctcctccccgcgcgcgcgccggtgacgggcgggcccgcccgcctccctcgctgacgggtggggcccacccgtcatccccttcctcccgccgctcccaccgcctcgcccgcgccctagcgccgccgccgccgcgaatcccgccgcctcccgccgtctccgcgtgcaataaagagggggaaatcactccctttgatccccggtgcctttccccccatttttccctctctctctcgcgttcaaacgggcggatttgcccccgcaaatctcgccggcgccattgatggcggccggacctcccgcgccggtttcctcccttccccggccaccctctctcgacccggctctatttaaaccctccccgctcctcctccttccgtttccgcctctcgccgcccttcctcctcgccggaatcaaggtcgcgccgtcgctctctccctccgccgtcgccatcgagctccggtccgccgccgtcgtcgccccggaccacctcccacctcggggccgcctccttcggctttgccgcatcctcgccgacctcgtccacccctccgtttcggtcgccgaccgccggagcaccgtcgaccccgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatgtgtcacgaccggaaataacccaacgggcgttccttacgtgcgtgcattattccttgtcccaggaggcaaggtacaccaaaagttgatacagttcggagttcaacaagcggaagcgtaaatagttaatttattacatgggcagcgaaggcccagcacacacaaagacaaacgagaaacagcggaagactagggcgacgaccacaggcgcttgacggcaggcacgagctagacaccaaaatcttcatcttccggagactcctcttctgggtttgggaaaaattgagcaagactgagtacaaccaccgtactcaacaagacacacccacaagtgcataataaatgcaagggagtacaagggagttataatataaagggttagggttgcagtaaacagcattaaaagacacttagttgctcaaagctattttgtaaacacgattctagaactatacaatattatttatcaaggccgtgaacccacacgaacctgccttaacccaaggcctacgatgattcagaccgaaccggcaccccgaccctgggtcccagctcgtcccaagccaacccaggccaaccattccccattttagttgttaagcaggttttaagaatttaaaacacttacctgggtacattgctcggcttgcccataaccgagggcgcggctattcgaataggttatactctgatcagaggtgtacatctttacccacaagacacatcttcctcacgtgtaaccacgtgccacataccaccacggtaaacagacggaagacgtgacatagtttccaacccatcctagccatagacaagagtaccgacccaatcccacctacggccggacccccgggataggtaggcaggactgagcccctagcagcaggacaccggccctgtgccatgacatctcgactaccgggctgcagctcgtgtagccttcatttgtcctagagatgtccatcgacccccgacttcttccatctccatccatgtacttttgtttataaccagactgagccacaaactaagccttacccactagacatgtggaagtacggtagtgctttgcaacagaggcccgaagaccggtccttatatggccgaggtgctactatgaaaaccatacaccccgagcccagcctaaaaccattttggggattttgaatagaaggagcggtgtgaagccaattccacaataaccaaaccattccatagtgtccaggtgatatgaatattcccaaagtctagagttgaaaaaccacctaatgttacctaattaaatagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaagcaacataattttataaactgggattcaatatgttcaaagatgatgtgacttgccttgctcgctttcccaaacgtcggcttcaacctccacgaagagcggatcttccgaagctgcagcgtctatacgaccaatagaaaagaaaaggcttttactctaataaactccatataacaagctgaaacaaagcacaaaaatgggtttttgacttcttaaggaaaaattagagacttgaacggtccaattccgagttcaaatggccaagttatggccatttgaagtttatatgctctttaaatgaatatttgcgaatttcttcatttaaattttaatt

SEQ ID NO: 74493 - DNA, 12258 bp, Oryza sativa
agagaaatgagagagctattgcttgaggtgtgtgtgaagtgaagagagtgagctccttatatagaggtagttatgacagttgtggaaggggaattgtccgaagtgccctccaaccgtcattgggatgcaatcctggacgtccaggtcaaaacctggatccaacggcgccaggattggtccaggttcggccgaacctagggatggcccaatccagcccaatttcggctggtgtcctcctctattgctccactccatagacttgtgaattttggcccaattcattgtgtcagttctgagttcttggcccatctattcataagtctggttctcgacatcgttcgattgatttatcatctaagttgatgtcgattctcctccactttattgtcattctctgcaaaaggttagtaaacctaatactggtagaaaattattactctaacatacttatggattgcaagtatcactagttctctcctattttggtagtattgacggtcgaaactgatcgataacgaccgtcacaccaggatacccaccaggatacccaccatatccattgttgccataaaacaaaaagaaaaaataaaataaaataaaataaagttggctcccgcagtgctaaggaacgtacgccccaggatgagcggcgtctcctttcccgtctccatgtccagcaccaggaaatcaaccaggatgaagaaatcccgtatcttgactggcacatcctccgctatccctgccgggtaacggactgacgaatcagccagttgtaggtgcatcggtgttgttgccaacaccgtgaagttgagcttgtcgaaaacgtcttttggcatgacgctaccactggctccatggtcgcacaaggcctgatcgaactgctatgccccgatcgagcaggtgatcgtgggacaccccggatccttcttatttcccgggagcttgtggagtatcacgttgctgcattattttgtcagcttgaccacctccgttgttgggagcggtctctttttgttgagtatgttcttgaaataacgagcttatgttggcacttgcatggcgtccaacaacggcacgttgatgtggatcttttggattacttcaacaaaacgagcgaattgctcgttcactgacggtttcctactccgttgagggaatggcaacaaccttgtgtcgcagtactactgcggcactgtcttttctggctgaacttccttgtcagccgagtcaatagatggtgcttcttttgatatcccatcagttcctgcagggttaggatatggcggatcacgagtggacttacctcccctcgttatgatcaccctaacattttcaacagaggagtcgggttgccccagaaccctcctagattcatttgcagggactaaagatgccaactgagctaagtgggtttctatcattttattgaagctgagttggttttggaatgtggaagcaaagccatctagcttgacatttatgttctctaggatgttatcattggcagcaagctttttgcttagcgcgtcagtggttttagcttgcgcaaaaacaagatccttcaaggaggattggttagagaagttaccgttattgttacctccttgataatatgggcgtggttggttccaccgctgacctccttgtggacgatacccgttgttgttgttgcccatgtacatcgcctcctcacgggtttccgggcagtcattcctagaatggctcgtgttgctgcagacctcacacgtgatgtgatagtccaaggccttgacggtgccttgtggctgtttctcgtggtcatccagccgctttatgaggaggtccagcttggcagcaagcagttccgtctccttgacgatgtgcatgccttgctgatgggtctggagtcgttcctcgctccaacccatatttgagaccatcttctctataagatcaacagctccttgaacagttttagagaagaatgctcctccagctgccgtgtccaggtgatcgcgggacatcagggtgagtccattatagaaattcagcagaatcagccagttgtccatcccatgaagaggacaggcggccacgtactcctgcagtcgttcccatgcttccggaatagactcgtctcttgtctgctggaaactagaaattcgtccacgaagggcgttggttttgcccatcgggaagaacttcgagaggaatgccgtagagcatttatcccaggtgttgatagcagcacggttggcatagaaccactgcttagctctcccgaggagggagaacagaaacagtcgcagcctgacggcgtcgggactgacgcccttgatggtgtacgtgctacatatctctaggaattgttgcagatgagcattggcatcctcattaggcttgccacagaacgggctagcctacgccatcgtgatgaggctggaattcaagtcgaaattcatgtctcccatgttgatctacggcccaatggccacattgtcagcagagggagcagtgaactcgccgagagtcttgctaatgatagtcttgaagattggtggtgctgatacggctggtttctctgtcggtagagttttctgtggagcaacgactcgcggtctgatgctccggaggaaagcttctggattttctttgaagttcttcggcaatttgaaaccagtcatgcactaccctgttttcacaacaaaagtgaaaacaaccaaggttagcctgcaaaggaaaatgattatacagaggcaaatataaagtattagttcaagtaatctctattatgaatcttccccggcaacggtgccagaaatgcttgttggtatttcttaacgatattactagaaatataattcccaacaatggcgcagaaatacttatggtatattatggttacagagttcatccgcaagcgtacggatataccattgtagcatttcacctgagagtattccaagggtatcgtatttattttatccagtgggaagataatgtagagaagacttgactaataatttatatattgcttgtgataatcatattctaagcaggggttcagataatccaaggatagagtgacacacaagctttaactactcattctcataatatattatctatgctaggtggaaagaaaagagaaagataatctattcctatacttctaatatacatagtatacatacatcctagttagctgatatactagctaataccctctttccgatgccctcctggtacttcgagaagccacccctgactgccgagttccttaagacagcccgttataaccatacatcaggggctaaatacggaggagtacccaccccaggaaattaacttaggattatatataggcgtggaggaatacccgtactgatctgtcaccataagcggcccacctctcatccgcaatatataacccctaataatgatatcccgtaatctagacaccacatctaaactaccagatactactctaatatcatcatcatgacatagagtaattgcataagcaaacattatacctgcaccaaagcatctcccagataagctagccgtatattcagtataacaacagcataatgtaaagtaggtactcatatactcggaaagtatttcaataccataaatgtatttagaagagtattctaataaaagtactaggcttacaaaagagaaaaggaaagctgctagagccatacccgaactcttccgaagacttccggactcctgatttctactctattcctattccaacagctagatattactaaactaagcttgagaggaatgagagagctattgcttgaggtgtgtgtgaagtgaagagagtgagctccttatatagaggtagttatgacggttgtggaaggacacttgtccgaagtgccctccaaccgtcattgggatgcaatcctggacgtccaggccaaaacctggatccaactgcgccaggattggtcaggttcggccgaacctggggttggcccaatccagcccaatttcggctggtggcctcctctattgctccactccgtagacttgtgaattttggcccaattcatcttgtcagttctgagttctttgcccatctattcataagtccggttctcgacatcgtccgattgatttatcatctaatttgatgtcgattctcctccactttattgtcattctctgcaaaaggttagtaaacctaatactggtggaaaattattactctaacatacttttgcattgcaagcatcactagttctcttctattttggtagtattgacggtcgaaactgatcgataacgaccgtcacaccaggatacccaccaggatacccaccatatccattgttgccataaaacaaaaagaaaaaataaaataaaataaaataaagttggctccttggtcttcactctcgtctttctttttcttttagtgtcaaatgaagagtcccaggaacaacgacaagtgtgggggtgatcttgcacatcaacgtcgtaactgttggtgcgaaaaacacgtggcctggaagatctgcttaactccaatgcaggtctaggaaatcttgcttttggacctatgagcgtgccaattgatttgatcctgcaatcaagaagaaataaagacaaggaaaccgtggttaaatccataaacgatagccgatcggctaatagccgatgacatatcatttatctttgagccgatgtcatatatgcatcgatcggaaatcatgaataaataataaagaactaaatctactcgatcagctatagatattaacagtatacaatcttggtgtcggtatatatttaaatcaagtgattgggatagatcggacgccaagccgagacagtataaatctcttagatcgaaatatatattaacaagaagattatagacatctatagcatagccgatcaggtaaatctagcatgtattggctaatactccgataccactctatattaagatattaaagcaagcaaaatatatcaaacaagaagcttaatatacctaaaagcagtaagatctcaacataaagggcagatctatcatatcaattaagcacataaaatataaggctaaatctggtaagatcggctgaaactccgatgaaaccctaatcggcaaccaaaaacaggctagagattgaagttctaatcacgacttataagatcagacaactgatgcagccaaaagtatgaaaagaaatacaatatctagataatcaagccattgattgtttcataggatggtagataccctatataatctaagccaacattgatatttaacttaatcggctatcttctaacgatagatattagccggttgaaggttaaataataatattgtcaaagattatataaaatatatgataactcgacaacttacataaacaagattagagtatcataatgatggaagcactaatatcgagaacacaagctgccataataacttttacctctagttgaagatcgaaaccgatgcaactcaatctgaaggcaagaactcgtcgaaaccaaatgaaagttaaagggtggcgattcgccgagattgcattgattgtgtgttcgtttattacatggggctcggggtctatttatacccgagattacaaaatatgtccatgtcggacacgactcttatctctaacaaactataatataccataagtctttgcggtagacttttgcccaaacttatctctaaggaaattacatgaaatatcctaactaatagatacaattgcctttccaggactcaatccgtgtgtggcaatccatatgaagcacattaacttaatccgacaacgtgtatcgaatcatattgtcagaatcggcttgatcggctaacctagtccgactcgaactctgtcgattaaggtcgcagccgattcttgctctgtttccagaacgatatttgtcttggattccgcttcgatctaatcttcatatccgatactcagattagcaaatttggttgttaacacatgccccccaagtccggaatatttggtaatgtttcggatttgccatatattgtctccaagagaatatcgcacttgtcgtttttttaccgttactccagcgctttaaatactaaccgtcaactctgagaaacttcacaccgtttcctccattttcactgctgaagcaaactcctccttctctctcttcggcgatccgctcggcgcgcaaggcgatttccaggcgatctcctctccgaccaagtttccgcccgcggcgatgtcgacttccgccaacccatctgccgtgccatcggccgagtacgcagaggtatgtgcccatcggctagatccctttttcccatgcaatagatcagtttttcttcatcttatcttgttttcttcttctctattccttttggatttgtagcatctttccattctggttgcagtccccagtttgtttcacgatcaccagtattttctcggtccgattggcagtctcgacccctatgagttcattagtgctgagaccaatatgatcccttttagactggccaacccgaacctaaatcacttgaaaaacaccttcaaatcctggccttcacttgagaaaagcaatcccgagaaaagttggcctgtgtggtacaagcgagtatcggctagcaagcaggctcactgggacgaaattggaatcggccaggcacttgcccttactctagctaattcggctaaggatgagccactgatggccgctgcagcctatttttggtccaatactctcaatgctttcctcttcatccaagggccaatgataccaactctgctagatgtcaccatgatcattggcttagatgtgacttcatcagccaacccaataagcttaaacacgaagaatacctttgaattcaaaagcaagagcattggagactggtcgggttacattgcagcgtatatgggcaaagggcctatcacctcccgagagcatatagcctttctgctaatgtggctagaaaaattcttattctgcggatgaagttgtggccccacaaccaactggcagttcttagccgaagccctagagacaaaaaggcaatttcctttaggcaaaatcctcctcggctacttgtatcagatgctgaacaacgcatcagctaagatagctgtcggctcagtcgtcggtgcaggtggaccacggtggctactgcagacttggttaaacttggtagccatgaaagctatcaatcggccagctgtgacagttgttgaattccctagattagagccgatcacagacaatgatggagaagagcgtacccactgcaggtgtatgtcctatggggagtatgcatccacaccagccaatgctggagcaaagttatcggctgagtttctgaaggactggttcttcagtttctatgatggatttcagaagaatgcccgagtttggtttccatatgcagactcgacggatttagatctgctggcagagttcagatttgaagacatcaaccatgagaaatatcaaaagtctagagaaatcttcgctgccaccattagcccctgcattcttcctgttagtatccatcaagggagaaatattcaggtttcttatgagttctaccatccgataagctcggccaggcaatttggaatgggccaactcccaatcggcttgtactttgccgataagacacaatgtagaggagatatttcttcaagcttgatgatggatcggctgctcaacatctcaagacctcccttgggcagcattgagaacatagagctagcaagttttaggagtagggcctttgatagatggtggagtgaatggaaactacatctattccatcaaccagcttccatgtatatgacagacctatttccggatgtcatccctcaggtaaatctttactttgtcaattctgctaaaataaccgtcagccgattggtaccttgactaacttcttcttctatcttgcagacaacagaatcttctcctcctcgtaaaagcaatagggacaaggacatagaatatgctctaggcctcataccagacagaggtggaccatcaaccccaatcatcggctaccatgcccccaagacctcaagtctactccaagggctaataagagaaccgggccgatgctggcaagaagagaaataccaaggtatcggctactgacccatcagctctagctccacagaaaaaagccaagaagaagaagtccaagccaaccgatgatttgcctaccttagatccatctatcgaacaagccctggatgaagaggaaattggagaagatgttgatcaagctgcagccgagctaagtgacctaggagaaaaaacaccatcggctccacctaaaaagacgcctccaactcctgcagctccaactcactttacaagggtaacttatcctgacaagctcttaaaaaatttccatatagccgatcattcattgaacttgtatttgtagaagaagaaaatcgcttcaaagaagacatcagcaaaagcatcatctaaaccagttccatcggtaagactccttctgaagaatcttttaaaatttaatcataaccgatgctaatttacatttgtctttttagcctactcctcctccttcaccccctgtgcagccgatgtcaagcggccgtactccaatggtcatgggcagccatcatattgaagaagaacaacaaccagccgctcctgctatcccagtaaatctttcttttttcaaaaaccccaaatcggctgtacaacatgcttcagtgttaacccttttccaactttcatctttataggtcttagccgatctattctcttttgacatcaaggactacttcgacgaggtggaagaagacaccaccagcagatccctagctcctctatatgaagatgttagaagaagtctcgaagacatttgtcatcgtctagaggcatcattagacagcttggtgaccgactgcggttctattcgggcaagattcaaaacaatccaaacctcaatcccatatgacctatcaaacgtccttaccccagctatataccttgaacaacatcaactcaagctagagaaagcaagacaaagactagctgatcggcgagagaagaaagacatagaggcaacaatccaagccaatcggcagcttgtacatgctgaaaaaatcaagctggatcatcttgccaaagagccaatcaaatctaccattgaccaactaaaatctgagaagattgagctcttagctcgccttgaagaatgcaatgctaagcttgctatggaagaacagaagttagccgatctcccgagggcaattgaagaacaaaaatcgaagttaagatcagctaccaagaacgtagctgatttgaccaagtcccttaaagttattacttgaaccaatgctcaagttgctcacgccatcgaagaaatcgaagaaatcaggcaaaaggcaatatcggccatccaacattatttatctgcataactgatcgactgtaatagggacttagtaacttttgtatccatttgtgtaatcagctaagaaactttaacactttacttaattgtcttgatgatcctttgtgccgattaatataacttgctcaaaaattctcaatttttgtatatatgtgccaccctaattttgcaatgacgaaggcattgataaaattataattcagactaagggcgatatgttacatataggccatcatacatcagcagaacacaaccgattatgaaaaaacaaaaaccactaagggcgatataactatatcggccatctcaaggcgatgcaaacacacatcggctttacacgcatcggcagactcagccgatcatcagttaacccatacactagggtaatatttcttttaatactttccattaagtgctcatccataaacttctccatcaagtccttgcaacatataagctcctttagacacaaccttgtggatttgaaacggtccttccaatttggtgaccacttgccgaatttattatcacgagttcctaccggcaagattaacttccaaacaagctctccctcagaaaaagacttgggcactactttcttgttataatgtcgagcaaccctctccttatccttggtaacttttgcaagagctcgcaatcgtgactgaaccacatcctccctctcatcgggcatgagattataatattcgctggctgtcaattcattttgtaagtctgttcttctcgagctgattctaatctcccatggtaaaactgcttcatgtccataaactagcttataaggaggaacttgaattgatccatgacaagtcatccgataggaccacaatgcttcggccagtctagtatgccattgccgaggataatcagaaatcttcctcttaatcaatttaatcaaactcttgttggatgccttggcttgcccattaacttgcgcataatatgatgaagaattcaacaatttgatacccatgctatcggcaaattgaacaaactcatcggacacaaaaatcgagccttgatcggttgtaatggtctgaggaataccaaatcgataaataatatgctcttggacaaattgtatagcatccccccaatcaactttcttcaaaggaatcgattccacccacttgctaaagtaatcggttgctaccaatataaacttatgtcccttactcgaaggtggattaatcatcccgatcatgtcaattccccaacctctgaatggccaaggtttgatgataggattcataaccgatgctggtgcccttcgaattgctccaaacttttgacaatcttcacaacccttgtaatatttaaaacaatctttcaacattgtcggccaaaaataccctggacgtctgagcaaccacttcatcttatgagccgattgatgagtcccacaaattccttcatgtacctcgcctattgcaaccttggcttgatcaacactcaaacatttaagcaacactccatcaattgtccgataatacaattcatcatccagcaaggtatatttcaaagctttataacacaactttcgtgaagccgattgagacggattctgcaaatatcgaaaaacatcatgccttcaatcatcggctgttattgtagcaacttctactttaacatctttcatcatcggcttgtaccccaatgctccttgagccaaatcattagcttcaacgttttgctcccgagatacatgttttaaagtcaccagccgaaacccatccatcaactttcggcacttctcattatagatcaccaatgtatcattcttgcatttatattctcctgccaattgactaatcaccaacaaaaaatcgcccataatctcgatagcatcggcttcaacttccttgagtaattgcaaccctttgagaaccgcttcgtactcagcctgattattagttgcataaggtttaatagtataggaaaacacgaaacttgcctcccgaggaggaattataaccaagcctataccacaaccatgagtgcacactgacccatcaaagaacaatgtccaaggcacaatgtaaactgagccgattgagccatgacgatgatccactataaaatcggctatagcttgtcccttaatcgccttcggtgaatcataccgaagatcaaactctgttaaagcaaatatccatttaccatcccttcctttcaaaattggagccgatagcatgtatttgaccacatcggctttacatatcacagtgcattcgttggacaatagataatgccttaacttggtgcaagagaaatacaaacacgagcacaacttttccacaggagaataccttgtttctgcatccaagagccttcagcttaaataaaatacagccctctctttgccctcaagctcctgaatcaataccgagccaattgacttctcaccagctgacaggtataatctgaaagatatcctcttttgtggaggaatcaaaactggaggggaactaagatattcctttatattatccaaagctttctgttgctctaccccccaagtgaattgtcgatcggctctcaatctcaataaaggtgtaaacggttccaatcttccagataaattagagataaacctcctgataaaatttatcttgccgatcaactcctgcagcttcttcttgtcatctggaggctggatcttcttaattgctttaatactcctttgaatcacctcaatccccctttcataaataagaaatcccaaaaactggccagctgatacaccaaaagcacactttgtcgggttcatcttcaagccatattttctagttttctcg

SEQ ID NO: 74494 - DNA, 1648 bp, Oryza sativa
ccagacgctcgatggttaggtatgagagggttccatatttctgtttcatatgtgggttcataggccactctgacagagactgtgttaagaaggtagctaataatgatgcgcccttccaatattctgctgagctacgctgctcgcctttgaagccatttgagaagaaggtgagcactgttaaggggacagaggcttcgactgcttctcacaggttgtcgttccgcaaggctggtagtgcaagctcatcttcttcacggagatatcagggggaacaatgggatgaagcagtccctccaagggtggacacacattacggctttgatgctcaagagaaagtgggagatgaaacacttgatgaacagttagctagtcagacagacaagttacatgtttcagatgaaaagggatagctacaggacatgatggctacaggatcgacaaaactgaagatgggatccatgtccgggttgtcgtcggcgaagcagcagatggttgacatgatcccggctattgcgaatttacatcaggcagcttcttttggggatgtttcttcagaagacactctcagtgtccataagagacgatccacagaacaactcgggaacaagaagtcagggaaagtccaacaagccttgctgcagcatgtgttggaagcagaggaagacatgaagaagaaggaaggtgcagggctgcaaggaagagaactgaagcgtttcaagaagacagctgcggacggtatgaatgtgggagaattggaagtgaccagcgccggggctgctggtacactggcaggtcctatgttgggatcccgccaggaacaatgagttgcctaagctgtaactgccgtggaattgggaacgccacgacagttcgcgacctatgtgccttggttcgcgaggcaggtcccaagttagtttttctttgtgagactagacaaaagatcgaaacggttcggcgtcttcgtaatagattaggtttaaaaagttgtgttggtctcagttctgatggtttgagtggaggtttagctctgttatgggatgagtcagtttttgtggatattaaaggaatgaatgaaaggtatattgatgcgtatgtgcgtttgtccccggatgctcctatatggcatgttacttttgtatatggtgaacctaaagttgagaacaaacatcacatgtggtctctgttgaacttgctgcgacaatcatctactttgccttggttggtgatgggcgattttaatgaaacactttggcagtttgaacacttcttcaagaccccacggaatgaaagacagatgcaggcttttagggatgcccttcatatctgtgagctacatgatttgggtttcagggggctaccatatacgtatgacaataagagatagggagttaataatgtcagagtgcggctggatagggcgggggcagatgacaattggagtgatcggtttaaagagtcacaggttgaacatctggtgtccccatgttcggaccatgcccccattctgctgaaatttgcggttgaagagagccgacgggttaaacgcaaatgtctgcattatgaaatatttctggaaagagagaatgagctcccaaaattattgacgaggcctgggcagtagcaggtgataaaatgaacttatctgatg

SEQ ID NO: 74495 - DNA, 1013 bp, Oryza sativa
tagagtgtactctagaactagaagtgagtcaactcgattgatgccatgcgaccacagacagacttcttgtgtctttctttgtttaactatgcatgttggaaattctacagtttatatgatccagttgtttgattctttgcacagccaagagcatcccctcgggaatttgtgatattagttggaaggaaggatatttggctgtggtaaaactggtattgataaatagagcacagatgcggctaactgttggccaagtgcatcgacatgtacttgcattggcatcttctcggtcatgcttcgtccttggtgatcaccttccattcagaatgctttcacttccacgagtggtaagatttcaccaaaccgcttggcatgatattcaaactgtggaagataagagtggtccgctaactctagctagtcttgaagtgcaaaacaaagttgaatatgttaagaaagaaagagcaacacgtactggaggcataaagccatcttcaagggcttcagctcttaatatgaaaccaaaagtttcttcattcaatgccaaaccagtaaagagtgccttgccgaaatcagcagtactgaagaagactctgaagatagatgaatctcttttttctgcaaaatcatttgaagaactcggtttgccacctttgcttatagataggttgaacaaggaaggtcttactgctccaactgaggtccagtctgctgctattcctatcatttcacaaaagcacgatgcagttatccaatcatatactggctcagggaagacacttgcttatcttctccctattctttctgaaataggccctctgaagaggcctacagaacaagacagttctgataagagatcaggtgtagaggcagttattgttgctccttctagagaattaggaatgcaaatagtgcgagaagtggagaagatattgggccctaatgataagagacttgtccaacaacttgttggtggtgctaatcgttcgaggcaagaagaagcattgaagaag

SEQ ID NO: 74496 - DNA, 690 bp, Oryza sativa
tattgctattgttattattaccttgttcaccctaggataaacaaaaccccaactagggggtactctatttatggttccactagtatgaatttaggtagatgcttcgctgattaattaggcaacattaggtggttttataactttagactttgggaattctcatatcatttggacactatggaatggttggcttatggtggaattggacatacccctctcttcctctttcaaagcccctaaaacctgtttttcgggggggtttgggtgcatgccagttgtgggaagtagcaccccggccactataaggattaagctcgggcctctgttgcaaagcactaccgtactttcacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctggctgtcccgggggttccggccgtaggtggggttgggtcggtactcttgtttatggctaggatgggttgggaactatgtcaacgttttccgtcccgataccgtggtggtatgtggcacgtggttacacctgaggcaagatgtgtcttg

SEQ ID NO: 74497 - DNA, 2177 bp, Oryza sativa
atttttccctctctctctctccctcggattcgtttggaactttccccctaaccttgccggcgccattaatgacggccgggactcccgcgcccgtttccccctcctccggccaccccttccctctcttaaccctatataaaccctccccgtgcctccctccaccgtttccgccgctcgccaatctctctccccgccggaatcgagctcgcgccgtcgctctctctccgccgtcgccgccgagctccggtccgccgccgttgtcgccccggaccacctcccacctcggcgccgcctcctttggcttcgccgcatcctcgccgacctcgtccacctctccgtttcggtcgccgaccaccggagccccgtcgaccccgtccacccgagccgcgccgccgccttcctccgctccggtcgccgttcccgtcgtcgccgtcgacccggggtgagccgtggaccgccgattcgtttcctccttccctcccctctctcggccgccgctccgccgtacctatggccgccgtcggcgaccataggggcgcgggcgcgccgcctcccgtcggctgtgccggcgtggccgccttcgggcgtgccccgcggctgccgtgtggggcccggctgtcagccgcccgcgcccttaggtgcggctgacgcgtgggacccatggcgccggccggtgtgagccctggtgcgcccggtccaccttggaccgtgaggctgccgcgtgggccccactcccgtggacccagtccgcgcgcccctcccctcggctgacgcaataaatccttttttttttctttaattaaaatttaaatgaagaaattcgcaaatattcatttaaagagcatataaacttcaaatggccataacttggccatttgaactcggaattggaccgttcaagtctctaaattttccttaagaagtcaagaacccatttttgtgctttgtttcagcttgttatatggagtttattagagtaaaagccttttctttttcattggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcactggttaattaggcaacattaggtggttttacaactctagactttgggatattcgtatcacctggacactatggaatggtttgattattgtggaattggattcccacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggtccggccgtaggtgggattgggtcggtactcttgtctatggctaggatgggttggaaactatgtcacgtcttccgtctgtttaccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcatgggttggcttgggacgagctgggacccagggtcggagtgccagttcggtctgaatcatcgtaggccttgggttaaggcaggttcgtgtgggttcacggccttgataaataataatgtatagttctagaatcgtgttta

SEQ ID NO: 74498 - DNA, 7586 bp, Oryza sativa
actgcgcccctttgaaaatcgagttgcagctcggtaccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgatggtcaggccttaagtgcctttgtaataatgtaaatattatcgatataataaagatgtgccttttgtatcatgtttgttcggtgtaccccggctttttcctgggatggggattaatacactagcattcgggaaaaggtaattttctcggtcgcgacatagtactgatgcagctcttgactatcagtacccattctaggtaactcatggtcgacaaaactacaaccaatggcatccctagctggagcgctccctgatctaggatcttatgtagatctagttgttttggaggtaagaatgactattacgcctttccttttcttttaaattttcctctttcacgatgcagcctgctagacaccatcagtggagatgaattggcctaagtacttttttgaaggagggcgatctacggacatttcatcgaagtctgtagcgtgggactgaaaatgagcttcattggccagaggaggtcaaggaactttagctgtcgaaccagagcaaattcggaatgctgctaatttgaccttggagtaatctttatgatgatgagtgttggtatttgatacgatcaaacaaacatccgcaagtgcacgaatactgatgtagcagttccccttagagtattctaagggtatcgaacacgagaaacgtgtgtgtactacctacgaacaaaattcaatccatgggcaacaactgatgttcgtttggctagaggtgatccctatctcttttagttagctacataagttaaaagtaaaactctatcgaatgctttgctggtacaagccctccttggtctactaggctgagtccggccttaacctctatgatgtacccgaatgtagagggatacaacggacgaataaagttgtcaccacccatcggctacctcactttccgtggagcatacaacaaacaaaggtaatttctaacctaaacacaacgcctaagttattaattactactctagtcttgcgcatgaacttcgttctttatctagagtcttagtactagagcactcagttgcacactaagcgatgagcccgcaccaatgagaatttatcccacttaaataaaataactaaagaacataagaaaacttgaatacctactttataaaaggaagcatctgctgaggtacaagcgagagaagaaggccaacaatcccggttttctccggaactccgttggatgaatgccgatagtccggcacaactccgtaaaattattaacgaggattatcttgtgcaagggcatactttgaaacattgtccaaatgtctctattgtattttctttcctagatatacaatggaaatttcgttacctaacctggaattttacttgtataattgctgggaactaaccattcctcttgtttgcacaagagggagctcgaaggataagtgtttctgccggacaacttcgagcatggcacgaaatgccgccatggagtagatgccactcattctcatcccgaagttttcgtgacttcgggcgagaatttgcggttgcccctcaacagctgggaaagcaggatttctagacaaatgagatgcatgacatgttaaaccagcatgtctgggagacccattcgtggcggcagcataccaccgactagatggtggacatcaacaccgccatacagcagaattaggccgacatgatggcttacttctgatcacagggattcaaaccccatcacgcaccccaagaagaagctagcttgagggagtgccacccccaccaagataacttatatctttacatttttgcatttgcatcataaaaagaaaaaaaagtaaaaatttgcaaaacataaaaataccaaaaatatttacttttgtatacgtgataagaatgttttaagttttcccagttgaaatgacgaatagttgcgatgtttttatttctatctagtacttagtttggagcttaaccttcactatagtttttgagtttgttagttaaaaacaaaatctttgccatgaacttgaaacttgtgggttgcaaaaagcatgatccaagtctagattgttgttggatatgagttggtgaaatagagttgctatgatattactctaagtgatattggaatttcagagcatttttttaaaaaagtaaatttaaaagttcctcaacgatcataaattcccaccaaagccatatgatgatcttaactgaataaacatatgctcatatgccagagtcaaatggttgtgaccctggtgagattcttttcatgcttcattgatcaagatacccactcacaagtacccaccatatatgcttgatctctacattggagattagcaaaaacatacctttcacctacgatagttgtttaacctctacactaggggtgagcaacatttccatccaccacaataaatactccacgatgtcatgaaaatatctctcatagtaatttgcaataaaagatggctgaagaaaaaaaaagtcgagacaaaaggtaaaatattgtcaaccatcatgagaagaaaaaaatgaaaaaaatagttggagaaaaaaacagccacatctcaatgttagaataaaagagattttatgacaaaggagtaccatatacaccaccatatagccacacattttgcacatcttgatcaaggttgtatgatttgttttctccttggatcctctatgtgattttgcaatatatgttgctggccctcaatcctttgctgagatattctctaatttttatgacgaggaacaagaggaagttcctgacattgcgtacgaggaaaaagaagaagaggaggatgagatccaggatgagcccatgcccgaggcggctcctgctcctgagcatactgctagtggtcctgttgctggcgaccaaatggatgacgatgctcaaagtggtgacacatagattctttactatagtgacgtctccggttgtgagtgattccctcctcctgcttctctctttttggtgccttgatgccaaagggggcgaagattgcagaatggaggggattcgcacttctcttttttatccttttgcaacatcccgtcagcgggctggaagttttgggctattggtcaggaagtttggaccgggctgttgttggtattttttaacgtcacagataaaatccgcaagcgcatggaagataccgatgtagcacttcacccgggagtattccaaggtatcgatttcctcagcaaacatgtgtgttcagctcctcttcaggctcatctatggacacgaagaaaatgtagacaaatggtagagatgatttcctagtgagaaatagtgtctacggaaaactcagtttaatcctaacgcggtacttctagcactggctagctcgctgctcccagatgtcactgtactgcgtacccggacagggataactttagtgtaattacctagacaccgtgtctatgcaattaataacgactctagtgtttataactcaataaagcaatcattgtattttagtggactatagtgaacaatgatcctgcacgctaattaggaactaaccaagaataattctcacgtaggaattcttacttactcagaaagatatttctattaaagtagagtaattagcaaggtacaaaaggtaagaggagaattaccgacaactccggaattcctccgatttcttctatcttactctctccctcatgctttggtgtgttggaatgaagtgaggggtatttataggcctagaggtacctcgggaatgtggagatgctaagcatccaaaggagcatcttcactcttgagctatcatctgtcctctaagatggtttctaccagtagaaacggtcttggaaagtcggtaactaccaacctatgaaaattggggccgattgggttgttttagagttcggccgaacccttgccagttcattttgccccgaattttcttgtaggctctagtaaagattccctcaacccatgtgtatggtggatttgcccatttgaatgtgtttcgtttggtttgtgggctcaaaactccataagcttgaatatggaagtttaattcacctccttctttatgtatctcttgtctcaactttgataatttgtcacctacatctaaatatacaccaacactcgtgggaattattagaaataaaccataccactatattgcatgttttattctttcagatttatgcacgtattgacggcataaatttcgcatttagcagccatcgacagctgtgttatcccccttttaagcctatttaccttattttatctaatggattgtgtgatattcatggaaatttggtgtattgttgttttattgtttttgtgtgcttgctatgtcatatgcatctctactcatttcattatcaaacattgctgcaccacacggatgagaactgctgggaaaagctgtccacatttatcactcgtattttgcatgcctacattaagggggagctttccacatctcttttcgttcagaaataatatatattcatgattttgtaagctttaaccgagttttcatcaatcaccaaaaagttgaagattgaaagtgcatctagccccttaagattgaaaggggcaaatgattttactgagataagcacggataaatagttccaagtttgttaggtgtgagatagtgtgtagaggatgccctccccccaacaacaaatgcaaagtggcgagaggactcgaagagttatttaaaattctttttaaatttcgcatgagtctaggaaaaccgtactatcaagagaggtatcaaacaattgcctcaggtgatacaagtgcttaaaagtcatatcccacaaaacagagacacatttgcacaacacttgcacagactcaatgtcaaataacaagtgtgggctagaagttcctagcaccctggcccggaacctcttgccaccacttttcagccaaaaatcgtaagtgttgcccataagttcctagcactctagtccagaacctcctggcacctttctaatttaaaaatgtgagacggctacatgacgtcaacacaagcctatatattccccacaccccccacagctcacttttggtaattaaactttcgtttttctgtcccctaacttctcccatggtattcttgcaccctccaccttgttcttcagctccccaagtgacattgagtaagatttgagtgtggcattgtggtttgctgaagttgttgagagctaggatgacttgagcacttggagatcttcatgggctactggttggtgcttgttactcttggagagcaacctcctagatggctaggtgtcgcccgtgagcatccaagagtgtgtggattgcctagaaaagattgcgaaggttttcctcacctccacaagggaacaaggtaatgcgagtaaaattcctagctgagccttcggatgtagtcttggtagagcaatccacatccgtggtactcactagggattcaagttagttatctttgtggtcacttgaatcctagtgagtgatatagggaagtgggattgaaaaccagggacttcctcctagggttttgcttggacatctaggtaaggggttaatcgtgaccaagctattatgagttcctcaacggagagtaggattcttgtaatccaaactcttgtctcacttgtgtatgatctgtgcaattacttgagcttttttgtttcctgttgttttacttcatctccaacactttggtaagtcttggggttctatgagaattgagacttaagcctcaaagtatttgaatattggaagttcctagatagaacaccggaagttctggacaaaattagcttccagaaagttttaaggctcttgccaagaagttatgggccctgttgaatttaaccgcaatgattgatgaaattttcaggaacgcttgaacccccatataggcgacatctacgagctttcaaggaagtggctttcgcggcaaacagattcgcacatcgctggcccgacaggtcagtttcgtgctggctccactgctatcggaccacattggggccctttccattgtctctacccagcgccaccatcatcatcaacacctccgcccggggcggcaagtggaggcggtgggagggtgggagagggaaagatgtggtgggagaggaagaagtatagagattgatatgtaggacccaccgtcagattggagagtgtaaatggagaggttgttagagtggaaagtaaatttgactctttaaatttttggcaagctggccaaatgaacatttggaaaatcggatttagagaggttggagatgctcttaactatacacctttgaaagaagttatggtggtggctggtgaatctgtcactcaccaactttgttatatttctttcatctatagaattgaagtttattatgcaaagacatttacagagaatcaatgaaattgttccaaaaactttacaattagtttatttcaaataatgttagcccatgtattatttatttttatcggttgtaaaaacataactatttaagttactataatacccaaacgcaatgcatatgtatggcaagtgaccatgctttaaaaccgatctgcggcggccagcaatggctcgttaataaaaagatatagcgagagcacgtacgtaggtggtgccagtgcaggggagcgtggtcgtggaaatggactttctgaacttcacggaggataagcaataaaggactggtaggaataaagcaccagtacgtccggaaaatccacataaaaaaagtgagggggaagaggtgaattaattggtgatttggtggttacatcgacttcatcatcccgacatcccgcgcatatgtattctttgtgtgtgggtgggggtaggtgaaaccccgcgcattgtcgcgggaatttagtatgataaaaaaaataacgtactcactccgttttttaatagatgacctttatgccaagatcttatttcatttaagtatattaagcttttgtttgatatattatacttgttttaatatcctgatatagagtagtattcgggtattagcccgatacatgctagatctatatgatcggctatgctataaacatatataggcctgttattaatatatatttcgatccaagtgatttatactggctcggcatggggaccgatctatcccaatcacttgatttaaatatatatcgatataagaactatatattgggaatatttacagtcgatcgagtagggttagtccttattatctattataggcacccatcgatttcatatgacattgggtcaagataaatgaaatggcatcgggacttaaccggttggtttgattatagaataaccgcgttctttttttctttttttgttgattgatgatcaatacttggaccttcaat

SEQ ID NO: 74499 - DNA, 675 bp, Oryza sativa
ccgatataaacgagtgggaagctccagagtcgaacaaaatggtagcagggatggaatgaatgaggaacgtaccaatgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacactgcggaccttgaacgtccctgcggccttgaccaggctgcatggctggcataggaggacggggcgcacgagtcccttgttgactctgctgttgctgcggctgtgggacgcgcaccacgaattgaggtcggggcgcggagcgaggttgttgctgctgttgctgctgcgatgacgatccccctggatagggattgtgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagca

SEQ ID NO: 74500 - DNA, 1121 bp, Oryza sativa
gcggccttaattttcctttttttagatggttgattttttgttcaccattttttacttctatataatacatggacaaaaaatcgtatctaatctaatattctgatctgacaaaaaaaaacaaaaaaaaaaggggaagaactcaagtcggtttctccaattaggccgacaccaagctgtcggttcggcccaaaacctcgcagccacaggagagagaagaatcgcgaaggaagaaggccggagaagcggaagcgagagcgcacggcggaggcgaggagggtttcatggagcccgagaaatccaaagaggcggcgagccagccgatggaagcggacgccggcggccccgtcgatccccgagaactaggtagctctcccaatcccccccttgctttagatggctaaaatctttcatgcgaaccccttttgcttcctcctccaagaaccggaagtatatataaatcgtgcaggaaatgggagatgcctgacgtgtcctgactgatgcacctgatttcccctcttttggttttgtgttacctctgaatttgttagtgtccagcgacgatgagatagattactccgtggagcccgagttctacgatcccgacctggatgatgtcgatgagcggtgggtgagcaagcagaggaaagggaggacttctgacgccgtgctcagctgccccgcgtgcttcactaccttgtgcctggattgccagaggttgtctttccttactgcttcgaactctgtgaggaggcttctggattccaatatgcatgtttattaagcagtcactagttctttttagattagtcgatttactatttttagttcttggattggcacgatgcttttcctgatgatgaagaaactatcaggattgtggtgctgctgcctgtatagggtagatgctatcaataattttgtttggagaagttggtgtatgttagaccatgaggagtatatctatacatgtgagcaaatcttttgcatacaatcgacatccatgctcacaatgatcaaattggttgatttaagtggctggaagaaataatggaacttcttaataaatggtttatgctaggattagttgttcctgaatttttagtttgattttgcggggtgca

SEQ ID NO: 74501 - DNA, 1633 bp, Oryza sativa
gatgcataaggttccctacatatggatggttgttcaaaataacaagttcagttgaaaataaaatatatataagattaatcataggaagaatttcatcggttggaaattttatcttttcaattatgcttgaaccaaatattttctgaattcccagctcctgtactatacaatggtggcgatattcaggcagtggacgtgctcacctgcttacatgtgaaaactgggagtgattggggcaaggggttcggccgaacccttctggtgcccaatcactgcaattttcttcagagtttagtgcacatcaggtgttcagatattcagtcacagttttagaatttgcacgtcagaaagctgaggtatctcccccacacttattttgaatgctaaactttattaatcatcaaaagacaaaattggcgatcattggggttaaaaccaatgagccacattatttgacaataggtgcttacaatgataaaaataaaataaaataaaataaagaaactaagaacctattagctacattattaatggaagaggagacatctaatattctaatttgcataatatttgttctcctttctcatctctacaaatgcacgcttgatcttagcgcaaaaaccgcgactaagggtatcgaaattgcctctaagctcagcaagctctacctagttccgtgttgcgatccctaagctcaatattctccttgcgaagcttcttcacatggcttactagcttatggaccgagggcgcgggctattttacttcttcttcttggaatttgcccgggtgccgtaatgataggagggggcgtcaaatgacgcttccaattcataagtggagggctacgggactccgttgccccctccttctccgatggtgtcaagggcaggagcaagcacttaccatacccaccgccgggagttcgcactccccgaatgcaaaaagggtccccattaggggttgatggagtggcggtgggcgtggtgtacttgtggagcacctcatctcttgcctttgtatagagcgtgcccatatattgctcggtgggcagcggagcggcctttacttgctcttggaagagccgccttgtcgtcaacggattgagctctccagttgtcggctgtcgcgcagtcgaattcccccaaattttggttttggtcacatggcgaggggagagggatcgcgctgctgaacggggggccgattggggccgtgatgggttcggccgaacacctagttcggctgaaccatggtgctcgccgactggatgcaaaattgctagggagccagacaccatcgcaagaggctgcgtccacacaacgtttacctcttccatcgtgtaatcttcaatggggatgagttggttcaccggagtcggctctgcgttgaggttgcaagtggaattggaggaggagccaatgtagggcatgaaggacttgctagccatgggtggtttgagtagggggaccaaggaattgagttgagatggagaggagagctttcttagtggaaagaatgaagaggaaaggttttggtaatattgacggtcgaaactgatcgataacgaccgtcaacaaaaccccccaggcttgaacccttgctcgtcccgagtgaaggatgaaagggaaca

SEQ ID NO: 74502 - DNA, 24392 bp, Oryza sativa
cttgggggaggtcaggggtacaaaccttgggttacttcccacttggactaaagacttcactcttaggtgcttccacgtcagtggcaaaaaataattaaatgctacaaaatggcaatcctagaactgatcgattcccatatactgtcaagggagggtggaaggcttaagaatagataagagggaacttagggtgtgtttggttcattgcccaaacaaaaaaaaatgacatggcaaagtactcatacacttggtttgttgccagaaattcaaatttggcaaagcagtatttttacaaagctaaacacaagcttaaagtaacttggccgatatttgggcatcaaaccaaacacccacaccttgccaaaacaatggcattacgaaatatttggcttgccaaaatttggtaaggttaactataacagctcaccctccagaaccgcgtagcatagcccacttacgcataccacgccacttacacttccatcctcacttggtgtaaatgggttaacccaagagtgatgtggttggagggacaaacccttataaattggttccaccttgctaaattagcaatgtggtactaaacatgcaaacacagctcttatagggcacacaggccaaatcctaattgggccaggatgtcacattaacaatggctataatccagaagaataccttaagatctaccaccatgttgaaacgaatggcataaattgcatcttttcaagattacttgccatcatggggtgagattacttgtttgctggttctggaggatgaagtagactggcaggtatcttcagttaatacagaattggcgatttggctggaggcttggagctttaccaatttagactagtttttagcaaaccgcatatctttgtcgcaaacatggtattttagattattcaacataacagttggatttattaagttctcaaggttttcctggcattagatatattagctttgagaagttgcatccctacaaataattagtagctacagacaagcatgtgtaaagtgtgaacaacctctgcaacctagaatgattaaccaaatgcagttatggtatatgcataccaaggcaaccaagtgtacagctgtatggatgcatactatgaagctctctaccaatgacaaatgacacactatattacactacacagtacctgataacaagtcaaaaacttgaaatagaataaagtaatacaagaaaatgtcaactatactatgatcaggaagttagcttcttaccacttgtacaagtaagcttttcagatacggcttcactgcacgacgcagccaatcaattgttagcctgagatacggctcaatccaatgatcgacttgacctttgcaattttgaaaaacgacttcaatcagcttgggagcaggtataatgtcagaatcttccatgttttggtctgtcataatctacaattatttgtaatcaactgtaaaaattacaggaactaggaactttacaaaatatttcagagcaaattttaatgcaacatgaatttaattcactcacagatgacagtgctctccataggctttgctgataatcaggatctttgcatgcaataaattgatcagtgccacgggaaatgtagttgtctaatggtaccagaatatctgcagggcaataagaacattgaataatgtagcaaaaggatgtcaaagataatacaattgcttctgaaaatatagttgatggtaggagattagttccatctagtggcctgagggtagaaccaagcaattttctacagatagaaacagtcttagcagctgactaaaaaaaattctgaaggatagacaaccaagcagttggcatttcaatactttctagtactataccaaatatgtaaaacaaggattccaattcaaaggaacaaccgatgacacaactattcctgatgttcttatctaaaatctggatgcacatgtgaatacaaaattttccttttgcataatggataccagataccggcatgctaaactatcacacagaaatcataatttcaattcaattaaacagaatcttaacaatacaagatggttctagtttcataaattcaattccttactaagtggcataaccatcttatataatcctgacgaatgaataatgtaagaatagacaatgcaaaggctgcatttggtccaaggtattagattggttgaaggtctaatcttgcaaacacatgcacgttaggaagcattaatttaacacaataaatgcctttcgaaccattctaagtgaggaataagttgacccacaaaataggtgcagcaataagcaagccgacctcaactataatagtttgttcttttactaataatcaaaacaacaaagcagatctagccaaacataatctgagactaactagattagtcgctggacacaaaaaaaaaggtttgagctgctaaaatccaggttaaggttaggaaacctaatcattttttattagcgacttggaagaattttataaatgagcacgaaccaaataaaaaaaataatcagaaaataatatgacatgcaaactgaacaaactagtgaagtgggcacatggaaactaatacaaggtgattcagatattattttaaatcatgcatgactttccaaattacaagcattcatacaactaaacaagattgtcattggaaaatagcacaagcaaatataacaaacataaaactgcaagaaaacccaggaatatgcttaatctagaactctcagtttaaaacaaacataattgcttgccattcaaaactagacttactctcaaagaaatcaatggcccaatcattaagggcctccatcatcaaaggccacaagccccacatttccagtgaaatggttggtgagtaaaatgtcatataggagactatctccagaacttcttcatacacatctgcaagacagagtcaaatgcatcagcggaaaactgcaagaaacaccccaaacctgattaaatttaaaacaaacaactcttaaacctttgataacaatttgagttcaaacaattcaattgtaagtttgtaactttgtacaagtatctagcaggttaaaggtatatcaccagggatgagcatgggtcaagcctacccattgacccatcctaagtaaatgaagtgaatagacatgaaatagaaaaggtgcattctagttgattagttgaactgaatatgctatatcttgatctttactcttttcaaagtaagagttggggtgatggcttgtttacttgtacacccatccagccatcctcctccacaaggatcttcattttaaaatgacccttttgcacatgcatacaaattggtgtgaatgatctcatctaatcatgtggacactttttatatttgaaagatagagcctttggtttttttaactgtggatccatagttatgagtgaataattttataccttgaccatctgaagtcaacattcttcgtaaaataggcaacaaagtcggctctatttggggaaacaaatgaggaaggctactaatggactcaaggattgtgcttatcgcacgtaagcaaccaacagcagccaaagcaccagtgtcctcaacttcttcgtcagcttctgaactagccatgcatctccagaaagcagcagcctatcaaaaacagtaacatgaagttcaaaggaacagaagaacttattgggctaaacacaatgcactgaggggcaacataccaaactctggcacaaaccaagtgcatatggtgccatctcttcaccaaatttgtcaacaattgtctcaagggtgaaaacgagatcttcattctcaacttcactcataagcttaaaaaattctgcaaataatacttaaagcatgatttaaccacaataaaattaaaaaaaagttgaagaaagtgatagaataccatcaagtagttgaggaagaattggtcggatctcatctagatctgtagaagaaatacaaaatatagattgtgatctattcgaaagggtgatccaagttaattaggtctctaagaaattaaataaagactacctttgcatgcttcaacaaaagaacggagtgcaaagactgaatccaccctaacaggaagttctggatcacgcaaaccagagattacacaatgcatagctttgcgaaaattgttttgatctgagaaattgatatgagcatactgcccagcaacccatgctgcctacacatcatatggtaaaaatcagcttaatgaaacaagcaaataagaagtactaaagaaaaaacaggggaataactgcattaatagaatacaataatagaacacaaaaaaggctacacaaagtaaaaatataatatatttaagtaaaataggacccttaaggtaacaagtcattcaaatatgataattgcagtcaaataatttgcaagaaagtacattgtggaagaactatcttataatggtactaaaacttagcatttttaaattggaatcttatattacatgtcactgccaacggaccaggggcaccagcggtggggcaagggccaatgatgttggcccttggatgacatcactgcagtgggggcatggtaggataacaaaggcacttgggaggatgactccatagccagcaggggacaaaagatgtcaccagatgtggaacagaagacgatgcacacaggacagcggcacctcaatagaggagaaatcaaatgtgatttgggggagatgtgagagataagggagaatctaaggataatttcgccattaaaaaaactgacagaattgcttctaacggtgtctgtgtaatgtgtatggcatccaagggaagaaaatttttgtttggtggcaatataaggaaaccaatgaatttctaaaggcacatgaggattgttctctttttataaaagagcactgctacacgtactaaatttcttttacaaaactcttataaacaatgatctcaaccgtttgatttaagtagatggaagttacagaaaatctagatgtactcacagcatgaagagtttagtaagacaaaatttagtacgtataaacttttcatttataaatatatgtgcatgcctcaaactaaattactggacaattgcattttggagacattgagaattcaaacttatgaatttcggactaggtagaatacttcaggacagaacctaccaaatgttccaagttttaagtaaaaagaggaagaattagatgcagaagtcatgcagaactacaattgtactaccaaaatatggtggcttcaagaaaaaatgttcatgatctaaaatgcacaccaatttatagcttgttacctttgcacgtaagtgtccaacatgactactgaactccggaaagacatgttgaaccaacattcgctccagctcagccttatatggttcagtttgttttagcctatcacacaatgtcccaattgcaagaagcgcaccatccttttggcggtatggcttcacttcaatggatgcctcattatacctgccaaaatgttcttcaatcagatattagataactcacaaagttaagcacacacatattaatcacaggatgacacatacctcataaatatttccacaataaaatggataaacttttgcagattgcttttccctcgttttcttaccaattcactcacaaagtccatagcagctgttcgaggactatacaaatcttcaataatatctgtacacaaaagtaccaagtagtatcatggctacagaaaactaatggagtgcacatactaccttgcagaacattgagaagaaataatgcaaattctttttaaaaaaagttgcttagatgaacatattaccatagcctttccgaacatattcatgaggatcttcatcccacaacatctggtcactatcattgaagcacattaatgggaagattatctcaaatagaattatgtcaatttgtggttgcataagctgatacatgctgttcttcgtgacactgcaagaaatacttacattcagccacaaagaattcagaaagcactgaatcccccccccctcaacaaaaaacgtatattacatactgactgtacactaaaataatgaaaggcatgtaaatataaatcaggcgaaaattatccatattgcatgaatgaagtggaagttgtgccattacaaatctgatgactagagcaatttgtcatggaactgagataaagactgattgcaaccatgtgaaacatgcggaaaaccagacaaaatggagaaagggagtggcaaaaacaatacgaaggcagaccacagagctactaaggaaatacagaatgctgctgcacagtttttccacaaacctgttggtaagatattgaagaataagattgataaccctatcaggcaaatagccaccagtacgtattgcattgagcaactgcaaatggcaccccaaaatttttccagcatagttcttttggaacatttgagcaaaggctttgctttctggtctctgaagcttcatatcagcaaacctgtaatgaaaaccaggtttagaatacaaatgacaagaatcacaaaaagtttacttgacacagaccgagtgtataaacggttcaatatatggataatccatttcttgactttccaccatccccaagatttcctcgcatcaggatccaatggttgtccttccactggaactggtcgctccagtaagtttaagaacaaaatcatccaagtattgaagacatttggatcaaaaagttgctttggaatttctagctgcagaaaatacatggcataatgagtattgaaaaaaaaatggaaaacataataaggcaaagaacttacataaatggatgaccagaaaattttgcatatcagcttgatcaagtcagctacttcaattggagggttggaaatcggaacaagatttcttaatatattcaacaaacgaggaaagcattcctcaacaatttgatacaaaggtatcctctcgtcctctgacttgaacctaatcatgaagaaagtaatgagatagtgtggcagctcacataaacaaaagacaaaaaggtaagcactgtatgatgttgtccagaaaaatgttcatagagcaaagaattatgttgtgcacccatcattttaagaaaactataacaacaatgttatctttacactatttctttgggtaatctctaaattacaataaagatcacaaagtcagcaaataaaacaaatagagtgaataacatgatgtgtagagatatttcacagcagagtaacagaaacacgtaaatcctaagttttttggagttacagaaaaataattcaaaataggaagacggatagagtgaatacaaacaaataaaaaagaaggtagaattctggcatttagactcactcatatttccgggcaagaatccttagcacatatagtgctccaaatatttgatcctgtgattctagattatgtgttacccaaggaagaagactaggccactgctcaggataatctgcaaggatcaaggtcttgatactttctccaagctgggctctacagaccatgaaatatgtgtcaattacttgtatgcacatttcataaccatcagtactgaagaatattgtgctttgtcatcaggaaaaacacatccactacaaatttcactgaaatactcatcaaaaataaaagtaccacaagttattgtttacaatgtagaacttgacagtgcattccgttcaaacttatgatgcttctgtgaaaaactaacctaaattcaatatctagaaatgctgaaacagtcatataggtctaacaaaactgaacagataacaccttgaaggcccgaaccctattccacagtggttttgattggtatggcagtggaaaagggatcgaggtgttacttatccagttttgaaggttgtaaacaacctgtttttaaaggcagggtgaaaatgaactttgcgaattcaaggaccaaaaatatattctatccaaagtacaaacatgagtcaaaaatggtattttcagactcatcttaactccaattggctggggtctaaattacttaaacaaatgtcagcattcaataatatgtgtaggcaaacattgtgactttgtgagacggccaaccagaatttatagattgacatcaattgtaagaagaaaagtactccagtattgaaataaaatgccttagaagtcaatttatctagaattcagaaacaacagtacaccaaaagcataaggactacgattatagcatttggagagaggcgcaaaaatgttgttcattaagaaaagggtaggtggacagtgagaaataccttagcaatggaggtaattgagtaacaaaacccaatatattctcacggaccatggacttgtcactttctggaattatatgtttttcttctaaagaaggacgaattgtaagtcaacgagacacaaggaattattgctcaaatagtaaccttttcataccaggatcagtaggtgaccaattcttcgcaacaaaattcttgaaatgaatgcttgcgaactgtctaacagccatatcacaatttccatccacaataatctgtagcaatctaaccaagtgttgtggtgtgtactgaaactgcaggaattaaagaaatatgaatacatgagtccgaagcagactgaaatttataaagcatagcaatgagccaatgacatcatcagtatttaatgaaacaaacaggactactcaggaaaaaggaaatagatcaaacacaggtaaaacccaaaaggaagggaggagcaaggacagtatgatgattagtcaccaagcataaaaaccattaaatgatcagctgatgtagagcaattttagcaaacagaaacggtacgtgtggaatgataaaagcccaccactaaaataaatggtcagctgatcagaattctattttatctctgctggtatatgacctagtaatgagttgtagtggatccttatctttcttgaaacaaggataacaacgaatcatcaaagctttctgaacaaattgcggataacaacgaatcatcaaagctttctgaacaaattgcaatggaagctggaagataagaaacatatgaccagtacaatataaaatgtaaatgtgtagtcttttgaatcccccattgtcaagccaaaactagataattcttcccttattggcttgacagttcattttggcaaactgtagtgttgggatatgttattatgtaacataagaaaatagcaaacataaactcagaaaaagagtgggatgcttgctccatatgtgactattaaatatacactagtacactatatattttgattatgaaggcatcaggtagaggtgtctgtttcatataaacttacaagggtctacgtgccaagtgaaagccctcacaaaatggccaactcaatgaaattgatgtccttacacatccaaatgaaattgatgtccttacacatccaaatgaaattgatgtccttatacatccattttgataacatgatatctaaacaaggttgccaccttagcatgtcataccaacaaagatagagctaactacaacaaagaaatgcaaactatttcgaacctaacttcacaaaaaggccaatccttatggatgtgcaaggagatagcaaacaaaaaggctaccctctcttagttcggtcgactttacaaacttgtgaaaggatgccattgcacctttagtatattattgaacagcaaatgggtaaacaaacatcagaatgccacacagagatggccatttcaacaagtttacgcatgtggaatcattataggccactagttgaataaaatatgcatgataacactatattagtggtaaagtgagtatacatgattgaacaggcagctaagctaccaactctgaggcgttaacatggatagcaataatgctaacaataacatctgcaacaagagctaagaactagtaaggcatacaacatgtaacaattctcatgaacaaatcaacaagaccaaaatccaacagcacgacggatttaagctaagcatcaggcacgtgcaggattcacacaccagtcaccgttcaaatttaaccgaattaaaacatcaaacaagccgcagatcgcacgaaacatggcaacagcagtccaaacgaagaaccgatgctttatccgctctttttatgccgttgtgcaactgatatcgaatcgattgatgataggagaatcaaaaagcgaaacgaagcaatcacgcccccaccggccccgctccaactctagctcagcgcgtgaataccccgttgccccccacagataccgagccagcacagaagcaaacgacagaggtagagagagagggggcggggtaggcccaggggctaacgcgtgatcaagcaacggggagcagcgagcgggagcgcgggagcgcgatctcacctgggttaggctggcctcggcggccttgcgctcctcggggacgtggctgagcgccgcgcgcagcaccacggccaggctctgcagatccatctccgggccggcttggggtaccggcggcggcggcgcgcggacgggggcggggggctagggctcctcgcggcggtggcggcggggggagtggagtccggagtcctctccttccccccgcttgtgtgggcgtcgcggagacttgggggaggcgcgtgcgggaaggggaaagaggagaagccgcccgtgcgtgcgtgcgtgcgtgcgggtgcgcgaggcggcaggcagggaaaggggactcaaggaggagggagcaaagatcaacgctagggtttggtcaaggccgcaaggggtttttggctttcgggttcaggcggccgagcgagccaaggtagagcttagctagcaataggccaccggccgcagcgcaggccccggtccgcgagaccgcgcgtacgtgtgcggtgtgcctctgctttccagtcttcatggactccgtgcacggcgacgcgccaaatcgtgagttcgtgacaagtacaaggtgggtggcaaccggcgtgggccttaatttggccgaatgcaacaccgaataggctgaacacaattacacaccgaccaaacaaatactaccttccttttttaataaattacgatgttgatttttttatgggacatttaaccatttatctttattaaaaaaatttacgtaattataatttattttgttgtgagttagtttatgacttaaagtattttaagcatgatttatatcttatacatttgcataaaacttttgaataagacgaatgatcaaacatgtgtttttaaaagttaacggtgtcatttattaaaaaaaaggaggtatgagtagaattgaagtggtagtttttattctgaacaatcctgaatttaggtttctatcctaaacaattataaagcatttaccgataaaaccgaaaagtcccctattttcatgtgcggctcctcaaaaggaccatacggaaaaatcaattttcacatgcgagcctcttaaatggaccgtgggcctattttcgcaggtggttaagagcaaggctaataatacagccgacatgttggctataaggttctttatagtctttctcagcctacccatataatagttagatctttacaattaatatatggcatacctgtctctctcacggagtttcttggttcttgtgttcaagccggctgtaagtctatagcccgcttctcctctctggcctctcttctctcctccaccttagcatttagccagcctatagcctactattatacttgctctaagaggtccacacgcaaaaatactcctccctcttctccctctcactcactttaaatttttcacctcccctccattttatttccactcatctctcactttctctcctctcctctctatctctttctcttctctcctctcctcttctactctcccgggaggggcgggaggcggcgtgcggctggcgacaaggtgatgaggcggcgactggcctcggggaggctggtgagtggtgacgaggcgggaggtggcgggctcgagcgtggtggcgagctgcccggcggacggcggtggttgacgtgctcgggtcggtgggtgcgcgaccgcggccgtgtgcggaaggcggcgaggggcgacggcgaccgtcccccacccagttccggcggcggcggtggcggcggccggcgggcggtggggaggaggcgcggcaacggcggatctggcgacagcgacgggagcaagcggatctggcgaggacgatgacgacgaggaggatgatggagactgcggcttctagggttagggttcggatttattgattttattttttttggtttttaatttttgcgtgagggcgacataagcacccgcacgcgaaaatcagatttctgcgtgcttctagacacttgggtgtgtgcgggtagcccatccgcacgcgaaaaccccttttggccacacggaaaaatcgttttcatagtagtgatttacccacatgaatacaaataaagaaccagattatatatccataactagtataaaactttaagtagaaaaccaaaccacatatccacgaccagcataatacttaaatattaaaccaaattaagaattcaatgcaacttgattcaaatcaccaactttgggtaatatatttcgacttccaaccttcgaatcatcttgaacgttggtggcggttgttaaaacccatttcgatcacaaaccttcggtaataaaacagggaaaacaatattgaatgcatcgatttgatttaaacaaaagtgaaaatatatgatatttttcacaaaagtgaattattttgcttgggtcaagcaaagaatgtcaagattaatattccaacatttttggttgcagactaaggggattccttttagatatcttgatatttctatgtattttagataacttagtaacaaaaatgaaaaataattgagtaaagaattgataaaaaaaacttagtaattggaaaggtaaacatatagctatttctaacaccacaaccaaacaacatctcatactagccaggctagactaatgcaaacaaccaaacgactgcatatgtatcacattaaattgaaaaaaaaaacaaccaggatgagctcaacctggatgagggagatgagccagcctagacagatacgagcaaccaaacacaccccatatgtctgtaggggagattggttttgataaattctgtgttatcttttttttgagatttctaaagtggttcttcacaaattgattattatatatcacgtttcttctggcaaggggatgagcatataaaaagatatatagaccggcaagatgggacattatatgtcagccaaaagattagggtgaacttggtttgaaattttgaaatacaaaaccaatgtttgttgtttaagttaataaatgagtaaggtttttggcaagacttctttaaaagaaaataattaataataaatcaatagcttaagttgagaggaaactaggggataccttttttgtcgggacttatgaaagttaagagtattttttttaaatatgggttcctagataattaataatggtgaacaagtcagattataggaggataagtggatagaaaatatttcctttaaggacagtttgtatcctattatcggatcccaaaactaatgattcggaaaccgacatgtttagtctgtatcaagccctggatcagtaaattgatacaggttcaacaatctgtatcttcatcgcatacatttgatcaaggctccaaatgagatttatttatgtaaaataatagggtatttacaaggttgtggctaactattacatcagaacctacagaatgacttaactctaatgtttggctataaacttaaaccatctatctaatctataattgagaattaagttagaatgaaactaacttatgtgattgaactcccagcttcggcagaaactccaaatagactctaaaaaagaggggttgaagcaagggtgagtacaacgtactcagcaagctattatattcaatatgaaggcatgaaatggtaatatttgagtagggctatgattacttgtagaaagctgagaataaagagggaaaaaacatgtgatgtttttaatgcaacagtatttaataaaatcttgaattatgtttctaaccaaatgccatatgagtctcgatactcaaatccatgagcacagctattcgaatagattcattttcactttactgcagtaaatgtacgttttacccgtagtccataactttccaataatcattagcttagtcatggcccagtatttggttactaacaatagtgacacatgttccatgaactctagtccccatgtgctctgaacatgacgttattagcagcgagatgagttctagtgttcccgaggtttttagagagaactaattgtatgacaccatgttatcgcaatcatggttcacaaacaagtcgcgacatcaatgaatctcatatatttacatgtgcctcagtaaatagcacaattgccctgctcggcataagtttgcctcctgcgcgaggacttaaaaacacgaaccactacacagaggtaccacattgttaattaacataataactaggtctgtccccattctagaagctgcggtcgtacctgttcatttgacataagtacttggtgataattatatcgaccaggacagtactagccacccggaaatcaaccaattcctacgtactgtcccaatctaagttcattaaattttatgcatattctaactaagcatggctaagtaaggtctagcatatatctggcttgctatatgttcaggccttcattcaaaatcataaatgactaacccatataatagagatatagaatatatgacatttatgctcaaaggggacgaataataacttgccttgctccaacgcaaatatatccaagataggcaacctaattattcggtcctcgaaataccacatgttgccatccaaaagacaatagactctactaaggaagaggaagaatcaaattcaataaaagtcattgaataacaagaaaaatgataaaatggcgagaagggctaggtttagggtgtaaacatcttctttatatggtatagggattattgggctaatatttcacatgtaagttctatagagttggaggctagaggggattaagcaactactgtcgcctatatttcatgtgtgggcttggttgctcaaaggataggatgtatattgggtaattgaactggtttaactggtatatggctagtattggctggtggtcggtttagttgtatttgagctgattatggagtagggcagtatctcagctagggtttggttatttactagtcgttgctagagttgggtagcatgacgactaggtttggtatcatttctagccgatgtcgatagacagcatattggctagaagaataggaggtggtgcaggtttagtggggtggaagtgttactccgacaactatgagtggcgacagagcggctaggatcatacagagcttgagagctaactatgtggtgcgctgtggaggtcgaggaaatagtaaaactctgaccgctatacgtattgaggcgtggggtgccaggagcagcacttcgaccttaggtttggttttgccgggctttacaactaacggtccgacgtcggggtcagtagaccgcaggaatgtccccatggaaggcgtaaagttccaaccaacggcttttagtggctaaagggtattttggagtaaaaggagatatttaaaaagcaaatgacatttaaataaatcaaggaaattcaaataaaattataaaatagcacattgggtatcaaaatgtagcttttgaatttagatgaatttaggtccaagtttcatcagaatcggatctacggtttaggatatatgggcttctaaagaataggatttgaattaaatagataaaatgagaaaagtcactgtgcaggggacccacctgtcaggcttttctttttctttttctttttctttttccttctctccttcttcttcctcccgttccttcttttcttctattagtagccgagagggggagaaaggagaggtgagcggggcgctggccctccggtggccggaatgcggcgacgccggcggcatatcgtgttcccgctcgatgcgtactcagggaggtcagtggctggtagagggagtgagagagaaggccagaacggcgcagctaagagctcggctccagccagattgggtggtgacgatggtggcttaaagtgagggggaataaaagggggagatgggcaaaatgagttcgccggagggaggccaacatagtggcgcaaggaaaaggatagaaacgctacggtggaggagatcgaccgtcggcaacgacggccggagcccggacatgggaggagagagagagagctcaaggagctcggcttgtgtggagtaaaggggagggggtgccgggtatttataggcggtgagccggtgaaagcaactccaatagaatggctaaatggctggctaagttaaattttagcaagtatggaggaaaaatgccctccaacagcctctccatcctgttagctaagccatctggatggccaaatctcactcctcattggccaaacttggagagtcactttgcctggatggccccaccactccctctcccaccccatctctctctccctggcaagaaggcagcagaaccgcacgtcggcgacgacaaggaggagagaggcgccggagccagccacgcccgccgccgccgttgtccgcgccgttgcgtccccagccgcgcccgccgccactgccgtccccggccgcgcccgccaccgccaccgtccgcgtcgtccccggccgcgctcgccgccgctgtcgtccgctccgtccccagcagcacccgccgctgccccaccctttgctcatcgccgttgtgtcgggagtacgggaagagaaagaggaagagggagaggaagaatgggtatagaggccgacgcatgggtcccgctgtcatagactcaaaatagagaggatggatggagaggctgttggagtaaacaatcaatttgacttgacaaatgaaatagagagttggccaaatagacatttggagagtcaaatctagagaggctgttggagatgctctgagaagcggtgaatcaagtcggttgcagaggcggtcgtcgatttggtcacgacggcaatggcgtggaaaacaaaggagcgacaccggcctcgttctatggttggttggcgatggcggcgcgagcacgtggaagctgcgtctgagttggcggcggaggaggagggtaaggcacggcgtcggcggaggcgcaagctgtgggcgacgatggacgacggcggtcggcggcgcgagtcgtgggcggcagcgcccatggcgcacggcaacagcgctcacagagaggagagaggcggctgcctctcgggctgggccgatttgggccgaggaaataaagaaaggtctggcccaaaatgaataggaaatcctccgaatttctgtaggaaattttgaatagaatttgtatttggagaggatttgaataggaaggttggacaaaggaacttggacacaatatatatttggaaggaatttgctcagcacttcttggaagggatttgaatattcgaagaaagttaaagataggtttagaatcaaaggatgggtcgacaattaattccaataaaattggaatcgcttggtttaggttctagggcaatagtggagaatttcttggaccataattcataaaaatagaaagggttttcaaactaaatttgaataaaagaattttagtcgaaagaaggttttatattcaaaaataaaattccatcaagaaatacctcaatttaaccaaatatatttttaaatgaaaaacacaaaagagattaaataccacagaaggattttgtgcaagttagttttaggaggtccctctaattatactgtctaggaggtccctctaattatactgtcctaagtttaggaggttattaagaacataagaatcggcatgatgcaagaaaaatgacacattttcaggaagttataaacctacccccttaaataaatctcatcctttagatttctgatgagtccaaatagtagtgtgggaattatattctttctttggttcttcccaaaattccggatatctgactgattaatctgttggtgaacaacttcatgtttttatagtacacgtaattgtatgtactgggtaatagaaagctgtatatcacttgattcaacctcatctgatttaaagttcggaaatccaacattcggtagcttttcccagtagagacatgccatacggtatttttgtatgggattcaatgtttctagcacataaatatgtaatcgtcatacttgttgcggagttttattaagatcttcccgttcttcttactattggggtggtcggacttcttctcgtatcctcagaatagagctgataaatgatctttgtctgttcttggtggcttcaacattttctatcgaacattattttcttccaactatatagaaaatatagatagtatcattagaaggtgtttaaaaaataaaagggtaatcctagggtgatgcagctaggggcccctttcggagggccccggcccgcctaagatttcatatgtgggattctctctagctaaggaggaatattgcatatatgactcaaaactctaagtataaaagtagcttggggcctagcttgggtcccaatcataccccaaatatgccttccttgtaggttctaggtcctcagcaggaaggacgtagaaacatacaagacttatatcttaagagaatgaggtaaggtctgcctcgggcccggcctgagcttgggccgcgggctcaccttagcccgtacaactcacatattactcaaggaagaagagtgacgagacttgccaagcttgaaagcggtttgacttgggctcggccttgttctgggcctcgggctcaccttggtccttgtatagcttgcatcccttgaacgtgtagagatgtagcctagagggggggtgaataggctttcctaaaattttctcaacaattgcagcggttaaattgacagggcccggaacctcctggtgatgaacaccggaactttcgggcaggatgagtagcccgaaacttccggagttcttgagctaggaacttccgggcagtagagataaattaaaactgagatgaaaaaacaggtcctagcaaggaaagtttaggcacacagaggaacaagatgaagatcgcagaatatcagcagattcacacaaagatcatgcacaagagagacaaagacgattttttcccgaagttcggatcacacgaatcctactctccgttgaggtgctccaaagaaccgggtctcgattaaccccttgcctcacttatacaaagatttcagaagaggtccacagccttcaacttaacacttctaggtcattttctagaattgagtgaccaccaagatcaaactcaaaaatccttctagaaaaggccacaagtgcaagttgctctacctaggacaacctctgaaaactcagcacaagaatctttactcacttacctcgtttccttgcggaggtgaggaaaaccttcacaaactttcccgggacatccacaagatctttggaagctcacgggcgacacctaaccgtctaggagaagatctccaagagtaataagcccaagtgacagcccacaaggtatctaaagtgctcaatcaaaacctatcttcaagccatctccaaaacactcctacactctcatctaatctctcaatctcacaagataggctctagatttgagtggagaaagcaaatgaagcttgggagtggctagaaaaccctagaacatgaaagaactgaagtggaatggccaaagggtaccctgggacgaaatccatatatataacggctaggtgacgtcatctagccgttattcacaagtttgaattggaaacctgccaggaggttccgagcaaaagtgccaggaacttccgggcagcacttaggaaattttttacaaataaacggcgcccggaagttccggccagaacctccgggtagccctctctgtcccggggagaaaatcatttttcaaaaacgattacaaaaatcttttgactcatggatatgactaagagcactttgtataccctagaaccacacttgaaacccctcttaatagtacggattttcctaaactcaatttcgaaagtgaaaaacctagtctaatcaccttcggtgattttcgcacttaggaacatttgaattggggggtctccttgcattcttagccatcacaacttgctttgggactaaactcctgtgaataaacttgataaacacgttagtcccctttaaccaccttgtcattaatcaccaaaacccactagggggtttaagtgcatcttcatccctctgcctagaggggtgtcaaaacgtacaaggcgcataatcttggaatattcttccatcaaccataccctctagaagctcatctaagaataatcaaccttctttgagcgcgggaggacaagacctcagaaactaccgggaagttgggcgtgctccatagccagctatgaggcagcacgcctcgccataaatgaaacaggtttatggggggatcctcggccagtctggagttgaaagggcatggacaagacgccaacgctaagttactttggacagtggcgcttgggacacgcgtcgcacatgccccgcgccacctgatttagccaaacgggcagagaagcaaccgtggcattgtttcgggtaggtcgggccttatcgggcccaccacgcaccacgtggtgaacacactggcggaggcccaaccatctaagacggagcccggagcccggggtaatatgaactgtaagacttgaagggtttcttgagaactgcgttagggaagcagccaacaacaacaagacggctgattagacaagactaagagtagatttctaatgatgcgagcccctccttagactataaaaggaaggggactagatacggatgaagggttgcattcttctaggtcagaactattgctttgtagcctaaaaatgcttcctttgtacttagctgatctagagaagacaatgaacaccaacacatgactagggtattacacctccgggtggcttgaacctgtataacctcctgcctctctcttctcgtgaggcggttgggccccacgaatccatcacgatcgcagataccgcgcacctcatgccgactaacccccagtcgaatcttcactctcggggattccccgctgtccgagggactgccccctcgacagttacctcttaatttagtggtgtacgtcatatatgaaactaggtgattccccacgttttgttgcagaatttcctaactaacttataataactttttaataatagagctaaaagtaaaaaatatattagttattaacaacaaatacaactggtttgtcaaactatgttcaaagaaaaatacattgtagatgaaatatgatatcccacactttgattatatggataaatatttattaagtattataaaaatgatcgatatatatatgttaaaaatattgtgtgaaggaagatgattggatgctgatttatagatgatgttaaatgcttgcataaattttgtatataattattgcttgtggatgatgcggtggcatgtttgtatattgagctttataattaatgggttacaactctataagataggattagatgcgatagtcacgtcttctataaaacttgtcataaaaagaacacatccagttgtaattttttctctacctttaattagctttgccataaacgacgtgggagtattattattcaacgctgagtcaaactaatgaagtgagctcccataaccacaaccacagaagaagagccccccccccccccgtttcctttttctcggacacggcgaccacctgacgacgcctactatttccgcgtcgcgtcgtcggcccgtctccgtctccgtctccctccccccgcatccccgggcggaggaggccaccccaccgccaccccgttcctttcccccccttcttcccttcctccctcccttcccccaccttttccgctcccccaattaacctcaagctcacccgcggaggcggaggcggagccggaggaggaggagggaagggccggtggcataaggcagcagcgattcttgccgccgccgccgcccgccgccgcactcccacgatggaccgcccgcccgcgccagcgccagcggtggcgctgctcctcgtcgtcgtcgtcgtcgcggcggcggtaatgctggcggcggtggagggagcgggggcggaagcaacaggggtgttccacgtgcgccgcagcctccccgccggtggtgcgggggcggcggcggaggcgtaccgagcgcacgacgggagccgcagggggaggctcctcgctgccgccgacatccccctcggcggcctcggcctccccaccgacaccgggtacgcggcgccacctccctccccttcgcttggcctctgctgctgccgtgcttgcttgcttgcttggctgatttggtgctctctcgtctcgccgcaggctgtactacacggagatcgggatcgggacgccgaccaagcggtactacgtgcaggtggacaccggcagcgacatcctctgggtgaactgcatctcctgcgatcgatgcccacgcaagagcggcctcggggtaacacaccatctcgttttcttttcttcttcttttagatttttggattctctcaactgtgggcaaaaccgtgcgttgcgtgcagctagagctgacgctgtatgaccccaaggactcgtctactgggagcaaggtttcgtgcgatcaggggttctgcgccgccacctacgggggcttgctgcccgggtgcaccaccagcttgccctgtgagtacagcgtcacgtatggtgacggtagctccaccacagggtacttcgtgtccgacctcctgcagtttgatcaggtgtccggggatgggcagacacgacccgccaactccaccgtcacatttgggtcagtcgtgctctgtccctgtcttaccgctgtttttgtatgagctaccttcgaatgatctactgttacacttagtattgtttcttagaaatgacatcacgttatgaaatctgcatgtgaattccagatagcttatgtctgtcacacgatgtataatgaaacttccctatagttaaggaaaaaaaaaccatgaaactgtttcaattcatcgggtggcaatgcctctggcctctaggtagaatttgtatgtagtaatgttttgttggaaaatgcttacatgattcctcccatgtgccagaggttgcgaatattttcctaactattttgtggctatgttttgttttatataaggtgactaagactcaatagccatgttctttgaagaggggtttttttattgcataatctgccattaagaaaggcatcaaatattgtcttggtgtaaaaaatattcattacatgctcttatgaagaatgtggcaatggagtaagcaaaattaacaattaacatggatgcatgacagtaacagaagtgtacagcaatgtggaatttagtaatcaatttagttatatgtgttgaagatgccaatgcaaataaatgcactcctgtcctttgtaggtgtggttctcagcaaggtggggatttaggcagttcaaaccaagcccttgatggaattatagggttcggtcaatcaaatacgtcaatgctatcacagttatctgctgcagggaaggtgaagaagatatttgctcattgtttggatactataaacggcggtggaattttcgctattggaaatgtggtgcaaccaaaagtcaaaacaacaccattggtgcccaatatgtatgtcaacgttgtaccaacacctcattattctgtttgctttttgctcatagtgaaatttcttaagctactttaaatataaatttttgactctatttgaacaattagttagcgaaacatggttttggagatttatcacagttcagtattagctattaagagacatattatatattttaggagattcatcacatcatgtttcaaaccctcaaaaggacatagaaatgtgatatttccctctgcatcattgcattatcttcttatcaaggacgcatggtccaaatctgatgcactatgtgaaacataattgtcctaattaaacgctctactttttgttcatccgtaactgcaatgtagcgtgagctgtccaattagttgaggttttctaaagtcaagcattcaaggttttttgagaaacgctcaggggtcttccggctagctccacaaggtggtgggctagacgacatgggttcgaagcctcaccccttctaattatttaatattaggtccttccctaat

SEQ ID NO: 74503 - DNA, 22837 bp, Oryza sativa
cacacacacacacacacacacgcatatatatatacatatacatatacatatacatacatatacatatatatacatatacatatatatatatatatacatatatatatatatatatatacacacacacacacacacacacacacacacatatatatacatatctacatatacacatacatatacatatgtacatatgtatgtatacatatatatatacatatatacatatatacatatacatacatatatatacatacatatgtacatatatacatatatacgtatacatacatatatatacatacatatgtacatatacatatatatgtatacatatatatatatatatatacatatatatgtatacatatatatatgtatacatatatatatgtatacatatacatatgtatatatatacatgtatacatatatatatatatacacatatatacatatatatatgtatacacatatatatatatatatatatatataaagcaacaactgagacttggatgattttttttaaaaaaaaattccattcgtccaatgtgtgtggttgcaagaatgttgattatatatattcccataaatcgtggagaaattctagttgattcctatgtttgataaaaccaccaggaatgttagttagggggctaactaacattctgagaattaatacgcggcattaggattagttttaaacgttcctggtggttttatcaaacataggaatgcaacattcctagaaacataggaatttgtcatgtctgaaacaaccatgccaccaaaatatatggaggtatttgattatattattacatgaaatatccattattgataataaaacagaaaacatgcattatgtttgtagctagatagctagtttcctcattgcacaaacttggcataaagcagtcgctcgaactcctccatctttcgtgcctccatacacatgagcacgcgcacgccacccccatcgttgtcggtgccatccatcatataaacgaaaccgctgcgcacagactctgcacgagacatcatctccggcttcccccacccaaaatccacgtcgtaaacaggcatgcctagccaaccaatcattcgcagttctgtatctggtaggtttcctttcgcaggcttgttggacatccctgctatctcattgtagtctatcactgactgcaacatctcaccatcaaggcggcccaatgtgctctttatttggccagcacttgcagccaatgtccccaagacaacgtccctcaccgtggaggccactttcatgatgacaagtgcattgccgaagtagcggtctgggagaggtggcgttacacggcgtcggatgttgactgggaaggtgacgcgtgtctcggcgtctagaggcagctgccgagcaacacacatgcactgccatacaagggcgctcacggcacaaaatgtgctcatgccacaacagattcgtttaagggctacaagctggtgcacagagatggtgaagatcttggtagatatggggccacgacgaagagtgcaccctcggcattgcactcaatcttgggcctactgccgccatctacatggagacgacctgccagtgggtagaaggccaccagggccctagccatagcctccttgatccttcctacctcaaaaaagtcggtgttgccgctggcagcaacaacatcacgtcggtagaagtaaacattaggggtatggcctctgttggccaggacgatgtcgaggggagagagccagagcccttgtctaggcgtgtcctcactgggtgctataaaacatgactcaatctcctctaccccttctatctctgacttcagtgccttgtccatgagcagaaagattgactgcaaagtagtaaagtactgctgtggttagttccttttgcatagatctgtaccacatatatgcatcgacaagattggtacatatcaattaaaatgcaataataatgctttggggaccactgctagaaaattttgaagaaaaattaaaaaggcatttaactaacttattcagccacaagtatgattaaaattttaatcacattttttttacataagttaatatttataacaatggaagcgaaatgcacgggttggtgccatgcatgcaactgcaaataccatctaatatttagttttagtttatcaaaatattaatgagtccacaattcggaattaacaaatatgaatctgtacaatcttctattgtaaagttaatttttcattaatttaattccaaaattcaaattaataattagcaagttgtaaatgatgtgtgaacactttgactgtttttgttttgtttttctaaacaaaaagagcatgactcctcctcccctttccattattagaaacgtaggtgtgttctactacaggaaacaaaagattggacattctattactctctctccatcctaaaaatgtatgacgttttaactaattaaagtcaggatcgagtacaacccaaatagttgttatagttacctggattatggtacgatgctgctctctcaatggacacttaaccgattgatcttctccacggccggccttcgtcgccgcgccgtcgtcggctgctccgcctcttcgccgccggcgaccttgccgaggagtctgtgtctgtgccctctccgttcttgagctagctagttagctcgcatgcagtgtgaggctgtgagcccgagcagctctggttgccgatccgtgggggaagagatagattagtggcttgatctggccgcggcatggctgactaatttatactccatccatattaaatattttaatatagaacgtagttgatttatgtaatttattttattgtgacttaatttatcatcaaatatactttaaacataacatatatttttatatttgcataaaagttttgaatttttagataatagaataaaacatcccggactttgctcattagagctatagccaattattacaaaagtacgtatcacctaaacactgagtgtagttcaaatgaattaaacacatccaacaaaataaaagatcaaactaagataaaagttttgatcaaatgtttattaaaaagtcaacgacgttatatattatacattatacattatgaattatatcccatcgatgggaaaagaattaaagaagagatatgatgtggttttcatgttttagttgtcgggaatctctcctctctaaatgtttaggtactaatcactagtactaacataaacacttgtatttactcggtggacacaaacacacaagaactgaacaacacacagctttggtcgaggcagccacaccccggctcacttcattttcctttcattttatagactcacacagtacatgcagataacaaccagccaattctcttgaccgggactcacgctatgcacacaaacgtgcagatgccatgcaactaagtaactaactaatcctacttatttgccaagaaatcacttcacatgattaccactaatcacagcacatgcggctaatcactagcaacaactaaatctcatgcatagctaggaccgattcactcggctaatactgaccacaccttgcttgcaattcggctacttctcgcagcactccacatgcagttgagctcttggtcttcatgaacgttgtttgctccattctcgcaccaccgcatcacacggcatgtcggcatctcgcccatgagctggagccaaactaaatatgcagtttgtacatatctcacgtacatagcttctagcatgtgacctatactacatgtaaacaaaatagaaccatgcatatatcctaattaatgacaagattaaactctatcattagtgtggatacgtacgttagtggttcaagccactagacttgtccccatccaattttcagccatcggatgagcaaaccaacgtacaggatatatatgaagggaactatatatagttgcgccatatttttttctggttaactaaaacacgatcatattaatttctaagcagcaacagatgactatttaataaccaattgttcaaagacagccgtcgcatgaacagatcaacaaattagtaacaataactaagtgtcttgattaaacaactaacataatagaacattgaatttaactaagagaaaatagaaaacaaaaaaatattacagtgtcaaagttctgttgggttagttccttttgcatacatcatatgatccatccacaaatatacatcgagcagggccctatttgattacatgggctaatgtttagccctcaccttttagtctcaaattagccctcaagaatccaaacaggtgggctaattttgagctaattcaaggctaaaaggtgaagagagagtagaaagagagccaaacataacaccctaagctaatgtttagcctaccaattcatgactaaatattagctctcaaaattagccctatgctaatcttccaaacaggacccagctgtagatgcatactacctgtaaatgcaataatgcttcggggaccattaatataattggtatgcgatttatgtggtgctgcagggtggctgttgtttggtggcaggttctattcaattacaaacactatattcatcaatgcacatataacaatatttggtgtaatacacctgccaagtttagaagttttgtgtaatgcgaagatttggctcatacattagagcaagtttaatagtatagcccactactagctctaattcatctatagccaatttaatagccaatttatacaatagttgcttactatactattaatatatggtctcacctggcatacacacattgtggcttatagtccgtgttgcagctggctatagatctgtagcccgctgctcttctcttttctcttttatctcattaaaatatattggcttatagccggctattgtacctgctcttatgcatgctgaaactttacaagttacagttacgcggatttttcaccaagattcacaaatagacttcaataattgttttctccttatgtgttggctttattatttcagttcttattgttgctagagtatttgctctctgagagaactttgtaataaatggttgtaacttctttgtagcaaaggcccggatttttattctattatcttaaaaaaaaaacctacgaaggctcaggagagcaagagagaggcggcctagagctacagtaaaaacaccaataccaatagagatagattctaatagctcgagtggacgtccacccgtttattgcatgtcaactaaatggtaatgaaaaattttcaaaaaaattgacaagatagatcaatatgtatatatcactccagaaacatgcaagttcaaattaacttctataagttgtaataaaaataataaatttaactgtatatttacatatattaatttgagtcttgtttgttatttttgttataatttgtagaagttgaattttaacttggcatgtttgtggtgtgatatattacatattgttcatatttttttcatttttttataaccatgtagatgacatgtaataaacatgtggatatccactcgagctgttaaaacagtttccccaatacgaaggagaacccttcttacctccccgatttcagccggctcttgtcatccatgcacacgcaacatgattttttttagatatatcggatgtcatccgccttctctggaattaatttgtcagcattctaaatataggatcccaatagatagttacctcagcaaaatcactatatagttcgacctatacggaaataaacatcatacgtatatatatgcataaggttgggagcagataaaggagtccgttgataaggatatataggaggtctagtactatttaatctcacctagaactgctcaaatcatatcttaggttgagcacgtactttcactccgcactatggcaaattgaaataagtttcgctttacactaggggttataatcagctctaaacgaaacaacgatgggagcaagtataatgcagatagatgcgtactaaactgcatcatatgatgtaccacctactgacctagctacaatggtgtaccttgagtgagtgaggccctatttagttcgcgaaaagaaaatttttgtgtgttacatcggatgttcgaccagatgtcggaaagggttttcggacacgaatgaaaaaactaattttatgactcacctggaaaccgcaagacaaatattttgagcctaattaatccgtcattagcatatgagggttactgtagcgcttatgtgatgaggacatcctccactattacatgctggtaaagacgcaaaagttgggcgatgaccgtgtgagcttctgaataatcccaccttacttagctagggaggaggaagccaccttaaaagggagagctacccttctcctatcgaactagtcttttaggtagattgggcctttccccgagtgggtgtgcctaagaactgttggagtccggacaaccttaatttgttgggcctcggccaactctacctgggcctgttagggtccgagcaaccttaatttgttgggcctcgaccaactccacctgggtcggattgttatcattatggctaatcatggacttaggtgcaaaagattcatctcacgatttccccccaactgtgcaattagttttttaatttatatttaatgctccatgcacgtgtctaaagattagatgtgatgtttttgggaaaaaaatttgggaaactaaaccaggccttagtttccaaacaaaacttttcaccctgccacatcgaatgtttggacacatgcatggagtattaaatattaaaaaaaactaattatacagattgcatgtaaattctgagatgaatcttttaaacctaattgctccatgatttgataatatggtgctacagtaaacatttgctaatgataaattaattagatttaataaattcgtctcgcagtttataggcggaatttataatttgttttattattaatctacgtttaatacttcaaatgtatatctatatatccgatatgacatgtcaaaccttttcgtctcgcgaactacaaggcctgaaattgcaacacatggggtgtaccaggaccaggaggagagtcaccaccgcacatgcagtagttgggttggcttggagatttggtcgtggtggtccggtaacaatggtgatgtatagcctggcggagcaaggccatcaggaccgccttcctttagtgctctactacagcttttgtttggctaactaactatagccaaacttcataggctgtgttcgtttgcagtagttggaactcctttcttatgcaagcaaaacgaaacattggattaatacataattaattaaatatttatttttaataaagattaatataatttttaaagcaactttcttttttttaaaaaaaaagatgatttagtagcttaggaaagatacatacagaaaatgaaaaaggtgaagttgggaacttgcactagagaacacaaaccttaaaggagtattgtagtattcctactgtgacaatgaactgtacaatagacccatcaacattcaacaaattaattgggagaatgctatgaaggtgtgtgagcgtgccgtgtagccgtgtagatggcaccgttgctttcaggagagggaaggtagtccgggagcatacatgtggtttagaacgctgggaaagggaccgaaggagggaagacgatttttttttgacgcaaaaggcagagagactctaccttgttaccattgtattaatggtggtcatataagtaacaaagccagtggctggcaagagattataagggggaacaaagaggaaggataaagaaaacgaaagataaaaaagaaggaaggaagaagaaaatgaagaagaaagaacaaaacacaaaaataaaaaggaaacctagcttagcttgtctgcccaagtgttgatgtgttcgcgaaggctgggctttaggcgatgaacccataattggagactttctctgatttgatgtaggatgtatgcaacgcttgtttcagtgagcttgaagatcagctcgttgcgtgcttttcagagaccgtgcgaacaagcagcaaagcatgcaggccatcccggtttctggtgttctggcaaggtgtccaggattgattccacaaagagggaagacgatcgagcctagagattttcttgtttcaggcactgaacagtgagtacaacatcaacgatcgctgctgggaagagggctgacgccgagcaagggacgtgtcgtggcgacagctgcttcaacatcctgataatttggtactccgttccactcccttcaaaccttggaaaatagggtaaggctaaggaatctcacggtgaggagctgtggtgctctgaaagggctgcctgatggaatggattgtcgatttttatggctgcagtgaccagctgcaaagatgtttcagagaaggtggtgagtattttgacttgctattcactgtttgagagaagcaaatggtttcacgggtaaatttgacccataccattataaatttactattttagaaaaatattgttacaatttgtgaaaccgactagatgccacaaaaatttcgtaaaattctaataatgccgctgttgtccatttttcaatcatgttcttttcttcctctccccgatgaccacacggaggttggccggcgagctccgggaggcttgtccggtgtgccagggccatcaactgggtggcaggcggtcggcgtggaggggcaatgaggagcactggcaaggtggcatcggccccgcccaaacacaacgcaggcaagttatgatagaccattgaatatatccaaattggatgatgacctgtattccaagcgtgatggatgctggttcaatgtaggggacaagcaacatccgcaactctgtagatggcttaagatcgctgaaggcatcgacagtgagctttgatcgtgccacaacaaagagcgcgccctcagtattgctgtcaatcttagacctaccattaccatcttacactgagacaacctaccaagaggtagaaggccacgagggccttagccatatggtcttgtttggatcatccggactattaaatagccctccagaatcttgctatttaggagtattaaacgtagattactgataaaattcatttcataacccctgggttatttttgtgagacgaatctaacaagatatattaatctatgatttgctacaataatcatccgctaaacatgggttagtatacctcgttatattcgtctcgcaaaatagccaggggttatggaattgattttgtcagtaatatacgtttaatacctcagaggatcctccttttgagcgttcctaactcgaaaatcgcgtacacgaacacgataggggtatggcctctgttggtcaggggagagagccagagtcgttgcctcggcgtgtcccgtggggcgttacaaaacaggactccatctcgttcaacctcttcttctatctttgacagcgcgcagccttgcccatgagaaaatgttggctggaatgtactaaacttttcgggctagctcctttggcaaagatccacacataaatatatatcgacaagctacatatatcaattaaatgcattaatgcttgggggacctagcttgtattgctgctgcagagtaccattactgaaaacagcagacacaccataattatattgtatgggatgccattcgcctgttttgtggcaggattaatttaattacaaacactactctggtgtttgtaatttaatttacatgcaacatgatctagtgtaggcatatcggatatcatttcttttctctagaattaatgcttgtgtctggattgcatatttatcaagcatatacttcccccgtgtcaaattatttattgttcataattcctgagtcaaattaaatgtttcaatctttgaccatcagtttctatacacttaaattctctattatcataagatttatattttcagattcacattgagaaatacttacatagtatatataataattcgtatgtttaagacggttaaagaaaaaaaataatgattaaagatagacatgcttaacttaggacaaacatgacaaataatttgaatcgaaggaagcatgtaaatttagattataagcatggatatatccatcttgcagttccatgctcttggagaagaacaagggaaagccctctccatacaagcttagatgattagcacgatgttaacggtcgttaagtataaactttaaccgtcaactcatatataaaagaactaaaatattacatcaaaatttagtgagtgggagtgggaggtagtggcggaggaagcacaatgtggtggtgcccgccgtagccatggcggtgaggaggcgggggtggggacggctcgaggatgaccaagaatagggcagctgataccgacgacaacacccctagtacgtcgacgagctcggcagcgccacgacacccatcctgccaccgtcacgtctccatcaagcaaccagctcggtgacaatggagaatagagaggtaagcggggccgaagaggccatcgacatcggcaatgacctcgctgctccctcaccagcctccatactgccgtaggatttcttttacaccggatttataagttgggggttaagatttctggtgcgatttaaggatgaggtttaaactcggtggaaagatgaggcctcaaaattccaacagaaagtgacggagagggaaggagaaggcttgggccaagccgaagagaggaggatgaggcccaacgtgaacagttcagttctataatttccaatgttttcaggctccattagctcatctcacgcggcctttgctggccgcttactcgcatccggcatcccatcgatcggcgcgtgccggcggcagcggcgatggcgacggtgagcgagcacacgacatggagcccctcctcatccctcgctcatgtcacgccctctccctagcctcttatgacctgttcactttaatgccaaaaaaaaccttgccaaaattttgacatagttaccaaaattttaaaaacttactaaaattttgactaaaatttggtaaggttgaaaatgacatcaaagtgaacagacccttactctccctcatcatcatcgccccgctcctgtgggacttcaggcgcgccgcgttcgtgcacgcaaggtgcttgtagaaatgcctcaactacagacttgcttgcacttgcagcattctgcgtcgtcttgtctgtaggtcgatgatttcgtgtcaatctggcggccaaatcttggtattgattttgcggggggaatcgacgtgatatatattcattgaagcttttcactctcttcttttgatttttccggtgcaaataagtactgtaaaagacaacttttacggtgatctagcatttcctcctaaaaacaagtgcgcctagctagctgattaggagtacactagtacttgcttatcatcatcagtaggaatttcggagcaagacaaggcatcgccgtgtccattcaaccaagcgtgctttactgctttccattcttttatactccctccgtttcgaaatatttgacaccgttgactttttagcacatgtttacagcggcgtatctaggatttatgatataggtggtccgacttaacaaaaataaacactataaatgtgaaaaaaatgtaatgatggtaatatatataatacaaatacaaaataataaaataaaccaaaagtgtaccatgttatatatattaataagacatcttaaaacatatataaattagcaattaattagtaaaattcagacttaaacaagtttatatggctagaaaagtttgaagaaaattaccatactactactttttataaggtctacttctaacagtggccatgaaagtgtccattatattttcttcattcactttgaagaaaaacatcccgcttaatgaatgaaaacatcctgcaatatcttcatcttttttatgcaatctacaatacaataatacaatttagtatcaaattcacaagttttaaaagttaaatatgaaaattgaagaaaaaacaacacaagttcaagacctaaaatcctaaatacctgccacacccacacggcatcacagccacatgcctgccgcctgcacgctgctggagttctggagtctggacgccgaacagaaaaagaaatcgctgatcccggcggccggcgccgacgaaccggccatgacacacgcggcatgccactgaacagaagcgctgaaggctgattcgccgaagcggcgagccggcgtccggcgatgacggtcgacgatcaggtcatcaaaaatcgaatgagtgagtcgagaggacagagcagtcgcgccatcgcggtcatggcgcggagggcagagacgccgttgcggagtcgcggactcgatctctatctcgctcgatcagcgctcgcggtcatgctcctgcccaccaatcttgcggcggaaaacaaggcgtgattgttttgatcgctagaaggaagacggctcgtcgctcgagtcttgacgctggcgcttcggtctgatctggtatcgtacaagttttttcttttcttttttttaaagaaacttatactacctagttgcgccgcaatttttttgggaccacccggaccaccctacagatccgccggtgcatgtttgaccgttcgtcttattcaaaaacttcttgtaaaatatgtaaaattatatgcctacataaaaatatatttaacaatgaatcaaatgataggaaaagaattaataattacttaaatttcttgaataagacgaacggtcaaacatttcgaaacggagggagtatataacaacagtagtaaagcgtgcttagccaggctagctggacggccaaaaataattttgccaaaataatactatcaccttgactttgccttgacttacattacgattcagatcatcgatcactcgtcctcttattcgctactaatttccttcgcacatccagcaatcagatatcctgagatagacagagacagcacagaagtaaagaaggcccgttgtcactgtcagctagtgcgagctgagtagtggtagaagcatggcagaatcgctgctcctcccggtggtgcgcggggtggtcggcaaggcggccggcgcgctcgtccagagcgtcactcgcatgtgcggcgtcgacggcgatcgccacaagctggagcgccagcttctggccgtccagtgcaagctgtccgacgccgaggcgaagagcgagaccagccccgccgtgaagaggtggatgaaggacctcaaggccgtcgcgtacgaggccgacgacgtcctcgacgacttccactacgaggcactgcgccgcgacgcccagatcggcgactccaccaccgacaaggtactcggctacttcacgccgcacagccccctcctgttccgtgttgccatgagcaagaagctgaacagtgtcctcaagaagatcaacgagctggttgaagagatgaacaagtttggcctagtggagcgtgcagatcaggcaacagtacatgtgatccatcctcagacgcactccggcctcgatagcttgatggagatcgttggcagagacgacgacaaggagatggtggtgaatttgttacttgagcagcgatccaagcggatggttgaggtgctatcaatcgtagggatggggggattgggcaagaccacacttgcgaagatggtgtacaacgacacaagggttcaacaacgctttgagttgcccatgtggctctgtgtctcagatgatttcaatgttgtttctctagtcagatccattattgaattggctaccaggggaaattgcaccttgccagacagaatcgaactattgcgcagccgtctacatgaggtggtaggccgcaaaaggtatctacttgttcttgatgatgtttggaatgaggaggaacataaatgggaggagctgaggccattgctgcattctgctggtgctccaggaagtgtagtacttgtcacaactcggagccagcgggtagcatccataatgggcacagttcctgctcacacgctatcatacctaaaccatgatgattcatgggaattattccggaagaaagcattcagtaaagaagaggagcagcagccagagtttgcagagattggcaatcgtattgtcaagaagtgcaaagggttacctcttgctctgaagacaatgggaggccttatgagttccaagaagcgaatccaggaatgggaagctattgcaggaagcaagagttgggaggatgttgggactacaaatgagatcctatccatactaaaactgagctataggcacttaccacttgaaatgaagcaatgttttgccttttgcgcaatcttcccaaaggactaccagatggagagggacaagttggtccagctctggatagcgaataatttcatccaagaggaggggatgatggatttggaagagagaggacagtttgttttcaatgagctagtgtggaggtccttcttccaagatgtaaaggtagaaagttttcatgtcgggattaaacagacttacaagtcaattacatgctacatgcatgatctaatgcatgatctagcaaaatctgtcacagaggaatgtgttgatgcgcaagacctgaaccagcaaaaagcctcgatgaaagatgtccgccatctgatgtcaagtgccaagttgcaagagaacagtgaattatttaaacatgtgggacctcttcacacattattgtcaccatattggtcaaaatcatcaccactacccagaaatatcaagagattaaacttgacgtctttacgagcattgcataatgataaattgaatgtttctccaaaggcattagcaagtataacacacttacgataccttgatctttctcattctagtaagctagaacatttacctgattcaatatgtatgttatacagcttgcaagctttgaggttaaatggttgcttgaaacttcagcatttaccagagggtatgagatttatgagcaagctcaggcacctttatcttattggttgtcatagcttgaaacgcatgccaccaagaattggtcagctaaagaacctccggactcttaccacatttgttgtggataccaaagatggatgtgggcttgaagaactgaaagacttgcatcatctaggtggccgactagaactgtttaatctgaaagctatacaaagtgggtcaaatgcaagagaagccaatctccatatccaagaaaatgtaactgagttgttgttgcactggtgtcatgatatattcgagtacagtgaccatgactttgatctcgatgttgttgacaacaaaaaggagatcgtagagttctctttacctcctagcagacttgaaacattgcaggtatggggctctggtcatattgaaatgtcatcatggatgaaaaaccccgcaattttcctatgcctaaaagaactccacatgtctgagtgctggagatgtaaggatctaccaccgttatggcagtctgtctctcttgagtccctgtctttatcccgtttggataatttgaccacattatctagtggcattgacatggctgttccaggatgcaatggttccctggaaatttttccaaagctgaagaagatgcatttacattacttacctaacttggagaaatggatggacaatgaagtaacatcggtgatgttccctgagctcaaagaattaaaaatttacaattgtccaaagctagtgaatattccaaaagctcctatcctacgagagctggatatattccagtgcagaattgcactgaactcactcagccatcttgcagcactttcccaactcaactatgttggtgactggagtgtttctaaggatttgcaggtaataccaatacgctcctggccatctcttgtgacattagcgctagcctctttagggaactcgcttctcccagatgagcagcagacgaccatgccccctctggaatcaattcagaagctgagcatttggtattctagttgtttcttctcacctaattcgtcaaactggccctttggtttctgggattgctttgcatttgtggaagaattgtcgatagtattatgcgacgatcttgtccattggcctgtgaaggagctctgtggcttgaattcccttcgttgtgtaagatttagttattgcaagaatctgaccagttcatcatcagaagaatccttattcccgtctggtctggaaaagttgtacatagaattttgcaataacttattagagattcccaagctccctgcttcactggagacactacgcattaatgaatgcacttctttggtgtctctgccaccaaatcttgcaagacttgccaagttgagagatctcacattattttcttgctcaagtctgagaaatttgcctgatgttatggatggcctcactggtcttcaggaactatgtgttcggcagtgccctggggtagagacactgccacagagtcttcttcagcgactgccaaacctcaggaagctaatgacactaggaagccacaagttagataagcgatgcagaagaggaggggagtactgggagtatgtctctaatattccatgtctgaacagagacttcatagaagaaagaccctgttaaggggtttgcaaagaaattcctgccttgctgctcaactctcaactaaggtctgcctacatgcactgcctcttctctttttttccccttctcctccttggattatgtaagagtgattttacagtcattgaggagataccatatttttctagtgtaaaatatggtacctctcaaggaccgtgaatttactcattatgtaaatgtaatgtttgtgttcctctgaatctgaatctgtgataggtggatagcagtgaacaacccacacatgatgcgcaatccaagggctatcagtccctcacctttgaacctagatcagtagtgctaaatgttaaccattgcttgctcaaccaataaaaatggtaaagatcacagattgcagtcaatgaatccatatgccatctgaagattgagctagacatcaccactaccaaacactgcatttgcttcgaatttagacatagaatttatttttttttagataatggattaaaaccctgcctctacatcccacaggatatacacaaccctaaagatttttttttagagaagggtattttttaccggcctctgcatccaaccggaaccggatatatataccggcctctacatccaaccggaaccggatatatacggccattgaaatagggaacttaaccccgcaaacaacctaatctgaaattcgctcctatggagatttgaactcaggatcttggggtactactcaggtcactgtaaccactagactacgtgccctttcgtacacaaccccaaagatacatagtctgagcatagaatttatttgcattagattgtaaaacacaaaaacaatcccaaattgcaactagccatcatagttttgcaagcatacgtcctgaaaaacagcaaagggtctataacgtaaaccagcaaacaagtaaacatggtaaaaccgctcaaaccagacaccctaaaatcttttagaaatcctcctaatcctctcattctcacgtcatatgcaaaccttaaacataaatacagaacgagtctccttaataccatcggatgcaacccttccaatcttttgacaacaacaacaaagtcgcgtccaaaccctacaaatcgcgaccaaatcctagaaaccactgcaggaaagtaaatggcatccaaaccctaggaaccgcgaacttgtaatacgacaaagaagcagcaggagcagaggtgggaggaggaggaggaggtaccaacggtgagaaatcctctccgcctcttcaccgagcgtctcaatgagcttccgccagggctcgtgccgcgacccttagttcaccccgggaaccctcggaccaccgcaggtttccgctcgcatgccgcgggtgccggagagcaccactgccccgtacggaagccatcggcgtcggcggatccagcgcggcggcagacgaacccaacattgaagccactaggccgtccttccccggcggccggcaaggccaatccggcggagaagtccgggcaggcaaggggatggggatggggatggagacggggacttggaacgagaagaccatatactaggagggggtttctcgcaaaaagtcgtggacaagtgttgaattttccgaatatcttaaccgtctggatcagatcggacggcccttatccttcagaagtttgcaaaaagttcagggtttcagactcttaagaagttcagatttttctaagattttagggtgtctggtttctataatcttcagagtcttctcctgtcatcgacatcgctatcgcagtgtacttctgatttctgaaccaccacggcgatctacccgattgcaagctcatcgatgtcgatttcattcatcgaaaccaggtgcatgctgggctgtaattaagccgatatgcagttggtgattgaatatgcagttatcatgtcatgcataatttgttgattctgagccattccttggtgagttctccttctgtgggttgttgcgtgttacgatgacggttgcaaatcgtgttgtactgcaaatggggcgttgaaattcttgttattattggctattcataaagcctgagatcatagagtgcatggtttttctttttcttttacaacaaagtagacaataccccatttaagtagtctacatcaagatagaacatggtatctctgtgacgggactaatcagaaggaacaaaaatctagtgcaatcagctgaaaatcctggtaagtactaatatgacaacccacaaagaaactaagatttgaatgtacaatgcaaaaaaaaaaaaagtcaactatcaacatgctcgatcaattcaaatgaacaattgaagactgtgacagccaaaaatataagcttaattgcctctttgctttctttcgcgcatcgagcaatcaaagagcctgagagaaaaagcgagagaagttgcagctaattagtgagcagcatagagccatggcggaatcgctaatcctccccatggtgcgcggggtggcggcgaaggccgccgatgcactcgtacagagagtcaccggcgcgtgcggcgccgtcgacgacgaccgccgcaagctgcaacgccagctgctggccgtccagcgcgcgctggccgacgccgaggcgaagagcgagaccaacctcgccgtcaggcgctggatgaaggacctcaacgccgccgcctacgaggccgacgacgtcctcgacgacttccgctacgaggcgctgcgccgcgacggcgacgccaccgccggcaaggtactcggctacttcaccccgcacaacccactcctgttccgcgtaaccatgagcaagaagctgagcaatgtcctcgagaagatgaacaagctggttgacaagatgaacgagcttggcttgtcagtggatcgcacagaatcaccacaagaactgaaacctccttatctccagatgcattctgctgcactggatgaatcaagtgacattgttggcagagacgacgacaaggaggtggtggttaagctgttgctggatcagcgatatgagcagagattgcaggttctccctgtcatcgggatcgggggttcaggcaagacgacgctcgccaagatggtgtacaacgacacgagggtacgtgaccatttccagctgaagatgtggcactgtgtttcagagaattttgaagctgttccccttctgaaatccatcgttgaattggctacaaatcgaagatgtcaagtgcctgacaaggacaccatcgagctcttgcgacggcagcttgagggagccattggtagcagaaggtttctgttagttcttgacgatgtatggaacgaggatgagaacaagtggaaggatgaactaaggccactcttgtgctctgctgctggtggtcatggaagtgttgtagtggtcacaactcggagccaacaagtagcatctatcatgggcaccatgagatcccatgaactagcatgtctgaatgatgatgattcatgggaattgttctcaaagaaagcattcagtgaagaagtacgagagacagcagaattggtcaccattggaagacttattgtcaagaaatgcaaggggcttcctcttgctctcaatgctatgggtggcctgatgagctcaaagcaacaactccatgaatggaaagccatcgcagacagtgccagagacaaagatgaaatactttccatgcttaaattaagctacagacacttaccatccgaaatgaagcaatgttttgccttctgttccatattcccaaggaaccatgagatggacaaggaagtcttgatccaactgtggatggcaaatggtttcatccaagaagatggaataatggatttggaacaaaaaggagaatacaccttccaatatttggtttggagatccttcctccaagatgtcaaagcaaagaaaactctggaccatttggcagagctccagccgtcgaccattctacaaaaggaaattatggacaaggcattaccatatgagtccattggttgcaaaatgcacgatttgatgcatgacctagcaaaagacgtggcagacgaatgtgtaacttcagaacatgtacttcagcacgatgcatctgtcagaaatgtccgtcacatgaatatatctagcacttttggtatgcaagaaactatggaaatgttacaagtaacatcatctctccgtacttggatagtgccatcacccttgtgcagggatctcaaggatttaagcctggcatcattaagaacccttgtaattgaaaagggaatcttccattaccattcggttatgtctaaccatgtgatcacttattcgaagcatctacgatatcttgacctatctatgtctcaaattgttatgttgccaagttcaatatgtgtgatgtataacttacaaacattgagactcaatggttgcagctttctaaaatatttaccggaaagtatgggaaaaatgaggaagctcctccatctttatcttctgggatgtgatagtttggtgcggatgccaccaaactttggtcttttgaacaatcttcgcactctaacaacatttgttttggacactaaagctggttgtggaattgacgagctcaagaacttgcgtcacattgccaacaggttggaactgtacaatttgagaaaaattaattgcaggaacaatggaatagaagccaatctccatcagaaggaaaatctaagtgaactactattgcactggggtcgtgataaaatttacacaccggaaaacagtgcctacaatgaggaagaagtgttggagtcacttacacctcatggtaagctcaaaattttagagctgcatggatatagtggcctgaagatcccacaatggatgagagacccacagatgttgcagtgcctaacaactctccgcatttccaactgtttaggatgcaaggatctatcaacactgtggttatcggtctcgcttgagcatctgcagttatcccgtatggataatctaaccacattgtgtaagaacgttggtgtgggagctgaaggatacaccatccctcagcaagttttcccaaagttaaagtctctgaaactagagttgttatttagcttggagaaatgggcagaaaatactgcaggtgaggctaagaatttggttacatttccagagctcgaaatgctacagatcattcgctgtagtaaacttgcaagtgtcccagactgtccggttctaaaagaactggacagatttggatcttatatgcttgcaatgaacgaactcacacatctgacatcattgtccaagctcaattacgttgcaaacagtctttgtgattgtgtgagcatgcctttgggctcatggccatctctcgtagaactagttcttagatcttcaacacacattccaaccactctgcaggtggaggcaaatcaaggccagctagaataccttcggagtttgagtctagtaaactgcttcacggctgcatccggctcatccgaaatgcgtcttgggctctggaaatgctttgcctttgtggaggtattgcatattcatatgtgcctcagtcttgtgtgctggccaactgaggagttgacgagcttgattcaccttcgacacctatatattgagcactgtcatagacttgagggaaaaggttcatcatccgaggaaaaattcatgtcactgtcccatctagagaggttacacatacaacactgctacaatctactggagatcccaatgctgcctgcatccctgcaggatctgcggttagaatcttgccgaagattggtggcattgccttcgaaccttggaaatctggccatgttaaggcatctttatttgatgaactgctatgtcctgaaagatcttcctgatgggatggatggcctcgtttcccttaaaattttggagattcaggcatgtgcagagatagaggaattcccacagggtctcctccagcgacttccaacactgaaagaactgtccatacaagggtgccctggattggaaacacggtgcagagaaggtggtgagtattttgatcttgtctcttccgttcaacgtatatgcattccagcagcagcgaaaacagaaatggaggaggaatcaaggtctggaatctaacctgaagaagcttgtaaaaaggctcatcccctcctgctgactctcaaatgaggtgcatacgctttgctcttccattatctcactcttgtcaccatgcaaaggtccagaattgtttccatgcttcttcttccat

SEQ ID NO: 74504 - DNA, 79722 bp, Oryza sativa
  unsure (1)..(79722): unsure at all n locations
ccgcgatgccggcgagctggtgcacggtggtggccctggcgctccgccggtcggcgctgagcatcttcacgcactcggtgtggttggtgcgcttgcacgtgcgggcgacgaagcgggcgtcgccgacgacggcggaggggagggaggcggcgacggagacgaggacgacgacggcgaggaggacggtgacggcagcagctggtctcgccattgctgaacccaactcagtttgatcgatgaactccttgattaattactctagttcttgtgtttgttgattttgctatgagtgttctagctagtttgtgtatatataggctttgaaaagaatcccaaatataaaaaaactcattaattgaagcatttaatgtttttttcccttagagcaaggtcaatagtatagccaactactgactccaaaacatctatagtcaatctaatagtctattcatacaatagctaactataaaaatatactacatcattaatacctggtcccacctctcatacacacataatatcttggagtccgtgttacagccgactacaaatctgtagcccgctttcttctctcttctctttttttctcgatatatggttatagccagcttatagcctgctattgtacctgctcttatggaatccaaataggagtaatgcctttgagcatccaatttgaggaatttaatactatttggaagaatttagtgttgtatctttaatgaatttattgccttcaccccctagaaattccaattttcttgaggacttcattgtattttcctcaggaacccaaatgtttgtgtgcatttatttttcgtggaatccaatcttttgctatgaaatttattgtggattttttttctttttgaacccaattatccaaacccaaaccgtgcagaatattaaaaaggtcatatagatagaaagatggtgatttaacattggaagtacacatcttagagggacgtgactatacaggtagtggtagctccatctatgttagaccctatccacatatatttcaaataaaattttctcttaaactactcattcgatcgacgatccgattacaccgttgtgttcgtaataattactccctccgttttttaatagatgatgccattgacttttttttacatgtttgaccattcgtcttattcaaaaaatttacgtaattataatttattttgttatgagttgttttatcactcatagtactttaagtgtgatttatatcttatatatttgcataaaatctttgaataagacaaatgataaaacatgtgagaaaaagtcaacggtgtcatctattaaaaaacggaggcagtaaatctttataacaagatctcacatgattatattttgataaaaaaatataaattacttttataatatatctaaattacttttagatttcactaaattacttcttggatatataaaagtaaattcaataaagcctaaaagtatttacatatattatagaagtaacttataacaaaaaaataactttaatgcatgcctttttttttattttggacgtgactacacagctagtggtagccggtttgtattccttctagtgtctcatttcaacttgaaaaatgcaatagtatgtatcttttttaatctctttaataacttatatcttttaaatcacatattgtttttaagatatatttatagagagttacttctgaaccatgcaaaagttacttccatttaacattgaagttatttttaaaaattgttaaactttcatgtgttgatctgtgctgattaaatttaatttctagatagtcatatttttatccctacaacaaatttacttctaatgtcgtgacaaagttacttccgttttattttaagttactttttataatatatgtaaattacttttagactttattgaatttacttttatatgtctaagaagtaatttagtcaaacatatgataaaagtaacttacatatgtaataaaagtaatttacaaatataattttatttcatcgtaatataatcatgtaagatcttgttctgaagatttaattgcaatgaacacaattgtgtaattggattgtagatcggataagtaatttgagagaaaattctataaaaaaaaaatagacatgcattgtgtgcactagtaacaactggaccttttctcacgtaactatactagcaacactggaccttctctcacgtactatagcactggaccttttctcacgtatgaatgcatcgctcttttaacactaaatcgagagcgctgtcggtttagattttgcgatcttagagcttatactagttataagtaagattggagctagtagtaaagtataggtaagctctgatccaatattgagcccctgagctttactcctttgcaactatactcctgtgcaaacagttggtgatgattcataactgctgactgaaaatggacgttagatgtctatgatatgatctcgttcagaagcagaactgcagaagcataagggtttgttcggttcatgcatgatcctgccatgatgcatgccatggcatgctcagttcgttgagacacattcagaatatggatggatcaaattgtcagacaactctttttatttaggagtacattttatttccatccaactagatggtttgatatggacacaaaaaatatctgaaactctgtgttgatcgttgttattaatttatctgaaaatcaatacagggatttgatgcacaaatacttgttacaaatttcacaccaagcacaatctatccaaatacaaaaatttggctcatacatagctcattgctaacatctatcatcacttgtacgtaatgggcatccatgtacatcatcggaatttttttccccaatggtttcagaaattacggcgtaggaatgaccagttgagcctcttgatgcgaacgatgcggttgagctcctcgcgaacggagacgagcagcacgtacgcctcacgtgcgccctccacctccacgtccaccacgtgctccaccgtgccggagtcggggtcgtagtagccgccgccgccgtcgaccacccgcacctcgccgccgtcgaccaccgccacctccttctccgtcgtcaccgtgagcagcagcacggccccgtcgtcgtcgacgtactccacgcaccgcaccgcctcgcggacgccgccgccgtcgtggagcgccgccggcaccgtcctctcctccatcagcgggaacacctcgccggcgatctccaggcactcgcgcgcgtcctcctcgtcgtcgtcagggacgaggcggcggcgacaatcctcgcgcgagaagaagagcggcttcccgtcgtactccacgcagtcgcgcacgacgccgccggacgtcgcgacgcgccacctcgtcagctgcggagcgtacagggacgccatggccgcgcgccgccggtgacgccggatcacaccggagaagctaagctaagctaaggatcagcaagtgcaatgcgctctgatcgatggcgacgatgagcttgcgatcgaattgcttgagctctcatcagggccagcatctgaatttatcatgagcaccaaactcagtgtggaattcggagtcggacaccgattccgagacacagtcgatcgcggcactgccgctcctgtgggacccacataatgtattctcctggagcccatgggcccatgaccagttcagtgccatcttgggcttcgagtttctattctccataggaataagttcatcagaggtcccttaacttatcaacgaatccaattttcgtccttgaccctcaactatcataaccggtgcagataagatccctcggcggtttcgatggtggttttggctaacgtagcgcctacgtggttattttgactcggtcttcatccgacgtggcactgatgtggcgcttaggtggcaattcagtctagaaaaataataaaacctgtgggacccacatgtcagtttcacattcaaaaatatatttaaaaagtgggacccacgtgggccccacatgtcatcctctctgtctatcttttttttttcctttttcattctttttcttcttttaagatggcatccggaggccgatgcgagcgccgcgccggcggagagggcggccgacgggaatggagcgacggccggcaggagggagggagaggagtggcggccggcgggtgggagggagaggaacggcggcgcgcgccgcgctggcggagagggcggtcgataggagcgccacgagggaggaggcgagctcgtcggggcggccggcgggagaagaggcagcacgcgccggccgacgggagggagggagaggagcgggaggtggctccggcggctgtgggcggaagaggaaggggcggcgagaggtggccctggttgcggctgccgttgggagaggagacggcgtcgatggtgaggaggacgctcgcggcgctggagacgcggtcgctaggttggtcgaagggtgagaagggagtggcgggggaggtgacgtcggggcgcactagtcacggtcggcgagcgcggcatgcacgtggcggaccggaccgagaaaggcagcggggacgacgacgagaggagatggagcgcgaatcgggacagtagacggcggcggcgtgaccccggtgtcgaggccgatcgaggtcgagtagcgtgaccccggcgtcaaggtgcgcggcgacggcggtcgcgtccccctcacctgccaactcaggatatctggtggtggtggtggccggcgacgtcacactacccggtctaggaggagcggcggcgcgggcggtcgtcatcgccggagttgcgcggaagatggggagttcttgttgttgccggacgggcggcggccggaggcccggagcagagtagcggagcaggccaactttgccgctatggatcgccgcggccacctcctcgctggccatcccactcgaacgccatcttcgtgcgcgctcgccgcgggccactgtttttctttttatctgaccgacatgtgggccccacattttgtttttattttttatttttatattttacttccagtgccacgtcaccgccacgtaggacgaggaccaagtcaaaccggtcacgtaagcgccatatcagccaaaaccaccatcagaaccactgagggacctgctttgcaccggttttgatagttgagggacctgttgtatctggttttttctggttgaaggacgaaaatcgaattaattgacaagttaagggagcttaagtgaacttattccttctccatatattgggccagatgactaaatgggccggacacagactttctttctgctgctctccctgtggtctactggtctcgtcgcagagcagcagcatggcagttggcctgaatgcaacgcagaatgcttactgtactacttgcttattgcagcatattcattcagggtttcagaaattcagtctcagaatgcaaacagttggattctctagaaatttcaggaccaacacatgtaatcatcgatatgaagcataaatcgcattgggttaaagttcaaagtcaaggatcacaaatttgacaacaaatcacggaaactatcaccagttgttcgagcgtagccagtttgcagtgccatatatactgccatctcttgtttccatcagaacctacaagctaggaggagtaccgattaaacttgctttgtaattgcatcccaccaagatatagttatgaattcatgacgaggagcagcacaaggcttgcattgcatggctgcatcatagcttaccatactccataactgttactcctagcccatccatcatgatgcatatgccttgccatgctctcttcagacttcagatcatggattgattcatcgatcgtttcgtcagaaaccttagttccccaaaaaattttcctaaaaacatcacatcgaatttttgacacatgcatagagtattaaatatagatttaaaaaactaattacgcaattagaggaaagattgcgagacgaatcttttgagcctaattattagttcataattagccataagtgttacagtaacccgcatgtgctaatgacggattaattatgctcaaaagattcgtctcgtggtttccaggcgagttatgaaattagttttttcattcgtatccgaaaaccccttccggcatcctgtcaaacatccaatgtgacaccaaaaacatttttttctcgaactaaatatgcccttattttgatttcccatataggattacttcctagtgccattcaagcaacgatcactgttcagtaacagtacatcatgtcgcactctaaaaagcacataatttatctgaaactctgagtagatctgttgtttctttggagtaacagagattcagacaacagaatgatcaatgcagcacttacaggtaggaaaaagattggatttggggggaattgatgcatgcaagatgggagtagataatgctctgttcagaaagtcagaattccatgcccccacgcatgtgacatgtagcaataccaccatccatatccactgcctactcaagtgttcctcatcaactgccattttctccttattagataatggaataatcctatcaacagtccatggaacacagtaatttcacagtacctacctaccatgacaagtcataaatatttctaaaaacattccggtgttccaaatggcacattaaatcctgaattaatgtgcatgatggatcaatgggacagatctagtacatgattaatatttcaaaacaacaaatttatctgatctgtaaaattatactcctactcctgtttatttcgttacggttgtctgcatgcagtgtgatgcttgcctgtcatccagtgattattgcagaagcagcagcagcatcacattcacatcccacgttggcgccgacatcctgtgcagcagccacatgcgcatgccaaaaccgagaggtattaaaaaggagattaacttagcataaatccaagattaaatccgtttttgtatgcgttgagattggtgggaggctgggagaaagcacatgctcaccaaaccgtttttcagttaagccacagttgttgtgatgtgtgatgatctatatggaccatccatgcagggctaggctgcagccatccatgcatgcatgaaccaatgcaaatgcttttgataatatgcagatctgaactggttaattatttcccagaaagctactacagcctaacatctctcactctcaccatcatgggtgtcacttggttgctttgctgccagactgaaagttttaactgtccagaaactagaagcagtcgagtctgtctaattactcttgtattttggttatgtacttttgatttagatgtagaggctgggttttaatcaattttctaaaaaaatatatacagaaggtattgtacatatggatcaagtggttttacttaactcatctgaaagaatgaacgaattaagcaggtttgttcttggacagtactacagtgatgccttgcaaattgagcaaaggcaggcaaaacaagtacataaatttccccagattaatggagtgagacagctaatagtactattatggtactgttagtaccttgctgccactaattcgaggccattttttatctgactttttgtttcttcgagcacttgggttcagaaccgcatggtttttgtttttcgtttcgagaaaaagtggagctctgttccttgcttttcaagtgaacttctgcaatttccatcctgttctgcttcagaattttatttgtacatacatgaatgtgaaagatatcaaatgtgtacacatgtttgtagtcttgtagagagtatgatcaatgatatcaactagctgctgcattactagaaccacatgcagataaggtcgaactaaaccaaatcaatgataaaattttgagttattaaaactaagtactttggctggtgcaatgatatcgacggctccaatacacgacgacataatacaggcataaaaatactctggcaattagtttaccaaccggcaatgcaaattatacgacagtggttaggagatccctatcaattaatcatcggcagcgactgtattattctgacgcttgaccaaaatgggggctggcctgaacattaatcattttcaggaaaatgtacttatctgaaatctacaaaatatcaatgtgtttggttaaatttaaccctttctataacatggattagttggagtacattacaatctgaagtcaaactggagtactgcagagacagactgtcggtagtccgatttttgattctgcgtacagtcgttgaccaaattagattggaccatttcatggttactgcagtctgcaggagaaagaaaagaacacttgatctgcactcaagcttgggtgcttatcttaagtcacaaccaaccacatcttaatgacctgatgaatatgagatgagcttggtgcttttatgagaaattgacttctcccaggaggtcccaccatgtcagtttctaacccacaaattttgtacaaaaactaaataaattcttgcaaaactcctactattactacaattttcttagacaacagcacacaaaaccttactatatcaaatactctatccgatccaaaatataacaacctaatacaaaataagacacgtcgtactactacgaatctgaacaaaacccttgtctagattaatatttactagtatctttatcttaatttgatcatcccctaaatagagggcatcaagaccaaatacactaatccaacattctgaaattaatcctcatcgatcaaaggtgctccgtcgcttcatgttcaacaagttaattcacactttaaatgttgtatgggttgaactaatagaaatcaatcttgatttgttgtatgcatgtggggcattcacaatgcacatgtactctttacacaaataaaaaaagaagcaatttattaaataattattattttgaaaacatcttagatgatgattaaattgggatgaagggagtagaatatactcctatctctacttcgggtgttatattttaggttggaggaaatagagcttaagcttgtaatatgctccctctatcataaattgtttagaacacgatttttcttttgctttaaatccaagtatgccaggaaatatcgatgatcgatattttgaaagagcaatcgaatctcgttctaaaggtcggatatttatgacgtgtattagggcttttgcattgccattgtttacccaaatgttgtaagcataaaaccatgtcaagattgttttttaacttttgggtgaaaactttcacagttggagcagtaactaaaagaaaaaaaaaaggctttccctttctccaaattgtccttggaactccactttgccccattgaaaacgacgcctgacctcaacaatagcaccacccaggcacccacccactgacttcccgggccccacatgtacaatccctacaatcgagagagagagagagagagagagagagagagagagagctcgaagcttttcccaaataactttgccacagtgcctcctgcttcccccctgtgcttgcagacttgcagcgcagagctcagcgtagcgtgctctcgcctccacactccacaccacaccacagtcgcctctctcctctttcaccgagaagcgaagcgagagagagactggcaccgccgcaagaagccaaccggcgggggagggagaagcagagcaagcggcagaaagaagaatcattggttaggctctgcagaggagaggcggcactgcactggaggtgagaggctgagaacgagaggtagaagaagaatcgggagaaggatcgtcttcacgggaggagcaaggaggggataattaggctcggattgccattaggctgaggggggattcgcgaggcttgtgttgagaggcttgagaggtgtgtgctcgcgtccctctgcttcttcttcttcttctccatcttactgtattctttatgctgcttctagatttgtctcttgtatctgtgatgttgatggagttcgtcagaaatgtcccttcttttcttctcttcctcccatgatttcttcgagcagcatctttctatattctgttctgtttttcccccctctgaagtacgttttggaactatgatgattccataacaagttgctagtcgaagattgcttgttactctatcgatcaatggcagttctgcagctgctgcttaaaatgggttcttttgctcaagatttgattgtgctttctccttctgtatctctgttggtatatagttctgggacaggtccactttgattctatcatgggactcctatttgattgtgtttgaggtcctcactggatctgctcacaccttacttgtactcgtatagtatcccattcggattgaattaaatgcatttcctagaaaaaaaattgctctacttagtccttgctccttgcagcctccatttcgagtacacctctatttattcgatgcttgacttcattccaagcagtattgttgggcagctaggtgtacttgtcttctcctttctgcactcaaaatgttgtagttaatggcacctttcgtgctcattgagtttggtatgctttttatggttcagcaaaatgggagtagcaaattgttgtgctttggtttcaattccagtgacaatttccagccatattactagttagcatttactgacaaaatgcattggtttcgtgttcactgtgagccatcaaaacggtttgtgctaccgacatgttagcctggattgagtttcactgtaaagttgcaacctttattacatttggttgttggtgatttcattttcgttaggactacccaggttgtcgactattaactcattagacttttgtcactttcaagttctaataattctttgaagtcctctgtatgattactgtgatttctgaattgtgcttaacatttgcaggtaatgtgctttagagtcgacagcaatggcttcgctggtacccggggtccttctcaagctccttcagcacatgaacagcgatgttaaagttgccggcgagcaccgttcgtcccttcttcaggtggtcagcattgttccggcccttgcagggagtgatctgtttaccaaccagggtttctatctcaaggtgtccgattcctcgcacgcaacatacgtttccttaccagaagagcagcatgatctcatattgagcgacacaattcagttgggacagttcatccatgtagaccgtcttgaggcagccactccggtgccaatcttgaggggagtcaggccagttccaggtcggcatgcttgtgttggcagtccagaagatcttgtggtaacaaactccacttttctcggaagtaagaaggcacaacaatccatcaacgggtcaaaggatgccagtactttatcactagaaaaggagcagagcaaattggagaaattaaaaccttcagtgaaaaacaatggggcagaaatcaagaaaccacagttaaccaaatcaaactcttctctctcgaaacaagcattgaatagcattatagacaagaaggaagtagtcagctcaaagacaaaacctaccagtgctaggtcgacaccttcatctccgaccagcgtttattctctaccggcatcatttgagagattctcgaatgacataaagcagagaacaaaatcaaaaggagcagataagtcatcaccttctaggctttccttgttagagaaagctgcttctgttttgaaggctactacagcagggaggaagtcctctgcaggtaactggcttagtaacaccatgtcaagtattgaatcgggaccaaaggccctgagaagaagctgggaagggaatgcagaagcaaagagcaaaggaaattcagattcaaaggcagccaaaactgagaaaaagtctgagaatagaagcacatcggtacgtgcggttgttgtcaacgcttatcagttatatttgtctacaaatgtggcgtgatttactttattgagtatccttcatgtagtacttaagctattgccttaagcccttaacacattgtagcctttcagtaacatttgaattcatgtttgatcctttattgcccatcttttttttttccaaagttactaatctttgctggctcttttgttatcagactccaagacgcaaaccactagtagaagagaagccattgcataaggatgacagtaagattcagactcctccaaggaagagctcagcaagtgccccttcagatgattctgagaaaatagtgaataagccttcttctcctttgaggaggacgtctggagtttcaagcaacacaaatattacaaatctagtgaagattgcttcaaacagcaaaaagttgacagatgctagcgcttcatggacatcacttcctccttcacttgctaaattagggaaggtatgaatatgctcattcacatgttcgcataggttggctcattgatgtgttcactatggctgtttgctacaataggtctagcattgcaaaaccttttgcaattttgagggtgctaatttaatttttgtctttgcacaaatatatacttaacaaaagaaacgatggacaagccctgttttactatgtgaaatgatggctccagttcccctgggcatcaacaaagcaattttactataccattttagtcatactgtccagaggattgaaggatgaaagaattggagatcatttttctctgtagctgttgaatgcttcattaatgtcatattgaatatttaattgcatccaacttttcacaggagcttctgaagtacagggatgcagcacaaatggctgctgttgaagctatgcaggaagcttctgctgcagagaacttgcttcgatgtttaaggtaattttttcactgacatatcctttgtgatgttgcaactacaaaatctataatcagcaccatttcaaggtattgccaactcctgatatttcaatgatattgaattgtttctcttgagctattccttgacttcttagtctgatactgatactacctaagtactaaccattagtatttatttccaaattgtgttttgtatgcatagccgtatgcatgtgcatcatcgctgtagttattttgagaaattttgttaactttaaggtgaaaattcttcaagtcaactgcttgcgccacactatgctcattaacttgtttccagcctaaatatgtccttatggtgtgcgtaatatgtgcagctgatatgatctgccttggattttcttttttgtacttagttcaaatttgaacccaaagccaaagatttgaatccaagccctccctatccaaacagggccttgaggattttgttgcctgtcctagcatgttgtatgcttacaacaagcaattttatggataagtttcaagtcccacatggcatctaattattaacatggttgataatcgatggctctcttgatgtttatatcacatgggttctaaaataatcgatgaccaatcggcgtcaggtcgaaatacctcagctatagctgtcaagcaagttgcaatgatattaccaaccaccaattagctccctctccttttgatccatacaaaggcttgattatgtctgcacatgcttggaatttagatttcggattgagcttgtgttcctgagtgctctacggacagattgaacaagttcctggagtccatgctagcaatgcatggaacagccagctgttcttgtctgaataaagctaggctgtatagtgtttatcttctcaaacagtctgaactgctgattcctgtatcttgacaagcattgccagacaagaactcctaacaattcagtacttgtcactgcaatgtactatgaaataaagtagtttgcactttctgctcacacactggtgcttgcagtgctctgacagttctgtgcctagtcacaactcacaaatagtagtactatggtaatgtcaaatgtgaccttttaatctgatcaaaatgtgtgttttactgatggtcccatcactgttactgaataatgcatggctgattgtacagcacaaaagttcagatttctgcaacctttttaccatgcactgttgtagaatttgtgtactcctccctctgtttcaggttataagacgttttgacttttggtcaaagtcaaactattttaagtttgtagaaaaaagtagtaacatcttcgacccaagacaaatttataatgaaaatatattcaattattgatttcggattgagtttaaagcgtcgtatgacctgaaacggagggagtagttaggaatggtgcatttgttgccgaaacaacaactaagaaatgtcctgtcactgttgtgttgatctgaatgcttatcaaatgagcttttatctgatcaaaatgtgtgagttttactgatggatcattgttactgaatgctgcatacggttacttctacagcgcagaagttcagatttctgcaacatttttaccttgcttgtgtcgttactcgttacgttcgttgcagtaataacagctaagaacttacctttcactgttgtgttgatctggatgcagctcgtacgcggaggtgagctcgacggcggaggagcagaacccgcagccggcggtggagcaattcctggctctccatgcagccatgtcccgcgccaccgtcgtcaccgactcgctgaccaaggccacggcgacctcgacggcgacttcaccggaccgatcaacacccagtgaagccgcagccgtcgacgaggagtcccttgccgtcgcggtggagcgccggcgccgggcagcgtcctgggtgggcgccgggctcgccaccgacctctccgcgttctccctttacaacctcaagccgccacccgccattgctgcctccccgctggccgtcgtgctcgtcgacgagtcggcgagaccggcggcggcgacgaaggcgtcgccgcccgcgaagtcgcggctgttcccgcccaaggtcaaggggagggtgggacccgtcgctgcggcagtggcggcggcgcctgtccctccgccggagtgggagaggggaggcggcgcggaggacaggggcgagctggcgaggcggctgggggaggaggcgagggggtggttcctggcgttcgtcgagcggttcctcgacgccgacgtggccgccgccgccgcgccgtgggatcgcgaccgcgccgccaggatgctcccgcagctgaagcgcgtcaacgactggctcagcgagatagcgaagcccacggaaccgccgccgccgcaatccgacgccgacggcgaggaggccggcggcggcgcccccgccgttgcgaatggaggcggcaacaccgtgccggaggagacgatagagcggctgcggaagaagatctacgagtacctcctcaccaacgtcgactcggccgcctccgtgctgggcggcgccggcgcggcagcgaacgggaagagggtctgagcgacatgggccgtcagatcttgcacgaatctcgaggccagcatggggaggcttaactggcctcgcaaatggggtgagttgtggcccgctttcgagttctatctagaatttctgcattctctaaaagagcattctaaaatctaaatttgatgcggaaaatgaaaaagagaaggtaatttgtaatgataatgatgtatacagtaatacaattgattgtttcgattgttgaaatgaaaaaagaaaatgaaagagtaaattacactcgtaatacagggacaacaacttagcacgcaacccttgtcaattccttagattgtcttcctttcttcactttcccaactcatctctttcatttttcctacgccttttcaaattactaaacgtgtttttttttaaaaaaattatatacgaaagttgtcttaaaaatcatatcaattctttttttaaaaaatagctaatccttaatttattatgtgttaatgcatacattgttttacgtatggataggagggattcccaactcctttcgtttattagaacaaacttttcaactaataaacagatttgctagaaaacttacgcaagttttttttcccatctacacatgttgcgcgtaagattttagtgatagcttgtgtagtagttataacgtaattactgtcgaaacaagattttggcaataataaaagggggtgactatcaagctaagaaagtggatgggtttagagacaaggaattttatacaggtttaggccttcttattcaagaagtaataccctactcttgtccggggatgattccgccgagtgtattattgattgtatgattgggagaaaaaaaatcgtcccgagaggaacctggacccctccttatataggggaagggatccgtattataaagtacagtccatatcctaacggaacatgagattacagataaaatacaatcgtaaccgactaggatcccgagtattttcttaacatacaagtttagaatctaacccgagtcctcataaagatattctatctatatttggtaccatatatccagctggaatgtaaccgccatgtagatatggggtaaccataatcttcacagtagcccccgagaccttcgcagttgaccaaaatagtcttctcgaaacaaaaaacaataatccgagtgcttcaattcaacttgctccggcttgccgagtgctaaaagactgcgaagggcgaaaataaaacatggtgcatcgagtagatgcacctaattaggtgtagcccccgactatgtgattagttgaaaaactaaacatatagtcaagaaccgggtgactttatatcgaagcatgcatggtactcaataaaatacccagccgactacttctcacttgaatatatcaaggataaaaaatatgaaaagggccgaatgataaacactcaaaaggtccaaaaatagatatatttggtaggaatccgagtaagaaactcttaaaatgatccaccaaatatgataaaggtcatggtaattaagaagttcattagcctaggctataacccttaccataatcaaaataagcatataacatgataggagaatgactactaataaaccagtcatctcaaattaacccaatagcttttgtagcctaaaaaagcttacaaaaatggtataacacctttctgtcgggcaccttttcatgtgcatcataataattccaaagaattattgaatcgcgttaaaaaggattttaacagcatcgggccgcgtcattgtgagcacatattgccaaagcaaaaggcacctaagtccctagggatcacaatgggccacgctgaaaacataattgggctgaagtactgtacaggcccaagcccattagtactcccgataccctaaagacaccgaagtccaaacgtcgtttcgtcttccctgccgagactctcgccattccccactccgtgctacagtacagaaccgcaccgacgaagctagggttcatcaatctgctccaacccaccctcaaaaacttcacgaaatttctccccgcgtccaccgctccgattccccattcctctccagccatatctcggaccaaattaaaccatccagttcacattcatggcggaagaaagagaaagcttcgaaagtcagtgggcgccctccgatgtgacagaagataacctgaaggagatggtggcgcatggcgttctcccagcgaaggagattatcgggtggcgaccggcgttcggcgaagcattcccgacccccgacacacacgaaatcgtggtattcgctcatttcttctatggcggattttctcttccaacctctagattcttccgggggattctgaacttctacgggattagcttgcatcacttgaatccaaactccatagtgcatattgccaattttatccatgcctgcgaagcttttctgggcattaggcctcatttcgccttgttccgccgcatcttcttcctcaagccccagccaaacaaaagcaaaccatgcgttgttgggggagctggtttccaactcagaggaaccttgagccaaaaatatttctccatgcccttcaaaacctcaaacaaaggctggcatgcaaactggttctatgttcagaatcctgagcccgcactccccgagtactgctgtcttcctccggtttaccaggacacatggaactcattgcctatgggagatgaagctgctcaggcaatggaattgatggaacgcatgctaaaactgaaagaacaaggtttgcagggagaacagatcactcagcacttcatcaaaagtcgattagctccaatcaaagagaggtcccgcacaacttttgagtttgatggcaagcatgatccaaatcaggaagatccagattctcttgactttaaggtcatgaaagaaagaatgtacaagatcttctcaaacgctattgttgtcagctattcacatctgctgcccgttgtgccattcaacgcattcaaccctcctccaccggtatgcactcaaacatttcaaccttcctcaaaagtatgcttttaccctctgttaagctaattgaaagtttgaaatatcatgcccaggaatttgctttgatgaaatcggatcctccaattgctcaacgccgatcacctcgccagcagactggtcaggcgagtggaggaccaaaaattcgatctgacgctcgaccaagtgcttccgatccactgttgaaataatactaacagcataactcaaactcgtaggaagccgtctgacatagatccttccgaaaaggaccccgagccgactgacatagaggcaaacctttcaaaagaaaccgggccagctgcagaagatcgtccgagtgacaaacaaccggcaaccgacaatgtagaagccagcaacgagcccccgactgggaaccagtcggccgaaactgaagtcggtgctaaccaggagcccccgactagaaaccagtcggatgcagggtcaagccaaaagattcccgaagttgaagctcaaacgaacagtccgctcgggaaggatgctgacaatgaatcagaaaccagatctcctgtgaaggcaccaaagtccactcgtccccgaccgggaatcatcacaggtagacatgccatctgaaattattttgatccaacagactttatttggctgcttcatcttcgttcatggatacactagggccaataattggtgatgaagaagagatcctccggatacaagcagctgaggattcacaccctccgattctggtcaagtggtgggatgacaacatgcagcctcaagggatcgtgataaataagcaaaaagaggacgaagagttatgcctactgaagaaggcacttggtcaggcaacccgcattgtaaatgtaagccctctggtacctgatctcaaccatcttgtttgccatttaattcatgcgctaattaaactgtcttgcagaggatttatcttaggaacgaagccaaaacggtaaccttagagaggttagtccctcatctcgggaccctcgaagccaccaggaatcgactgcacgaagcgaaacaacttgccaggaagaatgaacatgatctgagggatcggatcgctgatctccaggaatcaaattttgaactgagtggctcatcaaaaggtacgcacaaactctgctcaactgactcatactgttatctttgcaatcttgattaaccgtaatcaatgtagtgcaagctgccaagatatctcagttggaaaagcagattcaaattctggaaaatgacaaggcagaactggcaaaacaaagagacctggctttaaaggaagttgaaggtatcaacaatcaatacctcaaaagccattatcctccatatgctgacttattaatgtgaatctgttgatgcagaccgcaagatcaaatctcaagctcaattcgacgtcctggttggcaagatcaaaaaacttgagggagcccgggatgaggttgctaacgctgctgccccaattgttcaaccgatgttcttcaataacaacggcccgagtgcacttgatgcttctgaaattttcgacaagctgagagttgctccggatacatatttcaagaacatcaaagaagctggaagtatgggagcaagtctggcgttggcgatgaccaaatccctttatccaagagttgatattgatgccattgatggctttgcagacgggatgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgctatgcttaatatcttaacttagttcctgatttcttaaaagtttttgtcgaaccttgttgagcctaaaacccgcaaaagttgttaaaaaactttcagtcctcattgactaagccaaagaaatcaaacagggcaatgatacatcaagaattgggggaaattttttaaccccccaatttaagtaagcaaattgaattataaaaatcacactccattattattatagtagccccctgactgaaaacttcaagaaaaaacttgaagttagcagtcaaagaggaaagatacaacgaaatgccaagcgtaaattacgaaggtggcaatattcaagaaaaaaaatttttttggggtttttttgaaaaatttgggaaaaaggaaagggtacccgttctttcgcgcttgagtcgataagaacccggccgagtgacttcagcaattatgaacggtccttcccataagggagataatttatgccgatcctgtgttgtttgaattttccgtagaaccaggtcaccgactaaaaaggctcgcgatcgaacattccgattatgataacggcgcaacgcttgcaaatatcgagtcgactgaattaaagctgcttctcgggcttcttctagtcggttgatgttgtctactcggccctcttcatagccctcctcattgaagttccgaaatcgtagtgattcaaattccacttcactcggcaacattgcttctgcgccataaaccaaaaagaacggcgactggccggtagcccgactaggagtagtgcgtaaagaccaaagtacggacggcagctgatctacccacttgccagcataggggcgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaacgctccgccaatgaattgagtgccattatcagtgatgatccgattgggtaccccaaaccgatgcacaatgttgatgaaaaaatctctagctttatctgctgtgatcgtaatgaccggtttagcctcaatccacttggagaatttgtcgatagtcacaaagagatgcgtgtaaccgccgactgcccttttaaatgggccgaccatgtcaagcccccagaccgcaaacggccaggacaacgggatggtttgcaattcttgggctggcaaatgagtttgtctggcaaaaaattgacaaccttcgcatgtccacacaatcttgtccgcatcggacacagctgtaggccagaaaaaaccttgccggtaagctttgccgacaatggtccgtgcagcagcatgattaccacaaataccagaatgtatatccttcaacaattgtctcccttcctccaaagatacacagcgctgcagtattcctgatggacttttcttgtacagtttagcttcatgaataatgtaaagtctgctgcgcctggaaatccgctcggcttcatttttgtcttgagggagttcttgtttggtcaaaaattttatgaggggttctctccagtcggcttcaatcatgcttacgccttgagtatccatggcttcaattgcttcttttctgggcacggttggttcataaagatgctcaacgaacacatcagaaggggctgcttcccgttttgaactaaaattggccaatctatcggctgccttattgttatgtcgaaggacatgggtgagctcgaatccatcgaatttatcttccaacttgcgtacctcttgtcggtaagcggtcatattatcatctagacatgaccactctttcatgacttgattaacaaccaactgagagtctccacggacgattaatcggcgaatgcctaaagagattgcaatccttaatccatggagtagcgcctcgtattccgccacgttatgggacgcagaaaagtgtatccacaatacgtagctcaatctttctccagtcggggaaatcaagacgaccccagctccagtgcctgtgagcctctttgacccatcaaaatgcatagtccaatattccatcttttcctctggcatgtcttcttggcactcggtccactcggcaatgaaatcagctaaagcttgtgacttgatcgaagttcgtggcttgaacgatatgtccaaatacatcaactctaaggcccacttcgcgatccgtccatttgcttcgcgattgtgaagtatatccccgagtggaaacgatgtgactaccgtgaccgggtgactttgaaagtagtgagataatttcctgacggtaattagggcaccatatagtaacttttgaacctgaggatatcttgtcttggagtcggctaaaacctcgctaacgaaataaattggacgttagactttttgaacatggccttcctcttcacgctcgacaaccaggaccgcactcataacctgggaggtcgccgacacatataatagtagcggctcttgcggatgtggcgaggccaaaactggtggagtggtgaggagtttcttgaagtcttcaaaggctttctgtgcttcgggcccccactggaaattgtcagtcttcttcagcagcttgaagaaaggcatcccccgctcgccgagtcgtgaaacgaaccggctgagcgccgccatgcaaccagtcagcttttggacgtctttttgggagcttggcggtttcatgttgaggatggcgttgattttctccgggttggcatgtatgcctctttgagataccataaatccgagcaatttccccgacggtactccgaagatgcacttttccgggttcagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggtcgctcctacattcttcaatccaaagggcatggtgatgtagcagtaggccccaaagggcgtaataaacgaggtcttcaagcagtcggattcttttagttggatctgatgatatcccgagtaacagtccaggaagctaagtaactcgcagccggccgttgagtcaaccacctggtcaatgcgaggtaacccaaaagggtctttgggacaagatttgttgaggtcggtataatcgacacacatgcgccattgccccgtctttttccgaactaggactgggttagccagccagtcgggatgaaggacttccttaatgaagcctgctgctaacagcttggttaattcctccttgatcgcatccttcctgtcctgttcaaaacggcggagtcgttgcttgatgggtttggcgtcttccttaacatgtaaagagtgctcaatcacctctctagggataccaggcatatcggatggtttccacgcaaaaatatctttattattctgaagaaaggtgatgagcgcgctttcctatttacaatctaactcagcgcctattacatcagtcttatcaggatcggagggatctaggggaatctttttcgtcttggcatcactttcttcggtcttcgtcagcttggttgcaggcacttctcgctcgcttgccgtggtcgcagccagtcggatctcttcgcgggcgagagcagtctcgtgggtttgggccatctcgcaactttctttgtcgcatgtgacggcctgcttgatgtcgctccgtagtgatatgactcctcgaggaccaggcatcttcatcatcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaactggaagagtgatctggccgagtggtgtagctgacaatcctgggataacaccgtggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtactagggggtatcgccccgggtggaccactcggtcgggatgatccgagcggtcgaacttaattgctatctctgaccaccgaagatattggggcatgttaggctgaaccgcatttatctcccgttctgtcagcttttgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctctgcgaactgtttgtagacgaagcaatctttggccacgtggttggagttgggatgatgcggacattgggagttcattatcttgtcgaaggtgttgacgcggggacgttgtcgggaagatagagaggtggtcgccacaggttcttcgggcttacgcttgcgatccttgtggttgttacttccactccctcctacagtcggcgtgtccttctttggcttccaagtggtgcccgactgtttggacgtggtgatagcatcttcggctttggcatactcgttggctttttcgaacatctgcttaaccgtcctgggaggtttacgtccgaacttgccgactaggtcctcgtggcgaatgcctttagtgaaggcggtgatgatgacgtcgtcggtgatgtcggagatcttgttgcgttgttcggagaagcgtcggatgtaatctcgaagggattctccagacttctgaacgacgttgtagagatcaaactgtgtgccgaggcgttcgaaggtgccctagaagttagcgatgaagtaatcacgaagttccgcccatgatccgatcgtgccacggggtagtccgtggagccaggatcgggcggagtccgctagggccacaggtagatagtttgctcattgttatgtcgaaggacattttaattatactatcattatatctgaaagttttttttactaaaaatacttgcggcagatttttaagatattctcactaataaaattgtgccatccctctcactacacacagagcgggcaacgagacgcacatgcagttgctagctatcaacggtaccgagatagagtattattaggtactactccacagagtgttagtttagtgatattatacctcctaaatcccgattagcactagaaatacctcgacctcataataccttttgaagaaccgaaaatttcccttttcctactgtttctgattttacactaagcacattatgttcattcggcaacccttgtcggttccttagaacaactacatgacagaactaataaaattttgttttttttttaaactaggaagcagagctcccccaatttcattaagaaaaatgagagctacaaaagtctttacatgctacttaaagcagtctaataataaaattttgtactcaacacataacatacttgcccacaatctacagccgaaaagaattaatggtccctctagatcgatatactgtatggtaaatcatttgcttcatcatccttcttgtaaaagatgtggaaaaccagaagaggatgtatatatatatatattcctatgcatgctttcactcatcatcaagacctggtatgtacaataagttgacgtcgaacataactgggctgcttggagccactcttggccttccaggagctgaagtaaggcccttcggaaatgctagctgttcagatcaagaaaaacacgaaaaatcaaattatcaccctcctttcaaatctctgtgctaagaggggaaaaatgatgccatagcaatggctgcaattgtctggccccaaatttaccacatctttcattttctcttgcataatatttgttgacattggggagtttaggctacttaccgggccaggtatgtataatcgccgtagtcctccaaccttcattgacaatatcccttcatcaagtccctttatcacctaatgtttaccaccacaaatggatgaaagaaaattgaattgtttttaaagcattttagttagaaggcgcataatgtgttttccagagggtagtttggttactgatagtgtaccaaacattttcttgcaaaattacatatggtgaattcatgttttattaataatacgaactatacatttttcacgtagcattatgtatgttacattagtgtatttcatgtgcaatttacacattagacataccaagagttttaatttgaaaaccaaaaaccagacgttaaccgacatgttccaaaaacttgttagcagcttgttaccctcaattactagtttaataaaatattttggattcaatctttttccagataaaagtggtaagcggtcggttaccctttctcaaagggaccagttggtattttgttctgaaactaatattcaaaacctttgttcgtactctttaacatttaagttttaaatattaattcaaattgttctgggctggtataccgatagccagtcgatggcttaggatcggtaagtaccagtaaccagccgagattttgattcattgtacaaacacgatcaaatatataaactgtatatgactgtaaattgtatatttacagtcatctacagttcatatatttgatcagtttgtaattttattactcacatttcagtggtaatatttcagaacacaggctaccaagtaccaacaggaatatgtagggaaaaaaaataaatacctgtcctgaaccaacacggaatatgtagggctgccccttttccagagaactgtatacaacacagacacacaagaaaatttcagcttgcagcttgcaagtgtacttgaacagcatcaacttaatctcgcctatataaaagatggttagtttggcatcaaaagctcagttcgcacctgtcaaatatctgtccattcggtaccatggcaacataatttgcagcaacctaaatggtaatcaaagagagaaaaaaagaaacagattaagaacatgatcatgaacatctgcactgtgagaaatcaagtgagcacctggaagccaatgggtggacttgggccttcacccactttgatatccttgtactgaagaccagactctgtagtcaccatgggcaccttgggaatgcatcatgatgagttagttgctgagattagcattgattagatgattaacatttactaatctcatcgctaaacatgatcatgtatgtaatcatgcatagctcaagcagggttgaaaacttgaaatgttcctaaccagaaaacagatcgatcaccctggcaagaaagaaatttcaggtaaattttttttaaaaaaaatcgatcagagtaagtacattttcgaggtccttctcgcaggcggcgtcgcagagcttgggcttctcctcgggaggcagcccggcggcgagggcatcatcgaacgcggccaggccgagcgccagcgccgacgatacccccacggcgactccaagaacgctcctcctccgggaccgggtggcgctggtacagaccacgccgccgtcatccactccgcgctgctgcggcggcggcgccgttcccgcctcaccggcggcctcgcacctgcagcagcagcagaagcatcgccgcgccgctgaactcagcgccctgctgcccctgaacgccctgccgtcgggaagccacggtttggaggaagggagcgggcggcgggccgaggggaggaggagcggcgaggcggtggcggtggaggaggacgaagcggttgcagccatggtggaagaagaaggaagaggagaggaagacgaaggaattaagcaggtacggatcaggagacgtgggagaggaggagaatggatagcgcaacgacgcatcgcatcgcatactgggctttgcgcgcggtccgcctccaccactcgctgcgtcgggtcaaactgaaatctttcgggtgctgctggtccacgtgtcactcacagagggtttcgatctccatctcgcctgcaactgcaaaccacctcgctggctgcctcggcagcatttttcaccgtagtccacgaggtgtaaaataagaacgtattatgggatcccccatctctatcataagacagtcacaaaattaatttggagagaaacttcagctcgatcaggtcaagcggagattgtggtgcgtcatgctacctgtgaataatctcaagttctgaactctaaacaagtggttatcacaagttagaagaaatacagtaagaattctgaagattaatttgcctgtattcattggtgtcacggtgactctggtattggaacatttctttgcagtaggtagtagcaccatgccaagccatcagattatttttcataagagtgaaatgcacatacagtccttaaactggtacggatatatcatttaggtccctaaactctcaaaatgaatttttggatcccaaacttgtaatgagtgtcatataagtccaaacgggctccaactcgctccgtgagatgacgtggcatgccacggtaacgcttacgtgccagtggatccacatgtcagtcatataaaaaaataaataagagaggagagagagagagagaagaaaatgatgtttttaattttgaaaaaaacaaatgaaaaaagagaggagaaaaaaatatgtcatgtggttgacatatggggtccactgacacgtaggcgtcaccatgtcatgccacgtcagcacacggagcgggttggaacacttttggatctatatgacatccgagacaagttgagggataaaaaattcattttgagagttcagggacctagttaacacacccacgtaagtttaaagactgccgtgcactttactcttttcataattatactttcgataataacatgtgtaaactgtcagacagaaaacacatgatcagagagtaaaaacacaactgcatacattgcaaatttgcgattatgcagctcaatcgctggttcgtaatccctactaccaccgtagggtttattcttctgacataaaacataaaaacatggccagattgcagggcttggccgaattattgtacaaacatcatcatcctggtagtaatatatatagttgatgcgatcaaacaagctattcgagtcaccagacgttctaataaatactccctaaatatttgacaccgttgattttttttaaacatgtttgaccgtttgtcttattaaaaacttttgtgaaatatataaaactatatgtatacataaaagtatatttaacaaagaatcaaatgataggaaaagaattaataattacttaaattttttaaataagatgaacggtcaaacatatttaaaaaagtcaacgacgtcaaatattcaaggagggagggagtagtagtgtaaggtttttccaagtgatagaaagtgatgatgggactcctgacagcgtggtgccaatgatactctgctgatattgagcttcctctcacattatctaattaaactgagcttcctctcaagtacagcaaccaaccagttgcatatgttgtcagtgaactgaaaataggctctcctggaagctgcactgaatatgaaggtggttgaaacggtgcagaatccaaacgcaaatcccagcagagtaaacatgtatgtcagcgtgtcaaaaatctcatgatgtttgtgtttgtcgctgtccttgtggcagcttcttgtaagtggagccccacagagatcttcatttcccaaaaaagagtctccttcaaaagtcataagttggtttccatatggtatctttcctgagaggtggttgtaggatagattcaggaagctcaaaaataacagtgacttcatgctctgaggaattgggcctgatagatcattccatgagagatcaagtgattctaaccaggccagatttccgattgtttcaggaatacttccctcaatgtgattccttgatagatttaaggacgctagtctgtaaagatttcctatttcactgggtatctccccggttaaatggttctctgaaagatcaatactggtaaggaggaatgatatcacgaaagtaagtctgtaacctctgaaggttgcctgtaaagtatctttgtacacagaaaagtaagcgcccccaacgccataaaccatgaattggaaaaaaggcgatgagtcccattctagatttcgtgagagaaaggacgttagttttcccagagaacgtggtatagagccagagagtttgttgttactaagatccagatattgaagggcatgaagttgggataattcttcaggtatttcaccggaaaactgatttgaccctaaaatcagaagtagtagagtttgtaggccattgcctatccatgttggtatgtatcctgacaaattattctctccaacgtcaaggactaacaatcttttacatgactgcaatgaggtgggcaacaatccagataagctgttcttgctgagatgcaatgctgtaagggaacttagagagcccatagtggatggtatttcaccccaaaaattattgctggagaagtctatgacatacatactggaattcatacgccaacaatttggaagttcccctgaaagattgttattggatatgtcaatcagttccattgatattatgtcacatagatatgccgggattactccactgagagaattatgagagagcgacaggtattgcaattctttgtctccaaagctttgtggtaatgatccagacaagttgttgtgggatagatccagcactcgaacactatttggcatatcaggaatgtatccctcaagttgattatgcctaatgttcagagttatcagcatttttgatcgcaccaaacttgcaggcaactcaccagttatgttgttcatcgagacatttaagctagccattggcgaagagaagttccagatccaatctggcaatgcacccctgatgcctgcactgccaagatcaatcatcttgattctagtttgtgattgcagccaggttggaaactgtggtccaaccaggcaaccatgcagtcctagctttgtgagctgaaagggtggaaaccagctatgcttgactacaaccttgaaagaatttgatgctaaaactaaagcatccaatcttgataaattggtaaagtggagttctgataattcaccaataagtttgttgaaggaaatatccaagtatgtcaagttcgatagcctgctaatgctagttggtaatactccagataatgaattctcactgagatcaagaacttctagacttgccatgtgctcgcaccaaccagatagctgtccagttaatttgttatcagcaaggttaaggatctgcaacttcttcatgcagggaaacatgctccttgctgcttctgagagatttcctgacaaaatgtttctagaaagatctatgtgaactaagttgcataatctgctcattgaacgtggtattgctccattcagcttgttgttccctagtccaataaactgtagtgctgctagtttccctagctcatcaggaatcctgcctgaaagttcacaactagacaggtccaaatctgaaagggaagatagattccaaatccaatctggtaaggaagaattcagttcattattcttgagatcaattactttaagggcagtgaagttgatctgagaaacagaattaaggtccgtagctggaaggcttgcatcattcaagcgaagcacttccagcaaatgaagcatattcacagcctgcagccaatccacagaagcagcaaggtacaaccaactaaggtcgagatacctcagggaagttagcttcgaaacccactggaaatcgtccgcagtgatcacatgagaaccagatgagctcagatcaagaaagctgagccttgacaagttgccaagctgaggagggacagtcccaccaaaaccagcatgcgagagatcaagatacctcaacatcttgaaacagccgatgaattctgggatgggcaccccaccgaagtcactttgactcaggttgaggtacaccaatcttgtcagaccagacaacgatggattgatctgaccattgagagtgtactcgccgaggtccagcttgatgacatggccagtcttcttgctgcagctgacaccactccagctgcaacagttctcgccatgccatgagtgtagccgcccatcaggatccttgatactggtgttgaaggcaaccaaagcatccctctctgtggagatgcacgcagctatctccctgaaattgatggttaagcacaacagagccaaagccataagcaatccattcatagtattttccatgttggtggataaaactgtcagtactcagtagctggtggtagaatagagaagataggtcgagttgcacctaattggataaatggaagtgctgagatgaagacttgaccagttgacctgatgacctctggtcttcgctgctagtctagtctttctgcatttttagtcatctgaaaaacttgctttcctgtgtattaattgcattttgcagtaactggcctttttggcttgacggccagggaggaactgcaattaccgatcgagaaaagggtgtacacaagggatatgtttgctgagattaaagcagtaccacctgtacactctgggaggttacaaacttacaattactgcactctaatattttttttgattgaaaatactatcaggccttgcctatatattaaaggacaaagagcattctttactgcactcaatattataattcactcaagaaaaaccaatgttgtggtcagcctacccaggttcaattcaagtcgtaggattggctaggatgatgtagagctcatgtttagttttcagataaaaaaggcaagttcttactcaatttgcttttatacttggattcacaaattgatctcctcttcccgggaaaatctacatcttgctcattcatatttattggcctgaaatttctggtagatctaagcacggcattctcagcctgactaacatctcagaaaatgcaaatgttactgaaacataaaccaaccccctcctgctaagagcctaaggcactagggtagtgaagtgaactaaactacgaaaggattggcactaacgaatttatagcgggatgtacagtaatccggaaacagtaaatcgtagagaggaagaagcctgtgcggccataaacctgaaacccgaactcccaaacccctagttgcgtacctcgcagcggagaccactccacgctccgccgccggagacgtcagccggcaagccgccacggcgaacaggcagcacggtgttggagaccagtttgccgccgtatccgctccacgggtagctcggcgaggatgagggcagagcctactgtcggaagcggcgcttcggttgagggatcttcaggtgagggtacctgcggcggtgaccggtggagctacgcctggagcggcggccgccggcggcacatgctcgccctattctattcgagaatttttttcggttttagattttttttaaaaaaatatttacagaaataatctatcggctaaaaaaattacaaaaatagaccctgccgcccacctctggggcggcaagctgacgtggcaaacgggggaggaacgggcggtgacggagggagggtttttttgcaggaaaacccttgccgccctctggtggggcggcaaggggcccgaatacaaaaaagccagtcggggctggctattttgcaggcggccccttgccgccctctggccggacggcaggcctcgctgcctataaaaggcctgctgcccagcccccagccctcattcttctctccttaattccagtgaaaaaaaaagaagagaggggaggagaagagaagaaggggcgaagccctgccggattcagacgccgatttcaggtaatattcatagatcctatatgtgactattgagttaaatagtgtgtgttctttaaaaatttgtttgaataaatgcattatttttttgggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccagctgagaggagtgtaccttctataaaaggatggttaatgaggggcttgagagttgatccacagacaagtgacataacaatcaatgttatagtaagtcggacaactaagggtttttattgggaactaatgccagttcaaaactctcgagtgtggagatggtatttggaaaatgcattgcaacgcaagtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgatgttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacatcaggatacacctcagttgttggacccggcgatagatcaccgacaccagtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgctgtgcggtgaggtagcccctaccctacaggacgtatcgtacttgttggggctaccgctcgcgggagacgctgttgggccagggaccacggctatggactggaaggatgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgactgcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgctgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcaaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcttgagtttgttatggagttcgaccgccttctgccgactgacgtcgtgtgggagccctacagtgccgcggctacccaggctcgtgcgctgttgggtctgtccacactctgcaccagggaccaggcgtactggatgactacggttccgatggtcttcgacatctgcgttgagcttcacgcccctttccgcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccaagttgcgagcactagagacctctatgccaggcaccgcgaccaggacttcgctcgtgctgtgagtaccctgcatcgcaccattcctttatgttttcatgtctttctcttcgtcaaattttacgaatatttacgtacaaattaaccatgcaggtcgacgacatcaaccgggtcgtcgttgatggttcaacgacgatccaacgtttaggcgcggggattccggtacccgtagaggagcacctgacgacgtacacgcggatggtggagtcgatgcgctcgcttctccgagtgctcacctgtcgtgccgacgacgttgctcgggcagacgcagctgtatagcggccacccgtacagactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtcacaggcagccggcacgtcgagtcagggtccaccactggaccatgttgggacctcatcggaccgcttgctgccttccaccgtgctcttcgacatcactgacttcgacttcgcttcaggctcgtcagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcagcgcggggcagggccagtagagcagtcttctctttgtttacttgcttcactttccagtactgtatgcttgtgtaatgactacgttgttgttatatgtgcacgatacctttcggtgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcaaggaaggcgcttttttaggtgccctaactatgaccgtgaggtattttattatctgcatatgcttattcattctgtatgggcaatcgctttattcttcgtaacactactctattcggcagacccgcactacggcttgtgcatacatcgagtggatcgatacaaaaaatcccgttctcgacctaaccacttgtttacaagaaggtcgctggtatttcgcatccgaaagtaatgagcaatacttacagagaaaagcggcttatgaacgacaatgtcgtgaacaacagagcgactggcgggtgctaactacggcactccctccatgggaagcttgtccaagatgcaggtgtggtgatcgttgtcaggtttttcgttccataaatcctacaacattgggttgaaggttctttgtttgtccaaatattcttgacgacgatttcatggtaagaatattttgattacatgaatccttattttctcacaacatttactaactttgcttgctttacatctattctttcctcctaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtatgggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtccatataatgtttatacgacccagactgtgataggcctatataaattatccgagtactaatacgtcgaataaggtacaaaataatacctcacttaacatatgaaattacgcaacaaccaacttcaatacatttttataacaatattaacaagttttaccaataaatacttctttatttattattaacataacatagaaaaatcttttggccgtacttttttcatctggggacccagatgaaaaagtacggccgcaagctctttatgggcggccaaaattgcaattagccccttgccgccctctgtatgggcggcaagggcctaatcgcaattttggccgacggcgcggtcgacccaccgtctgccacgtcagcttgccgcccaccattagggcggcaggggctatttctgcaattttttttggtcgatagattatttctgtaaatatttaaaaaaaatctaaaaacgaaaaaaattctactattcgatattgggcttcccgttcatgggccttcaagttaagcagtttctacttggaaaaagtatactttgactccctcaactatcgcccgagtatgattcatatcctccaaccacaaaccgggtatataaccggtgcaaacaatgtccctcggtggttttggaggtggttttggctgacgtggcgcctacgtggtggtccgtctccctgtgtgtcgtccccaccgccaccgccaccgccgccgctcccaagagctataagggagagagagaagggagaaagagggggatgaaaaaggaaagagagggaggatgacatgtgggtcccacaatactttttttgtgtgtgtgaatgacataggggtcccacatatttttttatttttgttttttctaatgccacgtaagcatcacataggacaaagactcggtcaaaaccgccatgtaggcgccacgtcagccaaaaccaccgagggacattgtttgcaccagttttgatagatagaggagttgatatacccggttttgtggttggaggacatgaatcataatcggacgatagttgagggagtcaaagtatactttttcctttctacttctgggctgcaacttcatatgggccgtccaagcatacaggcttcagtttgttcattcacggattggagaaagtatacattgagtccctcaattatgatctgagcatgattcatgacctctaaccacgaaaccgggtatatcgacttctctaactatcaaaaccggtgcaaactttgtccctcggtggttttggaagcggttttggcctatgtggctttgttgacctggtcttcgtcatacgtggcatcgacgtgacgcttacatggcattagaataaaaaaataacaaaaaaaatgtggggtccatttgtcattcacacagaaaacaaattgggggacccactcacatgtggaccccacttgtcatcctccctgcatccccggtcattcctctctctctccatcccatcttcctcgttcctctcccccctctgtatgtccttatcgctgcgtcaccccgcaacaatgatagccccaacgtcgacaaccatggttatggctaaggcagctgcgtcagagaccaagggagacagagaaggacagccgccgaggccagagcagcaaggagggtgttgatgcgaaaaacacacactggcctggaagatctgcttaactcctgtgcaggtctaaaatcttgcttttaggttcgtgagcgtgccagttgatttgatcctgcaaccaacaagaataaaagacaagaaaaacgagattaaatccataaatgatagccgatcggctaggagccgatgacatatcgtccatcattgagccgatgttattggtgatagatcggcaatgaagaatgaagcaatataaaactaaatctactcgatcggctgtagatattaacgatatataatccttctctcaatgcatattttgattaagtgattgggatagatcgagcatcatgtcgagacagtataaatcacatagatccaaagatacaataagatgacgattatatgaacgtttataacatagctgatcaaatagatctagcatgtatcggctaatactccgataccactctatattaagatattaaaacagacgaacatattaagcaaaggcctaatatactctaatgcaataagatcttgatataaagggtatatttagcataacaatcaagcatataagatatgaaatagctaaatcaggtaagatcggctgaaaccccgacgatatctctttcagttatcataaaacatgctagatattatagttataaatattacttaatagatcgaactcaaccgatgcagcattaagcataaaaataaatacaagatctaggcaaggtgatgaaaacctctaagagatggtagatatgcgatacaatctagattaataacaagatttaactttatcggctgctctctagcagtaaaaaccagccgattgtgagttaaataacacaatcaacaaagattatgaagcatatatgataactcgatgaattaaataaacaagattagagtatcataaagatggaagcactaatcccgagaatgtaaaccgccatgacaagtttacctctagttgaagatcggaatcgatgcagctcaactcgaaagtaagaactcgtcgaaacaaacgaaagtgaaaaagggtggcgatgcgtcgagagtgttattgaaccgttatttctagatcacacgggttcgggtcatatttatacccgagatacatgataggtccttgccggacacaactcttatatctaacaaactctaagatacacataagtctttacggtagacttttacctaaacatatctctaaggaaattacataaaatataaaagatacaattgcctatctgagagcttatctccatcgtggcaatccttgtgaagcacattgaccgattccagaaacagttttataaccatctcaaaagaatcggctgcatcggctgtatcggccgtattggctgtcccctgtccgacccatctcagccgatgcagactccagccaatgccttcgcagccgatgcacactctgttcttcgaacgcaatcctttgctaaatccactttgattccagtaccaaacctgatttatatcttaccaaatttggtcgttaacagagggacggttgggcgcggagcgaggggagtgtcggtgaggcgatggcgaccaagggacagaggtcgatggggttgctgacggtgagggaggcgacgatgggcaccaataagaacgccatggggagcttcgtgctacacaacgacatgtgggagctcaggtctggcactaaccccggtgccatgctatggtccatgaagaggaagacggacgaggagaagaagaagagggatttggggtggtgctggcgcggatgaagaaagggggatttagggtggcgttggtgcgagtggtggcggaggacgaggaggcaacgcttcaactagcggcggcggtggcgacaaagtagacggctgcatgcttcctccttcaatttctccgtcgctcgatgttgtgaccgacgatcctccgctgccttcgcccccacgcccgtctccgccgccgacgctccggcccttgcccgcctgctgcccgtcgccgctccaacgcccgttccccacgaacaaccgaagggtaagagataaggggaagagagagtaaggaggaacaaggaaagggaggatgtcctgtgggtcccacaatatattttgtgaatgacaaatgggtcccacatatttttttgttattgtttattctaatgccatataagcgccacgtcaacgccacgtgggatgaaggccaggtcaataaagccacataggcgccacgtagaccaaaaccacatagagataaagtttgcaccggttttgatagttggatgagtcaatatactcggttttatggttggaggtcataaatcatacttggatcataattgagggagtcaaagtatactttttcctcatagattcaccaggcgaagtcatgggccagatcacagataagtctaaatcgaatgaatcacttaagagtgagataatttcattaaatatagtaggataaaaactgtacattgtgaaaatacaaaacaaaaaggagatgtaagatataatttgtgccaggcgtttcgctcctgctagagcccaagtcttggctcttccttgattttagcttcgagggaaattgttgagagcccttttatggtggaagactgtgttcggacctccaggttcccaactcctctcactcgtttttcgcgcgcacgcttttcaaactactaaacggtgcgtttttttaaaaaaaatgtttctatataaaagttgcttaaaaaatcaaattaatccatttttgaaaaaataaatagctaatacttaagtaatcacgcgctaatggaccgctctgtttttcgtgcgctgagttaccaacttcctctagcgaacacatcggaaggagcaaggttctaaactcctctcctaggttcctcatggtgggtttccagctatatccaccaaccgtggattgatgtcggttggtcccaattggtcgggttgatgtgcactctatactcctttaaaagcctcaagttatagtggtaagtcaccttgatattgcttttataaattgttccctaatattttttaatattatgaaatagtacaacatttagtttgaacaagtgaataacagatactaatcaaataaacaaccaagtgatactaagatatttgattaaaaattataaaatatatttgataaaaaatattttgttatggtatattataatattttttctcttttgcccatggtaaagcaagcgtatagtttaacatgaattatgcaatcaacttttttttttgccaagattaatgttcgttcaaattacttattttagttcatttttttgcccggattaatcaactcgatttctgtccaagttcgtctctattgacccatggtgatcatcgtggagatcagagttcatgctgggatttgttagtcagtgacacaaaaaaattcttcagtttgttagtcagtgacacaaaaattcttcagtttcccactctactgagcaagtgtagacgcatgcagagagtttttcagcctgtgctgcttcccggaaccccagcaaccatgaatttcaaagtccaatccacggccaaggacagcagcctgtcgccattcccattcggatatacggaacccacagaattcaacaacgaactcctacttcattgaccataacagaatgaagaatatattactcgccttttgacctgtccaacacagttgatgtcatgtgctaacagtgtgctagttcgttcgtttctttcaaaaaggaagctcacttgaaccttgctggtacagattacagaatgattagcagataaccacagtacggcaaacatgaggtattttttagtctgatacaatctttcgtagaaccgattcagacatgctctgagtttgatattttttgtattatctcttgcatgacaaaaacattgataaatgtccaagtgattacacaatcacatggaattttttttaaagaaaaacaagaattcagcatgcgttttccaagtccaatatcttgacttcccacaggtgacaggtttgctcccaaatctgcactgggtcaatgttttctccccacaagtttgctctttccaaatccatggctccacacaatctctccaccaactcatttcgatatttttctactgaacacatgcgtcaactgctccagccaacacgcaatcaaaatgcttacaaatcaaaccgcctctcgaactatatatagagcagagcaccaaccaaaagaccaaagtgtttcagagaaaatttcagacttcagtttggtgttaagctctctttgtctcggcctctgaatctctctgaactttctgatgtgttcgtggaggagacgagttcttgccgtgttcgtcgtcgtcatcgtggtgatcatggcggtcgccgcttcccgtgctgacgcggcgaggccggcgccggaggaggcggaggagcggctggtggactgcggcgaggggggatacgagtcgatggtgtacccggcgatggtggagaaggccaaggagacggtggagctgctgctggcgaggttgccggccggaccgagccccaagggacccggtcactgaagatcatagtgattacatgttctttttttttttcacttttgttcatagtttgatttctcaaaacagagaaacaaaagatattcttttttacctgtatatgatatcagtaggaatactggatgtaattagacagtgaatttactgattgctacgaaggttaggattctttgatatggctgctgtcattgtagtcatgtgttgtgtgttcttgcccattcgggagaatcggaatcaccaacgaaaactttagctctgtttcatgcctcgaacatatcgaaatatcgagggagtgaaagtctagaattaaatcattcaattggggctagaggtttgaacaatgatcaaaagaggggaaaaaaaggaagacaggtgacaaaaaaaaatttaaaaaatgcccccacgcaggatcgaactacggaccttcagtttacaagactgacgctctaccactgagctataagggcgcttcttgttgaatgattgtgtatttctaatttatacttattttatatttgtgtcgacaagatgcacaatttgttgaatagaatctctccgtagcttgaatgcataaaggttttcttctaaaagataaaatgaattgcatagatgtacagtcaggtatgatcatgtggcttttctgctgcattttttcttgaaacttcgtttatgggtacggatctaatcttcgcatatgcggtagatgagcaacgcggttatgagtttgcttatccaatggtgttttgattatctctctctccagatcaatatccaaacgacttaacctgacacggactcggagtcggactccgagtctgatttccacacgagttcgtgccctgataaattcagattctggcgctgatgagacctcaagcaattcggaagctagcgcatcgtcgccatcgatcagagggcattgccgccatagccaccttcgcttcttcgtcaccggcggccatggcgtccctgtacgctccgcggctgacgaggtggcgcgtcgcgacgtccggcggcggcgtcgtgcgcgactgcgtggagtacgacgggaagccgctcttcttccggcgcgaggactgccgccgcctcgtccccgacgacgaggaggacgcgcgcgagtgcctggagatcgccggcgaggtgttcccgctgatggaggacaggatggtgccggcggcggtccacggcggcggcggcgtccgcgaggcggtgcggtgcgtggagtacgtcgacgacgacgacggggccgtgctgctgctcacggtgacggcgacggaggggaaggagaaggaggtggcggtggtcgacggcggcgaggtgcgggtggtcgacggcggcggcttctacgaccccgactccggcacggtggagcacgtggtggacgtggagggcgcacgtgaggcgtacgtgctgctcgtctccgttcgcgaggagctcaaccgcatcgtccgcgtcaagaggctcaactgatcattattctactaaatccctaggaaatttgatttgtatttgatagattcttattgtttgtggggaagtttgtaacaagttttgtgcatcgaaaccctctgtcactctgggttctgatttgaagaatgatggttctaattaacttcgaatcatactgaaatcgtcacagttctagttagtacataccatgctaaaaggacatgtagtctagtggttgcagtgtcctgagtagcacccaagattctaagttcaaatatgcataggagcgaatttcagattgggttatttgagaactagttttctcttcgatagactaagtttatattaaaaaaaggctaaaaaagctacatatatccggttagatatagacgccgggtaaaaataccttctctaaaaaaatgctgctgttacatgcttgttttaccatagagacatgaagaaattatgaattcatattatttgatagaaccccacgaattcacagtgcttgtacgacttttatatattacaaataatttaagaatgcatatactcaaaagctttggaattttgttacatgtatccgtaatcaaaagacaccaacttaattactctgccactgtcaatgctcgtcccgcgcgcggcggctcagcggcttccagctcctgcagctggctcgcctgctgcgcgtgccggtagatcgccggcggcggcggcccggtggtgccgccggcgccccacatctcgatgtcgtcgtcggtggtcgtcgggctgtggtggtggtggtggtgcgccgccgctccggcgacgttgtggacgaggcagcgcgccacggcgcagatgagcagcctcgccgcaacgacgacggcgacgacgatgagcaccgccaggaagtagtccagcgccgaccggtgcacgcgctggcattcggcgacgctgatgcaaaccattgctcgcttgcttgctgcttatgctgttgtgcatgcaagaacaagaagtatgtgtgcgagaagttgcagggacagtgagtgaactagtagctgatgatatatttttgggggcgtgatgaaaagctggagaagatttggattcgttgcttgggttggcaagaggatagagagatgtttgaacctgtaccttccttggggcttttgggatctagtcgcatttcagacagcgattgatcaatggcttttcagaatgtctttctgggaatggatcagccacaacttttaaacatttagtacgggagatcgacggagaagctatgattttcttcatcgattaccaacttaattacatgcagttacaacatgtgagttttattcccagtcttcttcatgcaacagaatacagctgaattttgtaaaatccagctatgcgaagccgccattactgtagtttggatgtgaattttcatccctcaaggggacatcctctcgttgcttcgtaatttgcttgtcatctaaatagttataaaaaaataaaaaaaatattaatatagattaatatgaaatatatctctccataaatatacaagaccaaattcaacttccataagttgtaaaaaaaagaacaaattaaactgaaaatagttctcatacattcacagttatatttgttattataacttaacattatttgtgaagtgatatatttcatactaatttatcttgtaaaattttttaaaattttcataactatttaggtgatatacataaaaacattttccatgtagtttgtccaatgtaagaaatttaccatgaagctcaaaaccagtaaacaggtgtagtttgatccaaactccatcaccactgtaacgtacgatcattcgatcaaatggatgattagatgcaggtggagatcgatcagctagcgatctacggactggaggaggaggcgagagcttcacctccggtctcctcctcctcttctccgacctgatgggaagcgacggattcagatgccgcgtcctcctccttcccgtcttgaatccgctgcggaacgacgatccgctgcctcttctccttcctctcaccgcggcaggtggtgatggaggacgccgtgtcctcctcgtcgtcgtcgtcctcgtctccggcggcgtggcgcttaggagggcggttgagggggagggggtagccgggggggaggaagccggagaaggccccggacatgaagtcggccggcgagggtgaagccgccgccgccgcgggcctccgtcctgagcgtgacgcgctcgtagaggtcggccctggcgcgcgccacctcctcggcgtccgtgctctccctcaccaccttggatagcctgcgctccttctcctccgcctcccgccgcgcgaacacgttccggtggtactccatccgctccgtcaaagtttccctcgtcgcccactcgtctatcggcggcggcggcacccagatccaccgtagatactcgcgctgccccatcagcggcacgaacgtccgctccatctcaagattgatccctctctctttcgccttagattattggattggattctgaagatttttctcgcgatcacaagtttgtaataactgacttgctaatctgatgactcgaggctgactcaacgactccgtccgattccgatatacaccaatcctttcaggccgcccgctccagtttttggatcgaaattgtgcttgcagtgacaatattcatattactagcaaacgagatgtgattttcctcgaggaacaatatttttcatacgtacgtatccaccattcatttacacaggcaaaactgcctcgacctacaaaatgttttttttttttttggaaaccgatcgatcgtcctacaaaatgtcaaaacttccaaagaggacgtaccaacagttccaatctacccatctcattccttgggcgttcaaatagtcttctgcaaatgcaaatccagcggtatgtgagggcgccatcgttgaagtttgtcgaatggaagaaagcgtcatggagctcaatgaatcccactaaaacaagctgcacatctgaagcaccacatatgcctttggcaggaaatgtcaagaacttgatccagttcccatcactttgtggtaaacttcgattgggcggtcaaaaccagtaacagcgccctccagtttgtccgtaaccacctctaccgacctgaatccgatctgcaaggaacaatgcatggtgaggcaaaaattctgttgctggggccaagaactgaacatagaattcgtggctgacattagaacataccttgtctagaagtatctcccggaatttatctggatgtattaggatggtattgaagttctctttggcaacctgaaagatgtaacacaaaaaagagtgaggtattgcaactttgcacgataaaaaaaaaactgcggtcatggaagaatcaaatgtttaatgaggactaagatttctgccagtatgttcattctagtaatcttaagattgaaataacagggggttaagaaagcaggtccagtaagagtgaggccccaacatactgacgataaagccaagcaagcagctaaaaccacaaccgcaactgtagcttttacacaagcaaggggctgaaagtaaaataactctagccttcaacaactgacatagaaacacaataagcatttcaaacttcaacgcgatccagaaaataatcaactgggtgtcagagatcagtatggcattggggaaaatgatacctctgaaaccaatctgtttctcctatatgaggtccaaggttgaggctccataataaaaactccaccctgaaaaacaagagaatccagtgggaaaatagtttattattttttttcatcttatcattgacatctactttaccaaagcacaggaaacataaagacagatagataccggtcttagaagtctccagatcttcacaaataaagtaattatgccatcgtcaccccagttcaggtggatccatttggtcacactcaaactgcatgagaataaaagcatataaaaacgcatgtgtcaatatgacatccaatgtgggtaatgatggcaattttcacaaatatgttgcaatataaaaacgacaaagtgactattattaatgacagcagaaaatctatgagatctatattataatttgtaacttaccaaacaattgtatcatactgttctgaacttgtacacatgctgtccacaaaattctcgcgacgaaaagaaacaactttaaaaatatcatgatgactgccattagaaatatccccatttgatatctcaggtgccactttttccggacagctttcagacggtgaatctgatgacttgtgagccttggtgttttctacaaccaccttatccagtcgagacatccttcttaaattccagttggcagtttcgatcaaacctaacaggacaagatcaggatcagtatagcaagaaaatagctttacaaaatttataacaatatgtttgcctaggaaagacatgaaacattagttaacaaacctgaatcaatatcaactccaagaatgctttggcatttaaatttcgcagctgcacaaggttcacaaataaaatgagaaaccatactagtaataaaatttaactaacacagacatacaaagtatcttacagtaacacatatgaatagataaaagaatatatactgcaaatagtttaaattttaaataccgtctctgttaacattgatacagaattcccaattctatttataagaggtacaacaacgtaactgtacaaccatacaattatgaattagatatatcatttttgttcaaatggacaagacagatcatcaaccaaacaaaatagtactaaatattgcacaaagatgatttacctagaccaatcgttaccaaaccctggttgcatccaatatcaagacaatccttgctttcaaaccactctctcttaaatattttaagacgagggtcttcatcaacattacggtcaatctgtagaacattagaagaaaggatgtataagctaatagagagacatcagaagagagaatttatcagatgagaacaagataaggattgcagtatccggcgaaaacaagataaggattgcagtatccggccatcgaatgggatttatattgtactaagagaagtaccacatgcagcgctgcaagtagaatgtgaaataaacccttcccccctccttgtctgaagaaatctacagtacactttggcattggcaaatcttaaggaaacaacaagatctaactaggctccctgatacttcactccttccttcgccaccaggtgtacttatgatatgcagggtatgggggcacttcctcgacctacttatgttatgactaaataatcagtcaaagtaaattagacgattttgctttcctgaaatagtgaaatttgttgttcacttggatacccgacacaatcattctgataaacaacaaaatgctgaactaaggaaacggaatagaaacagaaatttgattatctacattctacatgcccccaataaaagaacctaaactggtctactgcaaaccacaacaaattaaatcagaaatgacaccactgtaactaaggtacattctaagcgagagcttcgactgatatccattcagcgttccaatccaaacccatgaaccatcccaatcccacgagcaccgcgaccaccatcgaggcattccatcgaacagttggtgcgctcatacacacagcaacgatctgcgcgcccgcaagagaagcgacagggggaggggtgggtgttcactcacccggtagccgtagtagttcctgtagttcccgtagacgaatacctccttcctcttccgcttctgcccctgacccccgtcgccgcggccgccgccgcctcctcctcccccacgccagttgctctgtttcctcttcgcctctcctttagcccccttggccgcggacggcgcgtcctccggcgcggtggtggtggccatgctcggagaagagacgcctctctcgccgccgccgccgcggcgcggttcgtgctggagctgaaacgagaggggaacagcgcgggacaaagcggcgagaaggagacgaaaccctcgccgccgacttaagaagaagaagaagttcagagatagcccttccaaaatagaggtccagttaggcccatcaatatttgggcctatcgatgtttgggccgtaacctctcatgcatgtgcaatttgatgattaaaggatttgcacaatgtacattgtataaacagagatatgctttgcattgtttaagatgaaggaagatttagttgtgaattactcgtgttctgattttttttctttggttgattttttttttctccaatccaacgcaagctaaattttttttactcatgctctgcccctcgcgccggcggccggcctgcccgccttcccgagtcccgacggcgccgcgacggcccactgcccctcgcgccggcggccggcctgcccgccttcccgagtctcgacggcgccgcgacggcgcagcggcgctctgcccctcgcgccggcggccggcctgcccgccttcccgagtcccgactcgcgccgtcgcggtcgcaccgcctccggcctccccgacgcgcatcggcgcgcgcgccctgcctcggcgcccgccgcctggccggcatcccgcatccggcggccctccccctccggtgagcactgcgccactgcttctccggcagtccggctctcctctccctcagtccctctactctcccccttgcagtagtcagcaggcagtactacctccttcaataatcaagttctttatatccatgattagccaattggggatatagtaatttgtatagattaccacaaaattgtgcgccacaatgaacctcatatgacttttttgcatggtgtgatggttgttaggagattgaggaatgaagaagtcaagcagtgtatttctttttcagaagcatgaagcaaaaaaagttgatgaaggggcaatttacattgtcatttaggtaaattttaaacttatttattattttctacttgtattgaactatttagagttatatacccgtatcgttttacagattttatatcgaatcatgatgtattgcatttagatttttttcgctaggcctaccctaggttcaaatcctgggtccgccactgcctaaattacccaaggacgcggtaaggaaattattggactcagctattgggcttcttcatgagcctgtaaaacattagtacaagtcgccacagaaatatccgattgttagggagttcggagaagaaaacaccgaaccccaaacgatcacagagcagactgcatgtcatgctttcttctgttcagtcatcacattgatcagtatttctctcttccctaatcactcaatgacgacatgctatgtctgaattcctttttgtggagttcccttctgagttctgaatgtattccctcgttgattgaatcgagtcagattttagtttttttttccttcttctttcagtgccggatagtcttcagtgcaaggaattaattaagagcagacaatagaaaattcagcgagagtgttcaccattagccgaccctcctccaatgcctctccgctgtgcaaacgcctgcaaggatcagtgtgttggatgcctgtactgtatgctgttcgattatcccgtttgcatgttgcgccttcttctggtaggcgaggccatcagctgaatcaaacatcactattggagcaatcaaacatcaccattggaggctggagctatagtttagtttcctgtttgtaaagaaaaagtgaagaatgttcgtgactgccgggggtcggagaataaaactccgaaccccaccggtgaccgagctgattgcatgtcgtgccttcttgtattcttcagaaaagccaaacgaccagctgatcaactatcagatcagactttttgtaattaagtaatttatttctcttgtgaatgtgttctctacgatttattttcgaagagaactctaaagaaatgcagggagttcctttttttcattatagaataacagtcactagtacgtaaccttccatctctaacggcctctaacatgcttagaattagcggactgtcataagaaagtcatctcaatcgggccgaaaaagcgcccgattgagataacgcaggtccgtcacggatgacacatatcatccgtgatggacaccaacttggggcccgattgagatatggaatgttatctcaatcgggtctaaactacggctcgtcactgatatgtgtcattcgtgacgggcctgagttttatttccatctaacatgtttgtgcgatcatatctcaacaactaggtgagagatatgtgaattttatgaacaatattactatcactttgtcggatgaaaaaatgaccaaaataaaagttatagatcttgatgagttatacaactttgttgttaatgactttttcagttgaaatcatttagaatttgaaattgttgtttgaagttgttatatttttaaattcaaattcaaactattcaaaaaatattatatagaaaaatgaccaaaataaaagctgtaaatgttgataagttatacaactctattgttgatgacctttccatttgaaatcatttagtatttgaaaatattgtttgaagttgtcatattttcaaattcaaattcaaactgttcaaaaaatgttatatagaaaaatgaccaaaataaaagttatagatcttgatgagttatacaactttgttgttgacaatatttccatttgaaatcatttactacccgaaaaattatttgaatttcttatattttaaaattcaaattttatatagttcaatcaaacccggatgaagaaatgaccaaaataaaattggtagatctcaatgagttgtacaactttgtttttgtttttgacagctttttcgtatgagttcatttagtatcataaaattcaattcgaaatttatttttgcctagaagtcttatttgtctcctcatcatgttaatacttgctaaatatatattaactcagttttgctggtgaaatatgtgaatggatgtgaaatatatgatcaaaatggatgttatgtgaatgtggttgtgttaaatatatcgatggttgtgtatgtaaatgaatatacaacttcttcttaggaagctgatctccaaagaactctgaggttaagcgagccaagggtggagcaatttcggaatgggtgatcgaccggatgcacacgagtgaggataaagtacgcagaaaagactggcccgcgggcgtggctagcaagctataatttaggcccgttagagatgagagtcatccgtgacgggctatagtgttggcctgttagagatgagagtcatccgtgacgggctatagtgttggcccgattgagatgtgtgtcatccgtgacttaggcctattagagatgagagtcatccgtgacgggctatagtgttggcccgattgagatgtgtgtcatccgtgacggccggagaaattttctcacatcagtaacctttgctcagtgacggggtcctgtctgaaagatatgaggctttaggctcgttagagataactgatcccgttctagtaagttaatccaatttacaaaaggaaaccatgtcttaaaaccttacaaatgttcaattaatttggaagaaatccagcgaaaacctccacggagcaaataatgcaatagtcccaagcttaatttggaagaaatccagcgaaaacctccacggagcaaataacgcaattgtcccaagcggcatacccaccacaactgacgacaaccgacacaagtcaccgttgctaagattaaagccaaagaccaagcagctccaacttcctagggttatcctcaacccccacgatcaacaatgctgacaaaagggatatcagcgattaatcaaagtggaacatgaccttctaaacagagcctcaaataaggacataacgtcgaggacgttgtcattgcctcctggaactctaggactaggttttcatataaaagcaagagagagaattcagcacgacaacgcctccaacgaggaaagcggcacccatagttgttgccatcaccggtacctaccaaaactagggcaaggcttccgtctagtcacttcctatcaatcacaccctcctcaagtgtttcttctatgtggctagaataggaggatttaagcaagaaatggcagtgcaactatgcaagcaggcaacaccatcctacaccaagtaaaaataagggaaaacctagcctatagtgaaagagagaactcattgtcctctacgcatcctttgccgccgcgcacccggatctagccagagccgatcggtgcctctccgtgccctggcaactcatgcttgcaccactcgtgtgatcgtggcgttgctactatgtgcggccttaggccttgcgcccttcaactacctgaacccatgcaatcacgcctgcctaacctccacgctccacaccgactagccacctcgcggttgtgccgtctctctccacatattcatacctccttgttacaggccatcgccccttccgtactacgctgatcgggtcaagaaacaacagatccaaccggagggacattggatctagttgtctttgtgcactagccggccttagcacgagcaccttatcaagtatatgactaatagccaccttttcctcgtccaactcccctgcacaccattttgcctccttggccgcttaagtagtgaccttctccatgagtcacgagagccttatgacgtagtatgatgaaggaggaaaaaaggacgcctcgccactaccattgtccttggctccttgaagccaaatgggctccagctggactgctctagcagtagcgatggggaagaaagaaagatcgaggttgcgacactaggtggtcccatgggagtgacgcacgggcttttatttgtttctatatatttgagttcactataaaacactaaaagattacaccatatatagatttacaaaggacttttgctctaagcgactttagatacctttatttatatagaagaaaacaaagttcttgttgagaagtatgcgagtgatacctgcattttatagttcaaactttgtatatactagttggcaactcggtatgcaaacaagtagtgacgaaggcttttgctttgtatgatacgaaaagggctcctctaacacactactattctctaacacactactattctctaaggtaggtcgctgacatgtgaacccacggctatagaattcacatatcagttactcaaaagttactcaaagttagatgatctatatatgcaggatagctggggtgagatagcagcagcagtagaatacagctgttgtcttcatctcatgcagcttagctatgaagctaggtaacgtacgtagcggcacatattccgattcgcatagcatagcagagtagcaacgcggcacccgaaacacgttttacaccgcgcaaactctcctacaacctgtacccacccggattcctacgcgcctcccataaataattgctacgctctctcccgccgcatgcactaattaaaaagcccacacgcgacgcgacacgcccggcgagccgcgcgagcgcgacacacacagaggaggaggccgcgcgcgcgacgcgagctcgccctctgcgtgcgccgccgcgaggtcgccgccgccgccgccgccgtcgatcggcgcccgatcgatggggggctgctactccgcctacgcctcctcgcgcaagctgcgcggccgcatcagcaagatctccctcgtcatccccgacccggtccccgacgccgaggccgcctcgccgcgcaaggacggcgtcgatggcgacggcgacgacgtgaggggtggtggtggtggctgtgacgatggcggtgacgtcgtcgccatcgcgacgacgacggcggacgagttcgcgcggcggtacgtgctggggaaggagctggggcgcggggagttcggggtgacgcggcggtgcagcgacgcggcgaccggggaggcgctggcgtgcaagacgatccggaagcacaggcgcctggcgccgccgcgggtgaccgcggcgaaggcggcggccgcgcacggggaggacgtgaagagggaggtggccatcatgcggcgcatgtcgtcggcgtcgtcgtcgcgcgggggcggcgccgcgtcgtccgccgccgtggtgcggctccgcgaggcatgcgaggacgccgccgacggctccgtccacctcgtcatggagctctgcgagggcggcgagctgttcgaccgcatcgtggcgcgcggacactactccgagcgcgccgccgccaacatcttccgcaccatcgtcgacgtcgtccaggtaataatcaagaacgaacactacacatcatcttcttcttctcccattgatgcatcaaatcaaacgagtaatcactaattaatcaccaacaatctgtgatcgatcggtcgatggatgcagctgtgccactcgaacggggtgatacaccgcgatctgaagccggagaacttcctgttcgcgaacaaatcggaggactcgccgctcaaggtcatcgacttcggcctctcggtgttcttcaagccaggcacgtcgatcttcagcaaaatttccacctctcatcgtccatgatttctgtcaaatcctccatggtttctgaaaccaatcaaatgttgatgcaggcgaccggttcacggaggtggtggggagcgcgtactacatggcgccggaggtattgcggcggagctacgggccggaggtggacgtgtggagcgccggcgtcatcctctacatcctcctctgcggcgtccctccattctggggaggtatatactcaccttaattacctttttttttaatatacaatgtcattgatttttaaagatatgtttgataatttttttgaaaaaaagattatgtgattaccgcttattttattgtgagtttattgttaattattctataagtatgacttaaacttttttttatagtttgcaaaagttttgaataatacgaatagtcaaatatttataaaaaaaataacgggatcatatcttaacttccttttttactatatatatgatactatttaactttttagtcatgttcaatcattttaccttataaaaatattaaatatttttcgtttgatttatcactaagaaactttaaacattatttatgttttaaagatttacatattttttttaataaaacgaattgtcaaatattaaaaaaaaagttaacggtatcatttattaaaaaaatacattaccaattcaccatgatgatgcaaatcatctcccctgtcaattcttgtcatgaaaaaaaactataactgtaatcttgtctgaacttgcaaatgtgcagacaacgacgagaagatcgcgcaggcgatcctccgcggcgccatcgacttcaacagggagccattgccgagggtctccgccaacgccaaggacctcgtcaggaggatgcttgatcctaacccatccacccgcctgacggccaaacaagttcttggtaagtaaacaacttaatcaaaccttctcaatgattcagatatacacatgattactggaaatcaaacatcattttgtttgtttcgtcgattggttttgaaacaaaaacagagcatccatggctgaagaacgcggacacggcgccgaacgtgtcgctgggcgacgccgtgcgggcgaggctgcagcagttctccgccatgaacaagttcaagaagaaggctctcggagtaagtcgtcgagttgtctcattgcttctgtgttgcgatgatcttgatgggtcgccggagctaacaacggcggtgtccggtgaaggtggtggcgcggaacctgccgggggaggaggtggacaagtacgtgcagatgttccaccacatggacaaggacaagaacgggcacctgtcgctcgacgaactcttggaaggcctccacatcaacggccagcccgtccccgagcccgagatcaggatgctactcgaagccgtaagctttctgctcatctcctcgatctcgatctcagaatcattttctttattaagataatggaagatttttatcgagctcattcaattacatggagaagatctcaaaaatcatttttcttgagtcttgatctcagaatcattttcttttaagataatggaagatttttatcgagctcattcaattacaccgaggagatctcaaaatcattatttttctgaagattttgttgagatcatccaattatatcgagaagatattactgtaaaccgttgaattgtgatggatgatcatactctcattttctcgatctcaaaatcgttttttaaaaaagataataaaatattttatcgagctcatccaattacatcgtgaagatataactgtaccgttgaattggggtggtcagaccctcgtattctcactctcaaaatcgcttttcaaagataatgcaagatttttatcgattgaacttattagctaatttattgattacttgtcgttttagacaagtaaacggtcttaaataaacaattatagccaccattttctattacaatatatatatatatatatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgatatcatggtgccccatatgagtgtcctatatatatatatatatatatatatatatatatatatatatatatatatatatatatatatatatatattagaaaaaatattttattgtagtatttttaagactaatttctacatatggtctctacatttctacgatttaagaaagtttgaccaaattattatccaaaacaataaatatcatcaactcggaggtattacatcgaggatatagtaagaagatgagatgatgaatttgcaggcggacacggacgggaacgggacgctggactgcgacgagttcgtgacggtgtcggtgcacctgaagaagatgagcaacgacgagtacctggcggcggcgttcaactacttcgacaaggacggcagcgggttcatcgagctggacgagctgcgggaggaggtgggcccaaacgagcaggccatcctggagatcctccgcgacgtcgacaccgacaaggacggccgcatcagctaccaggagttcgagctcatgatgaagtccggcgccgactggaggaacgcctccaggcacttctccagggccaacttcagcaccctcagcaggaggctctgcaaggatactcttactccctgatgatcgatgatgcccaacaatctcatcaactttgtttcatcaaggcttataaactgcacatctttcaccttcaccagacagggataactagagagagatacaagaccaacttagagaaatgtattggagtggcaacacgatgcgatgctgcgcttggattgtgaaatgagaaatggaactgaaatggggatcgtaccggttttgctactctttcggtaaatgggtatttttgtttgctataatatgcacacaacatcaaaaattccatccatcaaaatatgcagctcgaacgacgaatctataagaaatcaggtactgctgagtaaacaccagtttcccacatgatttatcaaccatagattatgacgagctttggtaatttacatgaccgctcaatagataagagctacatctaccattctccagcttcacaggttggtcagtacagggggtggaactttacccaccacatcatctcatgtcatttaaacaaaaacagaacattgcccaccacattaacacaactacagaccataactaatatgtacataatataggctagaaagtaaaaaaaaaaaagactaccacatgtttgtaccccatccaccttcgctccatagtcggtcctgcattgttgctgcaatctagatacaaccagggaccttcactcacacatgtacgccattgctgccattggaagctcttcttcaacgccacataatttaggaacagaactacaatcaacaatcttctcatgagctttgagtaagcacccaccttctcaacagcttcgagatttatggggggcactggctttcagccagtttttcatctagtatctatgcttatcgcagacgctgcatgcatccaccgatgaagggttaataaacgtgcagcgctcacaaggccagccttcatctgagttgtccgaagatgttctaggaagctgcttctttgttttgcctttagtgactgctttcttggaggggatgttggtggcattgcttgatgtggtaccctgggcagtagagtgtacatcctccaagccagcctccagtgcttgaacaaggttctcaaaataattccgagtcacactgcagtggagacgaagcaaagtcaacatatcgtaaacaaagctcatatgacaataaagaataggcaaggaagctgctatccatgagcatagacagcatctcaagaccttgtaaaatgctagcaagtaaaaacatttgcgacaacaactaccaaaatcaaagaagcaagtctagggtcaacaagtaaagagcatagctgaaatgtccacctctttgactgtttgactactttacatgatggattaatactaaatcattaccaagagaaaggtgggcacaaacaaagttcatgtcctttattagaattataaaatctcaggcttctaaaattctcaaatggcatttaaattatggcataattagttacattcatgtgaacctacccaaggattgttaagaacaatgtaagaacgttcaaggataatttggaaggagcgcaacgccaaaatctttcagcacaagcaacacaccgtggagcggttattggaagacatcaaagaagaagtttcggtgtggacgtctggaggttattttcatattgtgtaagacatcaaatttttattgtagccttcagccttttctgtatggcttcgattgtttgggggacctgtccccaccctaatctcgacatcctactgtcgatataaagcccatttgtaatttgttccccttttccttaatgaaatttggtcgaccgaacctttcggccgacccggcaaaaaaaaaaaacgttcaaggatgaagaaaagcaaacccttgggttcatcctaaaaactagtactaattgaaacaagagtaactatcttaaagcatgcagtagttgaatatggccaaacccaaaaggatataggaaaaacaataactgtgaaataccttgtcagccccgcaagcttcacccggaagtcaccgaattcagcaattgatggtgcaggttcagtattatcagatctcacagtcaaaaatgattgcaggtctttctcagcacattggtgaagacgctccagaccagactcagcttcacctataaaagatataatatacataccacatgatttttggcaagcacgtggtagaacttaggattttattttggaatgcaacaaacaactaccttgcaggtactcgaaaaattcgctcttgaccttgtcgtccagataatagccataagcatatgtccatttgagtacccgcctgcattcaataatctgaaatagacatagtggaatggtgcatgcatcagacgcaggtgaattgtatagtatggagtgtcatttgggtcatgacatatttatgatatcaaacctgtgaccaagcttcaattatgaacttcagttgggtctccggtattccaaaaacatctgttaattttgcaagctgtagcacatagagaagaaatagagttagcagctatcaaatataaaatacgaatgaatggcgaagataaacaattatgtcttgccctaaatgcaacgcccccaacctaacatgatgcgaatgcttacttgttccttttctgccttttgcagatctgcttgtgccttctgcctcgactggcaatataagtgaatatgtcagtacagaaacttgcatactacagcagaaaaaattccaagttcagaatagaacaatgcagaacattcatcccaagcatgtacagtagattagaaactatatacccatcaggtatagaaaaacatctggaactgtatttttttatatcatgaactgataaggtaatacaacataaaaattaaaaaagagcatttattagcacttactaccttcatcccataatgttgataggatgacccatcttagaacaacgaatctggacatgaggaatgtccaaattcgttgtcctaggatgggtctcatcctatcctaggttgctacattctaggacggagggagtaagagataaacttggcaagtaatcttcaaataaagctgcagctagttgggctacactcggtaggtaagaatttaagtcaaaattagtatctgcccaagcatatggccaacacaacacttgccaagtaaaccagaaggttcaaaaacacagagtaagttatgagcacaagaatgactaaagctgcacgtatagttgttgtagaaagaaaaaaaaactcaaagagacatcaaacttgagcatgttgaacataccgtctgattagatgcccagcgctcatagtaatgcatgtatctctcaagtgaatttttggctctttccctccttgcttcagtctcatcatactgcattagaggtaattaagttaggaaaaagtaacccttatgattctatgaatgaatgaactaattgaacaaactgtcaatttggactcgacattgacttgtgggattgaaacatttaattctacagaagcaataacaaaatacacaagacatctagaaactgattccttctactaaatgcaattggatagtctcaagataaaacatacaactccctccttctttgctgattcatagcgattacaagcgtaaaatccaccagttctctccccatgttcagcccatgaacccagacataacctgaaatgttcaaagaaaacaaatgagaggtacatacactagtaatatggacataaatatttcagcaagcatagacattggactataccagcagaactcaaatttgcaaggtggagtgcaagtcatatgcatgcatccctggtttttctctattggtcgtttgcattttgggcacggcttagaattagccagtatcctgaaaaggatcatcaacaacatgataaaccatctgacatgattagatgatttcaagcaacataaagaccttaaatacatttgagcattcatggactagccatgaactgaagattggtatacaattctaacagcattgtataataggcaaacattcctgtaatgtaaacatggcaaaaacgcttgagcagcataatgttctcactagagcctccacaagtttttccataaaaagaagtcatcaattgataaaaatggagtcaatgccaagtatttaacataaattaagaggtgtttattatgaggtttaagccacagtgccacatataatacatgttttccgtcataatatattgttaaaaaacaatgcatcagcccttgcagccctgactcagcaaagagttaatagtgttcacagttccttgcatcctcaaatcttctgcttccagaccaccagtcacacatgaggatgtccacaaagtttgatgtttctgaatacataacatctgaatatacgtacgtaaattaaatgcacaatttttttcaccacctcagtttttactcataaccatgaggaaagttagaagatagctgcaatattggcatcaaggataggttaaaaaaagaagtaaatatacaacacaaatgtttgaacatagatttatctccacaaaaattaatgaattccttatctatacactatccgtacactatggcttaataaagttttgagcctgaaccataccagttcatattttcagattctgcgctattctttaatatccacctagaaacagtctcacagttcactggtcgatgagcttcctccgtgcactgcaaacatcaccaaagcattgatgaagctccacacttttcatcactagcaataaaaaaaagtagaattaaatcgtcaggaaaatggagccagaaatactaacgttccaacaaaaactgaatttgcaattgcatgagacatcatagttcccatcgctgacaaattccactgcacatgtacagtcaggagctggacaccatttagtctgcaggaaatgccataggttatacaaaaggttaacagaaagagcacagctcatcatttcaaatcgttagaaaaataaacaataaaaaataggtactccacaaagaactatcaagtggagtaattagttagcttgttcaaacatattaccttcttgctatcttcaacatatgcacgtaagataaatcgtgcatatctcactttatcatcatctttagctaacttattaatcatgttctgaagaaccatagcaccacaagatggatcagggcatcgcaatgacaaacatcctggaccatcacttattgcagcactaatataacctgaaaggttgaatttatattatcataaattttcattattctgagggaaaaataaaataactgcaacacaggaacagatcttgatcatgtttaccaaaaacaacaactacaagtctacaagatagtctatacatgagcactgatggtgaaactatctaagctagtgttggaattgcaaaaaggaagttatgcacaaaagcatgcacagagagagagagagagagagagaccttcccagcattcatggcaataaaaatgatcacaatcagcagaactcatcacatcagaagaatacccttcaaaacatattccacaagttagctgcaaccaaaacagctgtcagatgtaagaaacagtgtatatgtagccacagccaaaggtttgatcagatatgacatgtggccagcacaacaaacaagtgataacaatatactggcatttgaataaataatacaaacctttctagagttaggaagatcaattccatttaaaagtaatccaacaatatcacgaactttttcttcatccgcaaaccattcatcgcttaacttgctgatgttcctgaacagagaactcataaagattaacaaagaacaaatacaaacctgtacccttatttctagattccaaaagtggaagatcagcttattccaatcgtcaagtagttagaaaatcccacatcataccacttgcataccagcaatgacacgtaaactaaattgccagcatatacaaaatctggaggtactacctaagacttcacagtgataattttcaagaaattatcaaagggaagcttgcagacagcaccttgaaaagtgtaacagagtaaaaacaaactgcatgtgcatcaagggcaacttggatagctcaggacaccatgtataacaaatgtcccctcacaccccagaatactctnactccctccgtcccaaaatctcttatattatgggacggagggagtataatgataaaagaatattcaatgaatgacggttaacaaacttaccatttgtagtgatgaagaagaacacacgcctcctcccttcgaatcgatagtacagcagataccttgcctatatcttcctcttgacgctcatttatatccttttcagttaatacaatgtatctctgtccatagttaccaaacatgggccagtttttagagacactcaaggatatccagtgaaacaagatgacatagaagtgccaatcaacatgaacgaaaacaaccaaacacagtaccagcttggaaattatggaaagaaagcacagaaagctctctagaaacatatggtatttcatcgtgatgcatgcgattaattatccgccttttaacctttgtatttaagctatcaaactagcaacacattatcaagcatataatggttaacatagatcatgatttggctacgtctgttgatgcccaggtgtgaaccttgcttggatcagcacaaacaaaacccaggaaagcagtacatcatcaccgatccatgagttccattacaaagactaaactctctaccatgttattccttaagcgtaaacctgtgctcactaatcaatattcaccatgtatagcatcaatattgattgagcagataacaatctaagcatcttagcactaatgtaatcatcaacttgtcggcttgcgcacaatgcgaacaggtataaaacacccaaggctgtcctaacagcggaagatagatcacatctaggtgcggaagcagaacattccttaatttcccaaagagcagatgtgaatcacaaacaactactacacatccgagtacatgacaagcaccctggaccatcaatcttatcaacatatttcagtcgcgttagctgactggtacatcaaaattaagaactgccgcaaaagctcatcccgatcctcatttcagaaaaaaagaaaaaaaaaagaaaaggacgccataagctcatcctaatccttatttcagcaaaacgacgccattctcgagaccgttcgacgctaccaatctagcacccctgatcttccaggtcctgatctacgttcagctcgccttgcctccccgctaagctacaccgaaggggggtgtaatctcgagttgtatgaaaacttttttttcccaaaatcttaatgaaatcgaccgtcgcgcttcctgctaaaaaaaagaaaaaagaaaaaaaaacaccaccaccagtccaccacctgatctgcttccgaccaaaaaaatcctcacctgctcgcggcgggacaccacctcgtcgctcccctccgcctcgcggccctcgtagtcgccgcccaccagctcctcatccccctcctcctcctcctccccatcgctatctcccccgcccccgccgccgctcccatcatcgtcctcacccatgtcatcactgtagtcgtaatagtcctcgtcatccaacatctcttcgtcgctggacatgggcatctcggcgtcggagtccatcaccccgaccaccgaatcgggcgatcggggaggggaggggggcggcggggctagggttccggcgaggtccgcggccggtggacgggagaattggggaaggaaagagtcggagttgcgtgggcgagtcggcaggcacacaggatggggtgttttttatataccagtgtggtacacttttgggaactgtgaagcaataagaggaggggattcagtaattttgggatgtaataatcaagattaggaggttggaagatgcaatttgcacttctcagttctcactagtatcagcgccctgtgtggaagattagcccatagctaattttaagagctaatgtttagtcatgaattgatatgctaaacattagcctagggtggtatgtttggatccatagactaattcaaggctaaaaggtggagagagagtagaaagggaggagagagaaggagagagaaagctgctttttaatggtccccacacaaaattagccccattagcggctaatgttttgaggggggctaattcacattagctcaaaattagcccacctgtttggatccttgagggctaatttaaggctaaaaggtgagggctaaacattagcaaatggaaccaaatagggcccaggctagcaaagttgtgttctttcagttttggtgtgacttttggcatgcctttagggcccgtttagttccccaaaattttttcccaaaaacatcacatcgaatctttggacacatgcatgaagcattaaatatagataaatagaaaaactaattgcacagttatggaggaaatcacgagacgaatcttttaagcctaattagtccgtgattagccataagtgctacagtaacccacatgtgctaataacggcttaattagtctcaaaagattcgtctcgcggtttctagacgagttctgaaattagttttttcattcgtgtccgaaaaccccttccgacatccggtcaaacgttcgatgtgacacccaaaaattttcttttccccaactaaacacacccttagtctaagttatgaggttttgttcaacagaattgcttgagaacttccataagtttttatcctcaaatttgctgatttctagccatcggacttcctcaagatttttgcatgtttcaaatatgtcatgcgtaagatctcggttctaaccaaccaaaacatggttaaatccaagttttatataagttatatcatagttaaagtatagttacaatacagttacactttaattatactatagttacatttgaaagtttttcactcagaaaacttaaaaaaaaaacttatggtaattttttagataccccttattcgatatctaaaatttgtataccaaagacttttctattggtagtaaatctaaaactaaaatttgatgatagaacaaaacaatcacaagagtatgagagtaacaatcgagcaaatacaaacttttgtaatctaaaattgtacatagatagaattaagcaaaaccaaaattgagaaaattcgtcgaaagaaatacctcgatattttgtagtgcagacatgtagatctagttgttcgcaccatgtgccaaccatggcaagggatctgacgcctcggtcgacccatgttcccctccccctccatctccctcaccccatcttcggatatccaaattctcaccccctcatcttcgatgatttctaggaaactaggccgtggttacgtccatataaggtttcaagtttgcgacacgggtgtggacggggatcgagaggatgggctaggtgtcaaaggaggtaggggcgactatgaaagtagtgttatcgtagccataacatcaaaggatgacaatgggcgccatggatgggatgaaacgaaagtggtggtaaatggtggtcgctggagataggaaagaaaacatagcggggatattagctggttttggagaagtcggcgacgagggggttaacaaagtggaggattggatggggtggggtggtggggaagggagatggtggacagagaggaggggatgcgatggatgttagagataaggtttgtcctatgcacaagttttgactaattcaataataaaatgtgtcggcgtatatgtatgtaattccttttttatttctcttgaaatgattttattttgtttttcaagacccatctattgtgattactttaacacaattttataaacaatatattgattgaccactatttacaaatgaaaaaaatgcaacggaaccaaaactttggaacacataatttaattggctttatcatttatcatagtttggaatagtagcatttatggtaggttggagttaatagcatttattatggtagttgaaaaagtagcccttacatgaagaatgaggtcatcaaacttagaaacaactttcttgctacctaaacctgataactcaccttacatgttactcaatataagcagtttgtttgtaactgagtaatttaaagtgaccttttagaattgagaaatttatactagcagtatacttgtggattttctatgtagtatacaacaaagaggggtgatttgggatgttaataatcacaattaaaaggtttctcccttctaaaaagttgtatttattctattttggtattgatatacatatatatctataatatatagattttggcatgatttaaatctaagtcacgagcttttgttcaacatccaaagtcaccttctatttcagtgctgatatacatatatctatggctttttttttatcaatttagtctaagttatggcattctgatcgactccaaaaatcatatatcaagatgtcttattctctagcagtgaatctaaaactaaaattgaaaaggggttcttgtagaaaaaaaaaaagctgacgtgagagcatagactgacaatcgagccgacatgagctttgtaatctaaaattgtacatagatagaatgaaaagatagaaaatgagaaaacacatggaaagagtatgttgcaaatatgtagacccctagagtcaacctaggtaagggatccgatacctcgttgaccctatctcaaatcaccaaattcgccttcatatccgatgaaatcttggaacctaagtggcggcacatccagataaagttttgagtttgggagtgcgggtgtggaggggaattgggaggagggcccgggtatcaaaggtggtagggacaactatgtaagtagcctcagtgtagctgtaagataagggtggacagttgtaacacctgaaaattcgaccgataaaaaatctaaactctaaaaatatgggccttcaaaaactttttaaataaattgcatcatgccaattttattcgacgattttattggattttgatttcggaattcatcgatcacaaataggggaaaattaattaggaattaaccctgaaattagatttggttaaagaaataaataaattataatttaaaataaagattatgtaaggataggaataaataaaatatcatcacggccatatttgtattaattagatttaaatgcaatggaacaagaattaaccctaattaaaaattcaaataaattataccaataaaatatgagtaatattaatctagggtgaattcattagttgagataacacaaatattgagtaaacttcatttatgcaagatttagaaattatagaatcaaatttatatgggaaataaactaaaatgggataaataggaaaaagacactattcattgcactctaggtgttcgacgaggttccctagccccttcccctcccctgccatgcgcgcctcgcgccccgagccgtcgccatcgccgcctgccgccgtgccgctgtcacctgccacgccgcgcgccgctcggccgtcgccgtcgcgcctcgcgcctcgtaccgccgcgcgccgtcgccgtcgctgccgcgtcgccgtcgctgttgctatcgcgtcatcgcgccccgcgccgcgccgcccgctgtcgcgtcgccgctgccgcccgtcgcgtcgccttgcgccccgtgccgccgctgccgcgctgtcgccgtcgcgtcccacctcgcgccacgcgccaccgctgccgccccgtcaccgcccgtcccgtcgccgcgcgcgttccatcgccgcctcgagcccgcgccgctgtcgccgtcgccgtcccatcaccgcgcgccgagcctcgcgcgccgccccgagccccgcgccgccgtcgcatcaggccgccgcccctcccctctccttctccccctcttccctataaatactcccccctccatttcccccactccattttcctcttcctcccctctctccctccaccgcgtcgccgtcctcgtgccgccgcgccgccgccctcggtgccgccgcgccgcaccgtgtgccgcgccgggtgtcgctgtcgccttgcgccgccgtcgtcgccaccgccgcgctgccgccgtcgtcgccgccgttgagccttcttccccccccctcgcgtccaccaccgccgtcgctcgggtggacaagagccgagagagagaggaaaggagaggccggtagggaggaagaagaaaagaggagagaggaagagaaggaaaagaaagaaaggagccgggaggagagaaaagagagaaaaagagagaaaaagaaaagaaaagagagaaaagaggagagaaaaagaaaagaaaaaaaaaatagaaattagaggaagattagggaagtttagaaaattgaaaataattagaatttaattatggattaattatagtcgtagaattgcaaaatttaatataaattatggattattcttggcaatttctataagaaatcaattcgcggtaataatttagatgtagttaattactaaacaaatagatgaattcttatagattattatagattatttttgggtaatcctttaagtaatcggttcacggtagaaattcggatttaattactagggattttacccgtgtattatatttaatcatttagtcatagactaaattaattcgtataatatttctaggatttcgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaatagtaaagttaatataaagaaatcgactttcgcattcgactttcatttggatttatttggatttttatttgaattctaaccgaattcaaatcaattttcgcacgtaactatagaacccgagggagttgcggatccaagtgaaggctaagacctgcaagactttgagcaggcaagtcatcactattctttgaacatgttgatcccaattgcgaaattattttgtttacaaataaaatcgcatgcaatgatgaacatcctacttgtgagtatgccatgccttgattattgtttacccttaaatccttgtaactatgatttacgaataagtccctagtcaactatgacaaatgcttagaaatgctactctagatttatgcatactcatatttatcaaatgctatatgcttgggcaattacctttgggaaggtaattgagatgcggtatgtggagatatgagcgccacattgccataatgttgatgacatgatttgtgaaaggagaaataaaactaaacaactgttttcgactggggcggacggaggatttgggtggtatccggaaaatgctagtaccgtccccagtcaattaaggaccgagccatgaagttaagcatgaaacgacccccgtacaaccgcacttctcgtatgggtatagacctagcggagtagatagctgagcagaggcagtatccatgcgtagtggtcttcttttaggtgtgtgatgcggcaagcagtctgctggcggatgcccggttcggatggccaggtggatggcagatgcccattccggatggtcagaggttggcttggcaatactacgtgaggatacccataagagaacaatcatgatggactgggttcaacgacaagaaacaacgtaggaatgtgtgtgtttttcccttcccgggagcgccagaactcttctcactgctagaaacgtatgacgcctagagtgcatgagggctaaagttcatggagcgggtactgccaatgcgaggttatcgaaaagctttgccgtgacgcgtctcatgtgttgggacgaggctcatatgttgggcagtcgcggagtgcgggtaaagtgtacatccactgcagtgtgagtaaaccaaatctattcgaataaccgtgctcgcggttattgagcaccgggacatgtattacacttggctagactctaaattcttaacctgtgtgggatgggatattgcatgatgatttctacactgatggagccacttcctgagaggcgggaatgtgggcgtcctcagaaaaccatgacgactcaatggcgggaagctatccttgggatcacaatggatggtggatagaaccgtcattgtttaatatgaacactggtactaaaatttgatcagtctgtgctaggtcttaggcttgtgaaaagaattacaaaacttgctttgcgcaaaagaaccatagccatcctttgaatacccctgtcatatgcattgttgctgtggtggtttgctgagtacggttggtactcacccttgcaatatacaaacttaatcagaggtcggagatgaagcttcggaggatccctacgcttactatcaggagggtgatgaagacgatggcgctcagtaggtcttagttacggtcgttgcctgtggcaatggcgtgccgctgccttgactccgctgccttacctacttctgtttttggaatgtattccggaccgctcagttcgatgatttaagactatgcctgtgggcttatgatgtaataattcgtactagacactcgtgtatgtgcacttggtatttcagctatgaattcgtgtgtaccagactacttgatccagggaaatggtactgtttacacggttgattcctgttataaaaacgggggtccactacagtgggcagtggtaggtggggtgaaaaggaagtagcggctaggagcatcaggtggtgctggagtatgtatctgatggcgatcgttggacatgggaaggaaagcaccacatatgtgaagtcagtagaaaaggttagggaggccgtggattcaataggggcaaggtggaggtagggagattgcggcaaaaagaggggggaggggtgggatgaatggatgttagagaggaagggaggcttagggttcgttctatgcacaagtttcgactaatttggagaagaaaatgtgtcggcgtgtatatatatagtttctttcttttcttgaaatggttttattttgttgttctagacccctctattgtgattagtttagtgaagttttattaacaaatagtggcggatttaggccatttctgtggggtcggctgaccccacaactttttgaaaaacatcctataaaccttgattttcatgtataaatccaaaagaatttagagaaatgttcccacttaaatacaaaccactagtaattgaccccacagatttaaattcctctccgccactaataacaatgtattagttgaccgctattcagaaaagaaaatttatggtgaaaccaaaactttggaagatatgctttatttggttttagcatttatggtagtttggaatagtagcatttacatttagagtgaggtcatcaaactcggaaacaactttcttgggacctaaactcataacataccactgccctacgtgttactcgagataagcggcttgtttggtaagcagttggctgagacatgaaaatttaaattttgtacaatcatatggaacaatataattttgtgaaaaaggaaaggtgaaacaatgcagagtttagaacaaggccttagcataaatactgaagatttgtgctccatcgttatttctttttctatagtacggtcaagacatgcatgttctttttggaccaaagtattgattttatactgagataccatgttctatattcgttggatgttcttctcttttcttcgaaagcctgatgctgagttgcctccacgtgcaaagtgttcttccaagagaagttttaagtgctaatttcagccccaatttcactcatgacacacgtacgatggaatcatcatggaactggaattgttgcgtaggtcctcgcaatcctttgttgtaaatttatccgtcattgcaagtttgaacatactgcataacgacatgtggccaaactttttattaatcaacgtctacgttaaggttttccatgcaaaaacgatgcctttttattttcaaatcttttgagatggaaaaggaaaagttgatgccttcaccttttggtagaagcttgtactgatgatcatggcctcaagtacatgcaatggcaatctacaggtcccttgaaaaggcaacaatggtcggtgtttatttggaccaatcgtatgagattacatcatgccatgagtttcacgattcataagattgcaggatctgacaccaatttcagattgcctgtcactgtcatgcttatgcatgcaccaacatcaggtgtgaagcaagccatcagactatcaggctatcacaatcaggtcgggtaaactggttattatctagtgacaacatcagtggctacttgttcttcaaacaatggtcacagtttcacaatgtaggttcatttgataatgatcagtacttcagtgtagcatcaaagaggaaaaaggaaaactgagattgaagctgattgaaatgtcacaaaatggctcaacaagaacaatgatacagaaaattccctatttatttgggtcgatctttttctaacttactacaagatattgtaatctctacaatacaatgcgctaaccggaaataatggtgctacttttgcaccgaacgtgttctcaagagtttctattggtgttctacattgatgcagcttcctcacatctctcagtgtctgcagctggtgcttcatcacc

SEQ ID NO: 74505 - DNA, 4735 bp, Oryza sativa
atcttatacatttgcataaaatttttgaataagacgaatgatcaaacatgtgagaaaaagtcaacggcgtcatctattaaaaaacggaggtagtataagatagctagataacatcagactaagtaaattaatgtggtttatgataatttacacttaaattgtagaatgatgattcaaacgtaaaaagtaaggtggtatgactttatggaataacaaaagtaaggagatagtttagaccgtagattaatcatctaaaggctaaaaataattgatgtaatatgacttaattagaggaaaaaaggagaaagataatttgaaccatagattaatcatttaagcactaagtatataagatatcataaaacataataaagatatacattgaaacattatgtgaattatattggatgataatttaacatgtttgtatttgaaaagctcttaaattataaaaactataaagatatagcatgtttgcatgatgtttaaatgtgatgattgttagtagataatgatgtggcatctttatatgttaagctcaaggagtgagtggggaataattgtatagtaagataggattacatatgaatagtgtataatgccacatacttcttccgttttgtgtcatgagtcctctgacttatttcatatcgtctaacttaacaagatcaagaaaaaattaagcaatatctaaaatattaaattagtttcaatatatctatcattgaatatatttgttttgcgttaaaaattgtactatatttctctataaactttatcaattttttttttacgtttggttaggaaaattgacaaacgacttataatatggaacttatggaatattatatagtacattaattggcaatttggttcaacttaattaatcagaagaatggagacacagtacgagctgaaaatcaaagtactcaaacaaagtaatatattttgtggactctatatatatatccatcctcggcttgaacaactaaggccttgtttagttcccaattttgttttcccaaaaacatcacatcgagtctttggcatgcatgaagcagtaaatatagattaaaagaaaaactaattgcacagtttacatgaaaatcgtgagacgaatcttttaagactaattagtccataattagccatatgtgctacagtaacccacatatggtaatgacagaataattaggcataataaattcgtctcgcggtttctaggcgagttatgaaattagttttttaattcgtgtccaaaaaacctttccgacatccggttaaacgtccgcagtaacatcccaaaatttttttttcacgaactaaacacaccctaaacgtggaaagaaagaagaaaaaaggttgcatggggagcatatacaggtacgtatagcattgaagagctaggacagaagagctaggacaggggaatagcaggattgcagtaataagctggaactgtatcaccgaacaacatagatcatcatatcagcaggtagctagcgtagagagatgacctgtacgtggagtactcgacgactacatgcgcgcgcatgtttcgcataaaagctgtgggaaggtgagagcaccttaatgcacatgtacattaaatccttaaacgtcgacatgcagagacatgcaccttaaatccttaattataccccccagctactacactactactcctacatgcattcacgtaccccagtatcgtgcagaaaacactatttgctcgatcaataacttgcccaaagcagtatacctacgtactagccatacacactactacagctactgctactatacaaacgctttaattttactctccagcagtccctccgacttagaaaacaaattttatgaaactggaatatatcacatctaattttaatttttttttgagagagtagttattaacactgcaagctcggtgaggaaggagcgacgacgacagtagcatatctttgtcactgtgtgcacgtgctcctgcgtagagatatataaccattaacaattttagggggtctttagatctagggatctaaagttttagtacgtcacatcgatattatataggatgttattggtaacgttttgtgacaagtcgataagcacgattgtagcacctaaagctttgcggtaatatggagtctccaactgtcacaaccggaaataacccaacgggcgttccttacgtgcgtgcattattccttgtcccaggaggcaaggtacaccaaaagttgatacagttcagagtttaacaagcggaagcgtaaatagttaatttattacatgggcggcgaaggcccagcacacacaaagacaaacgggaaacagcggaagactagggcgatgaccacaggcgcttgacggcaggcacgagctagacaccaaagccttcatcttccaggggctcctcttctgggtttgggaaaaaattgagcaagactgagtacaaccaccgtactcaacaagacacacccacaaatgcaggataaatgcaagggagtacaatggggttataatataaagggttagggtttgcagcaaacagcattaaaagacacttagttgctcaaagctattttgtaaatacgatcctagagctatacaagattattaaacaaggccgtgaacccacacgaacctgccttaacccaaggcctacgatgattcagaccgaactggcaacccgaccctgggtcccagctcgtcccaagccaactcaggccaaccattccacattttagttgttaagcagattttaagaattaaaacactaacttgggtacattgctcggcttgcccataaccgagggcgcggctattcgaatagattatactcagatcagaggtgtacatctttacccacaagacacatcttcctcacgtgtaaccacgtgccacataccaccacggtatacggacggaagacgtgacatagtttctaacccatcctagccatagacaagagtaccgacccaaccccacctacggccggaacctccgggacaggtaggcaggactgagcccctagcagcaggacaccggccatgtgccatgacatcttgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaacctttttgaggattttgaatagagggggaggtgtgaatccaattccacaataatccaacaattccatagtgtccaggtgataagagtattcccaaagtctagagttgtaaaccacctaatgttacctaattaaccagcgaagcatctaactaaaatcatactagtggtaccatgagtagagtgtccactagttggggttttgtttattctagggtgaacaaggaaataataacaataacaataataaggtcataacaaaggtacataggcatggctagataaaacaatgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatctttcgaagctacaacgtctacacgaccaacggaaaagaaaaggcttttactctaataaactccatattacaagctggaacaaagcacaaaaatgggttcttgacttcttaagaaaaaattagagacttgaacggtccaattctgagttcaaatggccaagttatggtcatttgaagtttatatgctctttaaatgaatatttgcgaatttcttcatttaaattttaattttaaaagggtttattgcgtcagccgagcggagggggcgcgcggaccgggtccacgggagtggggcccacgcggcagcctcacggtccacggtggaccgggtgcacccgggctcacaccggccggcgccgtgggtcccatgcgtcagccgcacctaagggcgcgggcggctgacggccgggccccacgcggcagccactcggcgcgcccgagggcggccaagccggcgcagccggcgggaggcggcgcccgcgcccctatggtcgccggcggtggccataggcacggcggagcggcggccgagagaggggaagggaagggggaaaaaaagcggcggtccacggctcaccctaggtcgacggcgacgacgaaaaagccggccggagcggagaaaggcggcggcgcggctcgggtcgacggggtcgacggcgttccggcggtcggtgagcgaaacggaggggtggacgaggtcggcgaggatgcggcgaagccgaaggaggcggcgccgaggtggaaggtggaccggagctcgacggcgacggcagagagagagcgacggcgcgagctcgattccggcgaggaggaagggcggcgagaggcggaaacagatggaggaggtgcggggagggtttaaatagagccgggtcgagagagggtggccggggaaggggggaaaccggcgcgggaggtccggctgccatcagtggcgccggcgagatttgcgggggcaaatccgcccgtttaaacgcgagagagagagggaaaaa

SEQ ID NO: 74506 - DNA, 11487 bp, Oryza sativa
tttggtttgaaactaaaataaaacctgcttggaacttgtgttggtaaccatatattgtgcttgatcattttcctctccagaatatgcaattatatcacttgattgtactgagcatgtccaattttttaatacaaaattgagaaatctagatttgtgggaaaaaaaatctggaggcaagtttatgtgacctatttgcaattctttcagtaatcattttatatcgtgaaacattatgctgttgttttcatttgcacaatgttcagaaactcctgaagttcttactttgaatgcttcaaatcttcagacaattattaactgtagtggctttctttgatgttcaggcatgagacgtatgtaaatcagtaccgtgcaatgttcgttcgcaactgcaaggtcaagactgatcagattctacgggaggggaaaggcaaacggaaaaaccgcaagggaaaggctgctgattcttctactacatcagaaggtgaaaagaagggtgcagtttatcaccctgtttgttgtgaggtttgctcaactgaggttggagtgtttgatgaagatgaagtttaccacttctttaatgtcattcctagcaactcctgaaacttgttcttctgaatgtgtagtttgttgatccgtagccactgatgagatctgtacttgctttggcgttctactgttaaatcaatctacattcaattcagtcaggtgcatttgccatacttttttttttcatttctgttgctaggagttcttcagtctaaaattataatttatagctgtattctggtatggggcctgatgaatttcaccaagaatgttggcaagttcctggaatattggaattgcaacattaattacttcaatgtgtgtttttttgtgctgtgcagaattgctgaataaattaatgattcgtgagaattattcgagggtacaaatgaacgaatgaattattataaagataaaaatggatttaagacagtattataagaaatcatagcatttaggaattcgggaaagtgtgcccatttatccattcattcgttaagcagagatgtcctagtatggtagtggaccagaacgacaatgggttgtgaatagctacagtcctgtttggaccagaacacaggaaattttgctgggggtagaatcgaattgtttctcgtgaaattcacagctcatatcctgtgcaagaacatcaaaactgagaggagcagaagaggttgtagcttcagtgtaaagatacgaacagtgcacagtgtttcacttccgcggtgagaatagagagagagaaaagattgcgttaaaatcaggtggcgggagaggtcgccgacatgctctttttgagccaacgaagccatgaagcctttgccgggtggggctccaattatacgctgaaagcgagtaggcgaccaacgccatatgcatatccaaaactaggaaggctggtagccggtccattcgccttccctttcaacacaggtcatcatcatcgcttcatcgcccctgtaccccccctcgcttctctgccctctcctccctctctcgacgtctttctccagtcatcttttgttgaaaaaaacgctctcacaacctcccgcaaagtcaactaatcaacgcagtttttggcatcttcatgtgcgtattgcgattgctacttggttgtacgggctaactatagtattaaaaatcacggatggctaagtggtgctggtgtgtacctagttcatcagagttcaagttttagatttagtttagctgtccaatgtttttaggagtgcttatgcatgtatgctaggttaatacgtggtgtcctcgctacagggggtgggtgtttgatgcctccaacattaacttaaaacatgtgtacaggacttacaaatgtttgtgcgtgcaagtggtggtatgcaaacacacaacccaaattattgggaagtggcaaatcctctaaagaaaaaaaataaaaacatgaataaaatgatttactcttattgtggtgggattagctcatcggaattcaagtttctagacttaccgcagatgctcgtatttacgattaattattcttagtggtatatgacatccgttgacagcgagatgtttatagttacgtcgttaatctcaatatatgtcatccagtttttgaaggtgtttattatagagttaatgcgtgcacatgtgagcgcgttatagggatgattgtgtacgtgtgttttgtgcctgtttttgtaaggtgtctttcaaaaaatgatattatactacttttttttcgaggaaacgatattaggctcttgtctcgtacaacatccagtggaacacatggttttgcatgatctcacaacaataatcagttcaatctccatagatatcctcgaaaattcctgcttttgcaaacaaccaaccctaaacgccaagccatggatcgcatccccctcatccatctcattctcaccgtacgtttccttcgtcccgggtgatgatcgatcgatcgatccagctgccgccgtccatccaagctttgggcccccagagcagcagcacccacgcccccacagctcatggctgcaaaaactgtacgctacagcgttgtacaatgtacatgtccacgtccatacagtcgcagcttggacgacggaaacctgtacacagtctcgtgcatgaccacatgataacgattttttagtaggccaaagaccaaagttttttttttctttttcctgcacatccccagcagtagcccccatcatccagtgtccaccgaatcgtcaccgagcttttggttcgaaaacgatcgatttcctcgcgcgaaacccccacgaatccgtccgtttttgttgctgctgctgctgccgccgccgcgaaattccgagatctccctgtctcggcagccagcgtctctcaggtcgctgtgcctgcacagtttgggttctttcacacgtccagttcagcacccacggggataagatattgtaatgagctcgagccgtcgactattaaactaatcctcgccgtgatgtgatacggtggtagattaggcttaagctatgtagcgtttgctgctgctactatttgtaaaagaccctgcagattccagcaaagtgtgagagctactggacccagattcccatgtgccctgccccccctatggtggtacagtactactgctgcgaccacactgcctcttgccctcttctgctcctcccatttctcctcctctccttccctcctgatcaaggtcaggtctctctggtgacccagataattagcgctcgcatttactacgttgcacacacgagtaaaataccttgaatagtatattccgtattgccatttcgctacgaacatgtagcgtgtagtgcatggctgcatgcattagaatccagacaaaaatgtgctggtattgttgtatagtagtaataatgttgattactgtttcctcaatcatgaaataagtttatttaagccatcatttgcattagaggctgtgaaaatataagataaatacattaacaatagataaagagggagataataattgcattaggatttgatcaagtattggatattctagttttttcgattgtattggtatatgaaatgaattacaattaatttattttgagacgaaagtagcaacatgtactactactagtacttcatgagaagaaattttgtagaaaaaagtaagtggggggggggaagtgaagtactatggtaaaatacgcagaaaaaggccctgtatagatgggactaaaacttttaagtccctatcacatcggatgtttgaaaattaattataaatattaaatatagactattaataaaacccatccataatcttggactaatttgcaagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaaagacgagcaagtctacatcaagtccattataaatctatccggcgtgtccctctccccatcacctcaaaacctctcaaaccccacaggcaccggaccaccaccaccattggcaccacctcgcatcacactctctcgctcgccatgagctcccgcgacgccgccgccacgttccatgtctaccagcccgtgcagatcccgacggccacggtggcgcccgctgcggcagtgtcggcggcgccggcagaggccgtcgcccagctggtcccggcgccgagcaagaaggcggccggcgcggcgggtgggaaggaccggcacagcaaggtgaacgggcgcgggcggcgcgtgcggatgccgatcgtgtgcgcggcgcgggtgttccagctcacgcgggagctggggctcaagtccgacggccagaccatcgagtggctgctccgccaggccgagccgtccatcctcgccgccacggggaccggcaccaccccggccgccttcgtctcctcctccgcgccgtccacctcctcctcgcaccagcacaccctcctcggcaagcgccagcgccaggagtccgccgccgccgacgccgtctccgtcgccggcgccgcgtccgcgttctgggcggcgctgcccgcaccaggccggcccgacgcctggggcttctccccgctggacgcgcagccgacgtacgtgccgatggcgcaggcgcaccaccaccacctcaacctcctcgccgcgctctccggcgccgccaggcgcgccgaggaggagtcccggtgaatcacgcacagcagcatgcatcttccgagctctgacacgtctttcgctcaattcaccgacgcgtactgcactggcgtccgtacgccttgttcttgggacagttcttgattggagtgtgcttcttctctctaccccgtggatcgatcgttttgccttcttcctgtgcggttcatcaattgctcaagatgaaattaattgttgctgtggtgtttaagctcaaaactgtaaatacgagtccttagatctcatcttactcctacaaattccagcgccgcatgtgtttgtgtgtttgccacttgtttccagctcttgtgctatgattccatggaacttgtttcagtttagcttcatctacatcgttgtcagaccaaatcatttgacagttacagaaacatgttgcattgagctgctattccttgtgtgcatttcctatctcagcagtctatccaggattatagcgtgcacatcaatcacaatcttccattgcttcttttttgaaaaagaggaaaaaacaatgtttcattctttttttgttaaacgaatcggcgcttatagcgtgctaactttattgaatatagcaggagaaaaacaatctttgattgctcatggaaatgttcttgagctcatttcgatcgtaagtaggaggagggatgtaaaacaaagcaattgttgttcaactaggcgtaggagaaggcattcgagcaagtctgagaatttcctcggttaccccatccatggctgcagattacaccaatgataacgctggctgggaagatgcccgttctcctgtatactcctctggtttcttttctctcaaaaaattcgcctttttttcccctgctcttcttctgcaagtgcaagctatagctccgagcggggggaaggaaaaggaggaaaggctgcggcgctgcagcggcatgcagtgctgcacagtgcgcgctgctgctgcggccgctgccgctgcctgaagcttttgcccatggtgaaaggttgaggccgttgtgcatgtatagggctcgtcgttgcgtgtcaaagctggacgcaacctctcggcctctgaactgtaaagatgccctacctttcgtacaacgtcctgcatgctgccatgtcccgtgctagctactactctctcttgcaattgcaacacagcggactactcctaccggctagaggttgacttggcatggcaggccggttactctcttgttgcactgtacatatattgcacattgctatatatactgcccctctagggaatgtaattaaggaggcatggttgaacgtatcaggtaaaacaaatggagggtcacagggcatgttactacatgatactcctagtacttgacaatcttatttttggatgatctatagtttgactgtgttagtatagtgtgagaacaagaatttcctgctagcagtactctacgcagtattagaagcgccgggcggaaggatgcaaatttggggtcgctgtaaattcctggtcaaaatggtcaggagatcccaataagagagacgctagtacaatgtcggttggtagtctgacctgtcaccacgtactccgccatgcagcgtgtcagtagtataaacttggacaaggtagtaggagtagtacgtgcgtgcgtaccatagctatcccagtacgtacgcgcgtactagtaccacacatccctactgctttgcttttgcagcgatgcaatactggtgttccgagttctctttgctctcaacattttggaccgctcattcagtgattcagactttcactgtagctagataggagtatactagtagtactaatgatcttgttatgcatgtaagcgaacaaaagtgtgtgtcaaggccggcttgaccgagaaaaattgtccgtccaagccgtcctggctcatggctgttcgcatgcacggatctctcagaggcacggggagcctgatgtttctgatcggccgcagactgggacggtccgtccctttgccgcctggttttggttggtggcggccagctgctgctgctgccgctgccgctgctgcagctctgcatattcctcctttgcgattggccggtacaaagcacatgtcgcggcccgcgggcgtggctgcgcgcgactgtgttcgtgacagtgtgactacgtactgtgtcgtagtcgtcgtcgtctactctgccgcgcgctacgtactcttactccgagaggcgagagagtgaggagaggtgtggtcgccgacggcgagacactggcatgcaccaccgaggccggtggaagctccccggcagatttggctgaaaatgtgacaccatacctatgaccggatgatacatcttgtttctatgaatttctatctagatttatcttatccagtcttacactcttcatcaaaaagaaaaagctaaaatcctaattgcacattttcatattcataatcaggatttaattttcttttaaaatatataaaaatatgttgctacattgtgagatggagagactacttttaagcaataccgtacctgtggtcctgactctttgtcctctttgtcttgcctcaagagcaacacgtagagaggtggcagcaggtaatactgatagagtacttgtaagggcatcagcaatcaaagatactctatgggtgtcctcactaaccgaagctactctatgggacacccatctcacaatggaggatactcgtagctggattctttaaaatcttaggcaactttatagggctactgcagcccacaacgggtgtcccgactcaaagtagcccagtaagaaatgaggatttttacggtactctatactgcaagtatatacttatagtataaacaatccaacggtgtagatttatctgatcttcctctaaattaatttgcagtataaatttaaaagggtatatttgtctttccatcttttttacgtggggatatttttgtattttcgcgttttctttttgtccgatctggctcgagagaaatccactccagagaattatgtttgctttccttcgtcccatgctctatcgacgccgccgacaaccaaaactctgcaagcgcctgagccaaactcggtgccatcggcgacggcgcgccccagcctctcgttcgcccagtcaccagccctagcaccattgagaaattgcactgatagccaatcgttgttttcattttgcataactgtctcctggtgccgcctccatgcagggattgatagatctggcaaatcatcccgtcataaactaattgaacaagaaatatactgagaacttgatatgtctggcaaaaaaaaaaatgaactagtcatctatcaatttcatggatcatgcatggctatgcatgtcaaaacttaacagtgctgatatatatttttagatgcaagtgcaaccaaaaaagtgtctactaccgatggaaaattactcccgatgacaaatctcaatttcaaatgactaaacagccatttttagattttttaacaaataccaaacctacccttctatatactgtaagtatatacttgcagtagaatgtaccgtaaaaatcctctaaaaaattccacccatacccctcccaccagcccagtaaaccgtctaaacttctcatctcttcctctcctttctcgtctcctctgctcgcgcccttctttcttctcgcctccgccacctccctacgccgccactagatctggtggccaccaccagctcctccaccacctctccgagtccgattcctccccaacgccggccaagggtgaaaggggaaatttctggtgggggaaccgtgtccacaagagacgacatcgtccaacgcgaaacctcaagcgagtggctcaggaaaaagggagttgaggaggctgggggtgcgttcccctcgtgggggtcgcacctccctgttgagacacggctcatggacggggggcgaacggcgtgagcgaggctacggtccaggggcacccattgctgatgctctaagagcaggtataatagctggctataagccagctataaagatgttttaaagagataaaggaagagagagaagagcagcgggctatagatctgtagccagctgcagtacggactccaagacgtaatatgtgtatgacatgtcggatcagatattaatggtatagtaagcaattattgtatgaattgactattatattggctataaatgatttagtacgttggatatataatattaaacttgctctaataaggtggttgctgggtcaaaacttgacttcgatcggcgcacgaacgctttgaacggcccccgtgcttcgcttcgtgagcggccagtgcgcatatacagcggggtttcggggcttctggctggcgctgatcaactagctcctttctggcgcgccgtgccgtgtggccggcgcatcgccgcctgcgcctgcgcggccctgcgtgcagcagtggataagtcttggccattccgtgaggttctctccgtgtgacaaaacaggtcgcccccgagaaacacaacggcacacgtacggcaaataactgtgatccatactgtgtagtacacctgtagagcctgaattttatcttgtctgacgaatggccgagttgctgcaattttatcgtctggcaggacgtgattttcttgtaatctgtggaacgggttttgcttcgggcactcccagactcccagtagtagtaggagagatccgagtcttgcatgggatccagcttcaacgcgaaacctaaccagaaagactccaccgtttaaaaataaatttactccctccatctaaaaatatttgacgcggttgactttttaaaaaatgtttgaccgttcgtcttattcaaaaaatttaagtaattattaattctttttctatcatttgatttattgttaaatatacttttatgtatatatatagttttacacattttacaaaattttttgtataagacgaacggtcaaacatatttaaaaaaaatcaacggtgtcaaacatttagaaaaggagggagtatatccttaccttctatcttcaacttaaccaatcataccatccttcatttaatttttaacctactttctcttcctaactactccctttagcttgataattctcgttgttttggacaagataatggacaaacttcaaaggctttgattataaataacatctaaaataattatcttacaaatatgaaaaccatgtgtatagataagtcttgaaaagtactttaataaaatcatatatttaataatatttatatacatattataataaaaaaaatagtgaacaaagttgtttttttaaagactgtccttattcaaaataacaagtattatcaatatagagggagtactttttaacgctcatgctcaactaaggaatccttacgttttaggacggagagagtaccatttaagtattcatatagtttcttaacattaattgattaaaatgggatttaggtaaaataatttgaaattgattagatagatccaaacacaaacactgggcatttggttctttctaggtgttttagttggatataatatgaaccacttagttcacttactataatactccctccgtcccataatataagggattttaagtttttgtttgcactgtttgaccactcgtcttattaaaaaaaatttagaattatttttttttgacttactttattatccaaagtactttaagcacaacttttcgttttttatatttgcataaattttctaaataagacgattggtcaaataatgcaaataaaaactcaaaatcccttatattatgggacggaggacggagggagtagtatctacttcactgtcccaaaataaatcaattcctaaagtttaaactttatcctaaaataaatcaatttcgactttcttatcttttatcgatccaagaattgaaaagtttttttcccttcaatacccttactgatccacctatcaatactacattctattgatgagggacaatgtagtcttttttttccttagtactaattttgtctgggaatgcgagggtgcaatttggcttattttgaaacgaatggagtacttcaagtatctaaaattagaataggcacgggaaatggagtattatttaattaatggcattctcttatccaatgtttgcaattttggttcgaaattcctaaaatcatttcacttgaaaattcccatatcattttttaatttagcaaaaaaaattcaagtcggtcaaaactgttcaaattaaattacaagaaaaaaaatcatgccgaatatcctaaatgcgcagaacgtaattaccaaccctgctctacctcggtcagcaaaaagaaataatgggattcatgtactaattaaaaaaacactgtacaacaagctgaataaggaaaacgaaccacacgaacgtgcacttgagcgctgatctgtgactgatcatggcagatcgatcaatcgtcggcatgaatgaatgaataaccgaagctcctccgatcggcacggcgcacgcagcagcgggtgatcgtattcgatcgtacgtacgtgcacggtgcacccacgtcggaataacttcgaacaatcaactgagcagttgccacatactcctacaatttttgttcatgcgcgtactctgcccatcaagcttcacgccattttgcacggacgccgcgcgtactacgg

SEQ ID NO: 74507 - DNA, 23129 bp, Oryza sativa
aaggttgcccgggaaaggggggaaaaccggcgcggaaggtccgcctccaacaagtggcgccggcgagatttgcgggggcaaatccgccgttttaaacgcgaaaaagagaggaaaaattggggggaaaggaagaggggatcacggggagtgatttcccctctttattgcacgcggagacggcgggaggcagcgggattctcggcgccgcggcgctagggcgcgggcaagtcggcggagcggcggaagaaaggggatgacgggtgggccccacccgtcagcgagggtggcgggcgggcccgcccgtatgaggcgcgcgcgcggaaataggccgaatgggctgcggggagaaaagagggagggggagggagatgggccgagccggcccaatagggagagggagggaaaggggactttttagagtttttctttttataaaatcattttatctttgtttatttcttaataattattatttgtgctctgaaaattccactaaaatttatttacgcattttagtcttttaggaaatatacaaaaatctctcaagccttatttgacttttaactttgcaccttttaattgttggaggctttcacacggattttaattattctaggcataatttagaggatgtagtttagagtcgttttgggacgtgacaccaaccacctcgatctagccaaaaggccaaatcaagatggattttgtaaaaagaaaaggtaaaccggctagcggaaccgatttagatatcaaaatcagcctctaggccgatttagatatcaaaatcagcctctaggccgatttagatcgatatgaggataactacccgtctcgtggacaaaacggaaggttttcaggataaacctacaaagaggtgtcgcactctctattaacagtgaaaaaaaaaacaacaatattggctcggggggcaagcgcataagtttcagcatgatggagcacatcagtatctgctcatgaaagccgattgcaagaagcaaaggaagattggttttggagttatcaagacaagaaattatgaagcatgaattctcatactccaaaactggggggcatgtgttaacagtgaaatttggtaagcccggagtagtcattggcttagagtcagcatcggcttcgaagtcctgagattagccgatgagagttgtcaagtcgtcagttgtcggattcttgctatattcggttaaggaaattgatctactaaaggaagcttatccagaagagaccgagttcaaagagaatgtggcatggcaagttatctattaattaggaatagtttgttagtttccttttatctttaggaaagtgtgtttagtgtcctataaggactttatcttttccttttatctttaggaaagtttctttcttgtccgataaggacttgaatcaacccatgggtataaatatgtacacccggggtctatgtaatctatcgtcacgatcaatataattcggcgcatcgccaccttttaccttttctactttattttatcgtccggcgggacttggcatctgacgcagggctgcattggtgttcgatctccggtgaaggggtacgtccaatgttccgccgacccaggcaattgtatcgtttacgtcggtgtcgttcaaggctacatcagtacatttgacctcttagattgcttcggtttggatgatatatttgtctacctatttattatatgtctctgttaatctagtcttagcatatcaatttagctctatcggctgcttctcgttttagggtttctgccggtatcggctaaatcgcgttgctagatttgattagcttagacatctaccaccctgataattcaatcaacggcttgattgtctagattttatgtttcttttcatacttagtgttgcatcagttaagtttgatctactaagtcgtgtttagaaccataatctctagcctgcttcttgattgccaataagggttttttcagggtttcagccggtgagttatttgtacgttgcatcggctcatacggattgcatatacatataagttggatttagccgatgacaacaaaggtttcgctgtttaatctgatcttggggatttcatgacattggacttccagccgatgtgtgctttaacctttacatcagtgcttatttatcatatcattgctagccgattggtttatactggattataatgttattgtattacatcatcatcagccgattgcctttatatcatcatctacattggacatacagccgattgcttaaaccatatcgctatcggctggtatcggcatcggctaatatcgactatcggctggaactactccattggcttgtcagccgatcggctgttttatcggttatttacatatcttgtcagttgggggtcaaactaactggcacgcccgcatctcaccaatctttggacctgcacaggaactaagcagatctcccaggctggtgtgttcgattttttcatcaacacaaattggcacgcctggtgggatgatgatgtaataaaataacaatataatccagtataaaccaatcggctagcaatgatatgataaataagcactgatcttaaggttaaagcacatatcagctggaagtccaatgtcccgaaatccacaagattagattaaacagcgaaacctttgttgtcatcggctaaatccaacttatatgtatatgcaatccgtatgagccgatgcaacgtacaaataactcaccggctgaaaccctgaaaaaacccttattggcaatcaagaagcaggctagagattatggttctaaacacgacttagtagatcaaacttaactgatgcaacactaagtatgaaaagaaacataaaatctagacaatcaagccgttgattgaattatcagggtggtagatgtctaagctaatcaaatctagcaacgcgatttagccgataccggcagaaaccctaaaacgagaagcagccgatagagctaaattgatatgctaagactagattaacagagacatataataaataggtagacaaatatataatccaaaccgaagcaatctaagaggtcaaatgtactgatgtagccttgaacgacaccgacgtaaacgatacaattgcctgggtcggcgaaacattggacttaccccttcaccggagatcgaacaccgatgcagccctgcgtcagatgccaagtcctgccggacgataaaataaagtagaaaaggtaaaaggtggcgatgcgccgaattatattgatcgtgaagatagattacatagaccccgggtgtacatatttatacccatgggttgattcaagtccttatcggacaagaaagaaactttcctaaagataaaaggaaaagataaagtccttataggacactaaacacactttcctaaagataaaaggaaactaacaaactattcctaattaatagataacttgccatgccacattctctttgaactcggtctcttctggataagcttcctttagtagatcaatttccttaaccgaatatagcaagaatccgacaactgacgacttgacaactctcatcggctaatctcacgactttgaagccgatgctgactctaagccgatgactactccgggcttaccaaatttcactgttaacactctcgcagcggcggcggacggtttacggcacaaactgacaaagatggactaaaactagggtaaaatagaaaacatagtaaaagaacgattcaagtagattgtattggggggttttacaatgaaccggccttgtctcttaaataagggttggtcttgccctttacagaccctcctccacgtccaactcaggatagaaactaatggaaacacgaaacatggcttcccgagcaaggaaacccgagacccgacgaaaacagactcggactcgaaccctgacggtctgaccgcccacatacctgcggtgagaccggccctactagccggtcagaccgcccacatgcctgcagtctggccggccccatgaaggaaaccgggcactttccaaactttggcaattttccccctatttcgtccataggtgccaaatttgggtgtttggacactaataaaaaatgtaatccgtcatggggtgtttggacactaataaaaaatgtaattacagaatccatcagtaaaccacgtgacgaatttactaagcctaattaatccgtcactagtaaatgtttactgtagcaacacattatcaaatcatggaacaattaggcttaaaaggtttgtctcgcaaattaatcgcaatctgtataattagttatttttttagcctatgattaatacttcatgcaggtgttcaaagattcgatgtgacagcgtgtataattttcgggcgggatctaaacacacccttaattaatgggcgtgcgtacatatatgtcactgtcagtaatagtaatatagtatgtgtacctccaagttagtatagattcttaggatgtgctatatatgctactacctctggttgcataattcattcttatattctaaacattgatatggcctgtaaaatatatctttagctatatttttttattataatatatgacataaataaatatatttttacttttgttatagtaaattataagacaaatatatatatatatatatatatatatatatatatatattatattatatattatgtgtttaaactaaatgttttaaagttactgatagtcatagttataatagttatagaagtttaataatcttaatataaacgtcaagaattataaaatcggagggagtacgaataaacgattgctcttaactagttgatgaacaaattgcagaggaacatgttgggtttaagtcaggtacagctagtctacttctcgttacctttccttttgggggctaccaaattaatcacgttaattaattcccatccctcttcttaccttcttttttttttggggccaattatcatgccaatccagtccttgttagggtaaatggtggtaaagttaatagtactattaaaatagctttattattcaattctgacaacaacctactaacttggatgtaatttactacactctctccatccttttctaattgtaatgtactagtgtggtctttttgcaacgtactactgctggtctgcacgcctacagaggactgaaatacatgttctacctactcggagtaattattagtgcaatgactgctcctttaacctgtaccatacttatcatattactcctacatgcaccttcagggtaattatttttttaaaaaaaaacattacgtaccattactaatctttataaatacaaattatgaaggttctgatattaaccctacattaatcaagaaataaaaaggttagaaatgcccacattaataaaaaatctagtaattctacgttaattaggaagaaaaaagataaaactgtgtgttcatttgtcactatcttttaagagctccatctatcagttgtatggacgacatcttgcgcaccataaaatatatggatttattatatcagttgtattccgtttggagttttaattatttttcttcatcatgatttgataattctagaattagaaattcttatacttggtttggagtctaaattatagttttcgatgatttatatttttctaaaaatcaaaattcgtaaaatacgtaccaagttatactacgcatgcatgcatgcatgtactacgtctggagtctcgtttatacgtttatgacaatttattaattctgaatttcagaattcgtaaataccaagttacaataagtttgaagttttaattaattgtactttcgagagatttaataataactttttaattaataaatataatttgattgcactttttgaggaatttattagaaaattcaagcttttactcttattcgagaaatgaattgaggagtagcattatatcgttcctaagtacttctttacgtgctcttgaggatagattactatattgatttagtaataattaagaattatggagaggaccagggaacacttggagagagaggctaggagatggatcaagtcaagatggagatctaactcatcaagttcgagtccacttcgggcttcatagcagtccacattaaattcgtcgcctaggttgcattcggattccaattttgacgttctatatatgcatggaaagctaacgagatcatctttcgaatggatatagtcccacatcaaaattccttctgagtcaacaggaattttcaaaacaagaaggcgttcagaatctgcccggtgttgcgtcaccgtctttgggcccgttgggccatgtatcgagtcgaagtctaatagtgtcgcgtccacgggtctaatgtcgaccctaaatcctatatattcagtagctatcattatgttaggattgggttttgcttagattatttatgccttcgcagtttcgccgctagatcggtttgtgaaaccccaacttcgaatccttgataatcattcatctacaattgagttgctctttttcttgttcttgcttgtgttcttcgattcacacgcagggattagccttctcggcgaggtcgatcgagcttcaacacggttgataatcagaggagacgtgctgctacgattgcagggttcgggtcgtgttgatcggaagccggatcgtgtgtgtcaagtttccaccaaatcgatagttatcttcacctgacggaagatcgggcatcccgttgccatcatgaatcaaagttcaagcttttcaaattaaattcattagatcacataggtgatacgacatgtgtgagcaagcctagggtgatccagacgcaaatccatcacacgagcaccttcaattttgaagttttcaaaattttgttcttcacctagtattttccaagcactttgaacttgatgaaatcttgcatctttggggtctcttttcttgttttatttaattcccttgttgttgtatactgtcattcagatttttttaaaaaaaaaattcaacgtttgtttgggtggtttgaagcaaaatctacaaatttggcgtgtgctgatttttgcagactgtaagttccagtgcaagcggaagtttgatctaaatctttgagagaatcaattctatgccacttaccctacttcaacgatttgtcattgactttgtctccctctataatatgcgactgactttgtcactttctttttacaatatgtcacagctgggtggataattgtcaataaatgcctaaaatgcccttcaagtcatacaagagttgataattgtttgatcactagaagtttgaaaaaaatataaaagttttttgtgtacttaaccttcttacaaaataaataattttgtatctaagattttctttcatgtttttcttaaaaactatttttacatagtgtatgaaagagtattcacgtacaggtagccgtatcaggaaaaaaattgtatagcatgtgaatcatgatgtaaataaaagaacttaaacacaagactattttattagcataaaaaacataaattatatttttataaatttaatagatgtaaaatgaaattcttgaaatatacatacacctatatattatttacataaggaggttatgtaaaaattttcatattttttcggaaaatctagtaggtcaatcaattgtaacctcttgtaagtcctgaagggcattttgggatttttttaaaaaaagtatccaccctaatggcacactgtagaaaacaattaacatggtagataaagtcgatgctaaatcattgaactatagtaaactcagtggcatagagtggattctctcttaaacttttaagccaaagacatggtaagagtgttacgtcattgtgttgaaactgacggctctaagaggaagtgttttgaagcactttcatgtatctcatgcttccaaaaattttaaaattccaaaaggttaaatttacaacatttcataagagcctatttggtgaaaactcaaaaatccaaagtccaaaggttagcaaaatactttaaagtgtaaaagagctcttgtagtaaaaaagtatttaattaaaaatgaaaatgcatatttctaagatgttgccttcaccatgtttggcccaaagttgcatatgatgggtttagctaaatgagctgaacttcattatgaatattggcttaaattggtatttaactcatgtaagctctagatcaagtttagttttctatgtgatttgagtctctgagtgaaacttcttgtcttaaaaagcatgtaaaccacatttcttgctttcagtttgatagaaaaaattttttttttccaaataatattttgtgaaatgttcctcacaactcacaaatccaaaatcttggaattttgaaaggaaattttattgagaaaatcatggaattttgaaaggaaattttattgtttctcaatgctcttttggaagctcattttgtgtttccaaaatctgaaagctaggaatgctcgattgactacaactttgtgattttttgtgtatcatatttggttgagatatatgaggaattctccctaatgaaatttgtgcatctatttatgatcaatctccaagatttaccacaaagttttaaatcctatggactggacagtccagaatgaagctggattgttgtcataggctctccggacctcccattatatttgagagatgaagtgaataattcaagtcatcaaagaaacataatgaaacattcgacgcctcgagagaagaatattggagacattgctgggcttttagcctgccagtcaacttcagcctgagatgtgcccgtcaaaccactcgaaggcggcgaccagatgtgttacacattcaggagacttgacaaaaatggctaaagatctacaacatctcaaatattcttaacacatactcatgtgaatctacttcccaagatgtgcactagattcacactttcatcttaagcatggaaatacatagcaaaatacacttaagacgaaaataatctaaatcacaactacttcatagttacataggccgaccggcgaaataaagatatagaatagcgggaagcttgactacccaatcctcaagcacaccgactaggggtttaccccattaagttcaagtcctagaagaagcaatcgatcacccgcatcactcaaagactaaatctaaaacatgcaagcaaaagttaattcaacagcaagagtcagtacattattaaaaataatgtactggcaagtgccaagacaagcctaacaccctacttgcaaggcatataatcaaggaaggcatagtatggttctttttagcataaagcaagttttatttgcataaaacatttctaaatcagatttgctttcaaataaatttcagcaagctagtacttagcatatgggcatcaaataggcattaatcatgtataaatatacacctcattgccttccatggcagcaaggagatcattctcaaatctcatcacaatttgaaggtaaattttagcatttagaagaataaatacaagtctatactcaatacatatccacacgccgctcataaccacgagcacggctaatcgattagttttaactctgtagagtttgtacactttacccacatgatgcgaaataataatcatgcaagagcatggcacgcgatacataagtaccagatttattacccgcaacaaagcttttccaaaattcatgatttagccttacaccagcacgatacgtgttactccatcctaagccatacacgttatatgacctagaaccgttaagtggcgggcctaagccttaaacttaacgccgtggtggcggacacaacgggaactcacccacttggcacaataccgttgtattggacagacttagtcatctaaactaccacgtcggggtaaataggaagttcctctgagttatccgaactcatacacaccggcctaacagaatgtaaggctaaaccataaataatttactaagcttgggctatcccatactagcacatgtggttgtactgtatacgaaatgaactgacattgagtgaagtccgtacgtcggtttgggcgcactctccccctatcggtacacaactaatcaccatatgtgcaccacttgaggcccaaacctaaattccatgttttccaccattttatttatcaaaaacacaagtattaaagttctgtccagattatttcaaaatcaattttcatatttgtaatgagcccataatgacaaggaagaccattctaagcatggctaagcattatagtaacctagtgactccaaaattcatatataaagtggtatagtcatattgttcctaaggttaggaatgatggatatggatatatgtggggttaaggtgataatgcaaataataggagtttgtctaacaagtttaacacaattttaatttgttagtgtacaatcgacatgcaagatttggaaacattttcaataacctccaaaacataggttcaaagtgatcaaagagagggaggtggaacttgccttgaatcaggaaaatgtcagcacctaaatcacttattcactgtttaagcaatcatctatacaaagtacacgttatgcaattaaacaccgaaatatgcgaaaaatccaaaatgctctaaaatgcatgatttgtgcacagtggataagtgctggtataaaatgaatttaggtgaaataatttatattttatctcatttcatttgagagttatgaattttagaagtttcgtcggtatagtgtaggatttacttaggtactattgcgaaatgcttgtgaaatgctgttgtaagatgattcttattaagtttatgtttgctgaggtgaagatatgtgttttctaagactaacacatttggtttcataatttttagagttaatatgaattctttatgtattttacaagttataacgtgttataggtgtatagtgttctataggttcatggctttagaggtttaggtccagaacttgcctcatctagctagttatgtataatataagtcttttatttaactaatctaatcttagtttataaattttagagttcaaattactttacttcacattttataagctaggggatattctatgctagaaacttaatatatcaatctagagattattatatgagtaaagggtactaagttttggaggaaggggatggatcttatgccttcactggttcaacaagttttagttgggtttcattatagttagagtgtattcctatatacatttatatatacgtattgcttaatccttactatgtgattagcacctatcctatagatttaaagtttagagctataacctatacagaaggtgccatattttattttactatgttgaagctcaccatttgctggttctataaaaacttggttcactccatttggactaaagatgaattttctacaaattttacaaattaaaggctgctctatgttggttattacttacataaatatttagaggcttttattgtacagtaagcatatatttttattttataacttggaagtatatgttttggtgattctacagaacttgggtatactaaaaaggatctaagatgaattttatataaacttctaaagttcagcttatgtaaaactagttattttaaagataatagttttagaggcattatatttgatgtaaagtgtgtatatgttctattttactttgtttttaaagaacatgttggtggatctgtagaaactaagtttgctctaaaatgagttgttttcaatttgttatagattttacaagtttacatgtttttctgttgaaaatataaagctttaggcatttcatttagatttttccagaatttaaatagattgggtccacaggtcagtctcaggccaatatgcaaaaaggaccctagggtttcaggaaatcaacccgcagtcctgtgactgttctgtgtgtgaggtaggttttacaaactagtacctagagttttgattcttctcaacagaggtccttggtttgagcagacagagctagccatggccgagctcgttctcaagctcgccggtggcaaacggcggcagatctcggtgtgcaacataaggagaaaatgtaaaggggttcaaggcgaggctataggtggtattcttgcaagcattggtcatcggaattaatggcgacggcggcgcgagcggcggtggttctcgggtgacggtgcatgtggagctagagcattgatctagatgtttagctacatgcatgtgcctctatgggatcctaggatgcttaccgagcgtccaatgaaacttggcgaggtccagatagcgatgaccacgagcagaacgactcagcgacggcggggagcctcgggcaatgacgacgccggcttgatatggctgatgatcttccatgcatgcatacacacggtgttgaataggtctcaggaaagcttcatgcccgaggaattgaactgtgactcaccggagagggagaaatcgaaggtggagcttgacggccggaattggggaagacgatgccgatctccaagctcgctgcaccactgccaggggttcatgagggatttaagagaggacactgaggagatgttgatggtgcggtggctcggctcggcttcctccggttcgacggcaacgaagacgatgtcccgatggcggcgcccagtgcgcgctccagagcatcgtcggcgaggcttgcgttcccaccaaaccactgcatgaaatgggatgaaacttagagggatggaatcggcgtggagaggcgataatggaacgcaaaagaagaggaaacgaccgctgcacaatggcgatggtgacggccgtcgtcttcacggcaggcggcaaggtcgagatggaaaagaaaagccggagctctccccctcggtttgctcggctcaggagtggtaatggggaggaggcgatgcagctgggtggaggtgaagccttggttcggcgctgccacgtcgaggccacgcatcgacgccgtccagtgtaggtcggcgccctcggtctctctctcggctgtcactgtgttggatggaggatgcacagggtgtggttcaagccaaagaggctgccatgtgggcccaggtctatgtaagctaggtgggagtctgagggatgggtaagaaactgggtattgattgaattttggacgattttcatattaattctctccctccaactttacatctcaatattttaatgtgtgaagcatataaattagtgtgggtttttctgaaggtagatgaatgtagctagtttccattttctttgttgcacttaaaaatttagattgctcatagaaaattggggaagatgggctcaatagaactttgtttgaatttttagaagacctaaactaagaggataaattctagaaaaaatatatttattcatgataattgacctagtattttaataaattatttcccctatacactttcatgcagttaaatgcacattttagttatgtatggttttagctgattaagaactatatttaatctattatttgacaagtttgacttgtttatttaaggtatcaaatttagttattaaattgtaccaaaattatagtgagttgtatatgttaagtagagcctacataaattttcccatgattttatcttgcacgaattattttagaaaattagcaagacttatctcttatatgtgtttcccttttcctaaatgtatgtaaatgcttataaaagttttatttggactctttttaacctgaggtgatgttgatgttgatatgttagaattacagtttaccttacacaggtcataagctctttacctatttatgcataagtttactttaatattaaattaagaggatgcttatagagatgattaagatagaatataccctatatgggttaatttatttgttcactttcatgttcatgacatgtcttcaaatggatgaccaaattagttttgtgaggcttgacattagccatgttgatatattttaaggtgtatggttcctattttaacttcgtctagctagcactaggccctaatggtttagttgtttatcgttaatattcatgagacctattatgaaatgcaaataaaaaatccaaatgcatatgaaggactcaagtcaaacatggctatgagaatatgcatatgagagtatgcatgcttacacagacgtttacattttgtcctaggttataaatgaaaaggttttaatttgttctcaaattttattcatgcaagagttagatcaacttcacctaggtttaaaatggaaatttttggctctcaaaaatgtaaaggttagcttccaactattttgacatgaaaattttaaggtctagaattttgggtatgttacaattgttttactggcatcacggaagttccaatactgattggtatttgttacgattatagataaatcctaaagtggatggatatccctgtagcattcaacccatgagtattcaagagtattgttatttgttttttatagggaaagcggcggtgtaaaaaaatggaccgttataatcgtaatcctatgattaatataccatagtctaacagagataaatgataacacacaaaagaatcatttctataaagataaattagattaagataaactagattaagaggacagaagagagccatggtttcttatgtacttctatacttacgatggttagtctacacatacattcatatacatatagaagcttaggacttggtactatgcacctaggcactaccgagaccgctccctactggtctacagcatggttacggcatttcacaaactcttacatcataccaaacgcgaaggattacaaatgatgaatagggctgtcaccacctgctgcctacctctacaacccatggggcaccccacatcctgatgaggacataactagctcggatataaccatgactaccttatgtatttattaaataaaggtgcatatgttctacattaggtttacttgttatatatttgaataaacgttgctacacaatgagttttgtgtgttttcgtttgcagaagtacttgcttgggcgaaggaaagagaccgagcgtaactaatgcatggatgattaaataagttgattggggaccaaaccaagaccttcttcaagtctacttctacctcaccacgtcactattggtccatagaagacaagagatcaagttgtacacgttttggattcggattcgggcctcctgacagcatcaacttcaaacggacctagccactgatctagaaggaatttcgaggcccatgagtacttgttggaaagattatggagtctactttcaaatggttttggtcccatgtcaaaattcctaccgagctgccgggaatctgcaaaacaagccacgtatctcatccagtccgaatctgattttgagttttgagccttgtaattgtgtcatgggcttagctcaagggggtgtgcgccctagggcaaccctatgacgtccctaagcacatttattcagtagccgtcatcgtttagagtcgggttttgcttagattattctgtcaagaacagtttcgccgctagatcggtttgtagaaccccaaattcgagtgcttaatcattcatatgcaatttggttgcaatctatcctgttcttgcttgtgttcttcgattcgcatccagggattagccttctcggcgaggtcaaccgggttttggcacggttgataaccagaggagacgtggtgctgcgattgccgggctcagtagcgtgttcgttcggaagccggatcgagttgtgtcacgactccatcgaaatcgttgtttatcaatacctatcggaagatcgggacctaacccccccatcacatccaacggcatttaatcaacccaaatactatgcctactgttgacggtcgttatcgatcagtttcgaccgtcaatatcactaacaggagagaactagtgatgcttgcaatgcataaatatgttagaataataatattctactagtattaggtttactaaccttttgcagagaatgatcacaaagtagaggagaatcgacatcagcaccaatgataaatcaattggacgatgtcgagaatcagacttatgcatgaatgggccaagaactcagaattgacacgataaactgggccaaaattcataagtctgcggagaagagaagtctagtaggccaccagccaaattgtgggctggttgggccagcccaggttcggccgaacccatttctccatcgttggatgtggggtttggcagggactgtggagattatggataccccatacctacatgatatgtatatccgactgggtatggggtgccatgtataggtagaatatctttaaaaggactcgggttaaattctaaacttgaatgtcaaggaaatacccgcgatcctaatcggtaacgattgtattttatctataactacctattccgttagggatatggactgtattttgtaatacggaccccttcccctatataaggagcggtccgggtgcctcttggggcacgtttttcacccagatcatatgatcaataatacactcggcggatctatccccggacaggagtagggtattacttcttgattaaaaaggcctgaacctgtataaaattccttgtctctaaacccatccacttttccagcttgatagccaccccttttagtcttgccgaaatcttgtttcgacagttggcgtgccaggtaggggtagcatcaagttcttcgccgactagtgcaatgggttttgtttcgggcatcgacaacttcgtcttccctcccgggcaggcgttccggttcggcagcctcgacttcatcaccaacgacctcggcaagatttctctcatcgactcggattcgaaccagtcgggaagaggccagatcttcgccccgttcggtatcccgaactcggccgagatctaccccaagatcatctccaccgagtcggcttcaaaccacttggacgagatccaatctactccaacacagcccgatcaagacgatggggcctatccgccaatcctgatgaagctccccgatgatttggctgctgtcttcaccacaagggcgccttctccctgtagatctatatcacatcctgattttcgtttcaggatttataaattacttaataaattattattggaatttatattaaatgatctttaatttacaagtgaagttaaatgtgggaaataaaatttcctaaatataaagcatggatggatttaatttttattaaattctccatgattaagtcaactctctgaaatcctctcggatttttcggagctcaattcctaatttttaatcatacaaagagcatttcagtaattacccacatattaaattaatcattaaatggtctaattataattttgttaagtactttgagtgtccaagtattttcaggatttttcttgaaattatttgagcattggaagtatttttaacaattcaaagatcatttaagtgattattttaattggaaaagtaataaaatcctcctcctcagcttgggccattttcggcccattccttcctttccttcctctctcttccgccggcccagtccgagcctgcatcctctcttcttctatcagccaaagtctggtttatctccctcttctaatcaggctgagaaaagaaaagcccggcaagaagtctacattccctccctgcgctactgttcatcttccagctcaggcagagcccgtggtctcccgtgccgtgcacagtgccgccgattcccttccaaaatccgacctccccgttgctcctatttccaaattggttgcgggaatggaatcgtctcaatctcctcttacttttccccaagaaatacccaaaattttctatggaaatcctttccaatttcgcggatcaaatccttccttttccggcgagaaccctaaactttcccgagtttttcccgtcgttttgggcccggacccgagctcccatggctatataaaggaccccctagtcctcctctttcgtttgccccctctcccgtggtctcccgtgcctcgtagcgccgccgccacgtgctccaccccgccgtcgtcgccggccgagctccatccgcgccgcgccgccggcttcgttgttgccgccggtcgccgtcaccaccgttgtgttcgcaggagcaaggtgaagctcggccgctctctccccgctgtcgccggtcaccggagccccgtcgccgccgtcgaccgaagccgccgccgccacccacttcgtcgccggccgtcgtcgttcgtcgtttggttcgagggtgagtaccgttgggttcgtctcgtcgtcctctacgtgagcatgccttccaaatccgcagccggccgctctagctcccgcaagcttgccttccgagccggccaccattgatgaggtcatcgctgacgtcatcatcgttttttttttctttttcctgtttttctaatagattaaatcttcggaaattcataactaaatcatcgtaactcggttttgagtcgttcaagttgctaaattcatctaaaatcatgatctacatgtttgtttactttatatgtactgtttatttggtttttattagtctttttcttctttttgcgtgttagcttgtcgtttctgtcgttgcgaaggttcgtgagtgcgtcgggagtgttcagaagattaattgaagaccgattattgcaagacaagtcacatagatcctaaacacaatcctttgagcatgttgatcctatacttaaattctctatttatttcaactgtgcatttattttcgaatgtcattgggtggtgtgaatctattcctttgttatggccaatttgcattgattattctattccttgataccttgggttattataacttgactagttgggctatatatatattggttcagctagatattagatatgattgcttagctatgcttagaaacattagcacacttttgagataacttatgactcattgtttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcgctggggagtccatgcctctggtttttgagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgtggttatgggcgggttgagcaatgtttttcgtgattagtcccacacctctcacaataattatggatgttataactggtaacaatttgcttagctcctggtttggagttagatctgtacagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgctgagtatgtcatatgctcactttgcaataatcaatcaacctcagttgaagaaaaaggatccagaaggagaagacgtttggcttatatcccagttgagctgcctgtgggagtggagccggagcttcgctagattttattttccgctgcagttttcttcttagtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaatctaggcgggatccggcctctacctcgatccagcctagctccagggaagtcggcgtcatactctagcctctcggcacggtttcgacggaacaactggatggctacctcagctcccccggcgtcgactcacggccaacggagatcattgagtacgacgacttcggctaccgtagaccgcaacctcgacgacttcgactaagactttgaagataactacacgcctctctacttcggcatcttcatggctgaaaacgagacggaagaacagcgtaaagcccgagaagcagaagaacaacgcgtgcaacaggaagccgaacgaccctgactggaagaggagcgccaagcacaagagcgagaacggctgcagcgtgagcaacaggagtgcgaacgggctgcaaaagaggctgaggaccggcgacagcacgccttggatgtcgggcgacgagcacgagaacttatcgggcagcaagacgttgagggaacggctgtttttcgcacccctcaacagaacgcggttgcagcgatcaccctcctcgacaccctcctcaaggaagacgtactcaatcaagccaatcacgtcgtcaacatcttgaaccagaccaagatcatgatctctgccttggtcccggttaactctgcaagcgtccgcacgctgactggtagccgagttccccctcttcgatctcaagactatcaccaaccaagcctcagcgtcgtcggtgcgggatccagtcgcaggagtaagggtcacgacgagcgatctgtccactcgcctcctgaatgacacagggagcatcgagttgaacgacctcgctcctcatatcgcaggcgccccgtcgatcttcgcgatactatcaaccagcgctgcgcggcaagagaatacgcttcccaccattcactagatcgctacgacaacgacgtggatggagttgctgccttcacaagcaaattgcgtcgagtggattggccagccggcttcaagccgactggaatcgagaagtatgacggcaccactaacccggagtcttggctcaccatctacggtctcgctattcgcgcagcaggacgagatagcaaagtcatggcaaactatttgcctgtggccctagcggactctgcccggtcctggcttcacggcttaccccgtggcacaatcggatcttgggcagaacttcgcgaccacttcatcgccaacttccagggtacctttgaatgccctggtacacagtttgatctctataacgttgtttagaagtctggagaatcccttcgagattacatccgacgtttttccgagcaacgcaacaagatctccgacatcaccgacgacgtcatcatcgccgccttcaccaagggcatttgccatgatgacctagtcggcaagttcgggcgcaagcctcccaggacggtcaagcagaagatgtcattaccgcgtccaagcagtcgggcaccacttggaagccgaagaaagatacgccaactacaggggggagtggaagtaccaatcacaaggatcgcaagcgtaaacccaaggaacttgtggcaactactacaccatcctcccgacaacgttcacgggtcaacacttctgacaagatcatgaactcccaatgtccgcatcatccaaactccaatcacgcggccaaagattgcttcgtctataaacagtttgcagaacaatacgccaagaatgcacgcaaggcctctgacggagatcaaagcacgttaaagaaggatgatgaagttgacgccccgactggttttcaagaccatcgcaaggaactcaaccacatctttggcggacccctgtcctatgaatccaagagaaagcaaaagctaaccgaacgggagatcaacgctattcagcccgacacgccccaatatcttcggtggtcagagacaacaattatgtttgaccgcttggatcatccttaccgtgtggtccacccagggcggtaccccctggtactagacccagtggttcgcaacgtcaagcttcgcagatccctcatcgatggtggcagtgcactcaacatccttttcgtcaagactctggacgacatgcagatccctcgcatggaattaaagccgagtaatgcgccctttcacggagtcatctcagggctatctgctacaccactcagccagatcactcttcccattactttcggcacttgggagaacttccacacagagaacatttgttttgaggacagcgtatcacgccatactcggacgcccgatgttagccaagttcatggctgtcccgcactatacctacatgatgatgaagatgcctggtcctcaaggagtcatatccctgcggagtgacatcaagcaagccgtcacgtgtgacaaggaaagctgcgagatggcccagttccgcgagatcacgctcgaccgagaagaaatccgactggctgcgtccacagcaagcgaaggagaagtgcctgcgaccaagatgccaaagagcggggcaagcgacaccaagaccaagaagattcctctagatccttctgatcctactaagactgctgtaataggcgctgagttagattgtaaataggaaagcgcgctcatcacctttcttcaaaataataaagatatctttgcgtggaaaccatttgatatgcctggtattcctagagaggtgattgagcactctttacatgtcaaggaagacgctaaaccaatcaagcaacgactccgccgtttcgcataggataggaaggatgcgatcaaggtagaattgaccaagctgttagcagcgggcttcatcaaggaagtccttcatcccgactggctggccaacccagtcctggttcagaagaagacggggcaatggcgcatgtgtgttgattacaccgacctcaacaagtcttgtcccaaagatccttttgggttacctcgcattgaccaggtagttgactcaacggccggctgtgagctactcagttttttggattgctactcgggatatcatccgatccgactaaaggaatccggggtaccgagagagatgtcatcaatggggcagt

SEQ ID NO: 74508 - DNA, 2352 bp, Oryza sativa
  unsure (1)..(2352): unsure at all n locations
gacgatcaaggtcagttgaaatcgagccattttcatgctcccgtgcgcgttcctggttctttatttttgtctcttggactcttggtggatgaggtaactcgaagttgtttcggacgcggcaatcatcatgtgtaacagtgtaagtatgttgaaattctgtaaccacccagttgagagagaaattggcgagggatgaaatattaaattttgtaatatcccagcggggatagctcagttgggagagcgtcagactgaagatctgaaggtcgcgtgttcgatccacgctcaccgcatgttttcatttttaatgtatacgagttatttttttttttgctcatcgcatgttttcatttttactatatatacgagttatttttctcctcactagcatattttcatttttaatatactagttatttttctccttactcgcatattttcatttttaatatactacaaaaatgcatgatttgacaaaaaaaaactatgtcaatttaaatgataaaaaacaaaataaaggtcaaaaatcatatatagcattgaacctggttacacgagttatttttctccttactcgcatattttcatttttaataaactagaatttgattaaaaaaacaatgtcaatttaaacgacaaaattaataacaaaaaaagtaaaaaaaaacatatatagcatttaacctgattacacacgtgacgccgagtagagatgcatggaatggtgttggttgtctgggttgggctgggttgggatagggaggggttgcgttggtataatcggatagaagtgtatgatactccctccgtcccataatataaaagattttgagtttttgcttgtaacatttgacccctcgtcttattcaaaatattttaaaattattatttattttatttgtgacttactttattatctatggtactttaagcacaacttttcgttttttatatttgcaaaaaaaatttaaataagangagtggtcaaacgttgcaagcaaaaactcaaaattccttatattatgggacggagggagtagttattagtcatgttgaattggatacagacaacatataacaaacttaaacataaataacgtatcaaaattctggttgaaacatcttcaatttttataatagtgatacgagttattttttttctcattttattatttttacaattttagtatatgagagatttcttggttgctttccttctcttcaggtttttctccgcccctagagcgagtacaatagcagggtacaagtcaactgtatgcacgcatgttgagaagagaagagaagagagagaagaaaagcgggctacagatttatagccaactgcagcacagactcccatacgttgtttgtgtatgagagatggaaccatatattaatggtgtagtatatattatagataactattatatgaatgagttataagattgactatagatgaattagagctagcagttagctacactattaaacttgctcttggccgccgccgctctataacgttaaggtacatacgtacaccggcgaaaacgttaaggtacatacgtacatgttttccctgttcacaatcgcattccgtttagatacaccagcgaaaacgttaagatacaacggcgcgtgagaggagctaagtttatggcagccgcagaacttccccttccctttttccgcacttgtaactttgtaagcttctggtcagaatgtcagatcctcttggttaagatatttgaatcgagccttttccagatttacttgcgccttctgtaacctataaagctatctaatttcaccatctttgcaatcaaattctcgattttgtcactggcgcctcgcctacaagggttcgggatggtcccttgcaagatatttattttagaggaataggggaggaaccccctaacatggtataataattgatgaccagaaatgaaaatagatcaaaggtttccacgctccttcaaagcgatatttgggcttgtaaagtctgaactcggttgtgcttgcttatgaaggtaagaaagatgacgcttgcttgaccaaacagggcatccgctgacataatcacattgcatttcatgctgctttcaactaattccatatggatgtggatttcctaggtcaataaaagatagctgcatttgttttctcagtaactcatgaattgaatccatagtttcatactagttcagatattagaatttgcacaacatcatgttttatggaccactaaagttttaggtatagttaaggccacttcactattttcttttatgttatgcaatcatggcctttggtgttggttcatgatcccacaggaagtgatttcagtatagg

SEQ ID NO: 74509 - DNA, 772 bp, Oryza sativa
aaaggctacatatatccgatacgatgtggccgagttaaaaaaatatcattctctaaaataaaaggctataacttaatttgtgagtaattatagcataatcttgtgaatcataatatatactaaaatgttaatcatgagactgatcacaggctcacgaatcacactacatgtaatgagtttaacgagctaactcggacattttaacgggtcaagttaagtttcaattcgttcccaacttattgtgttaatgagtcgagccgaacaaactcgttaacttaacaagtttttacgaattacttcctccgtttcaagttataaagctttcacattgcccatatatatatatatatatatatatatatatatatatatatatatatatatatatatatatatatatatatatatatatatatatatatatatatatatatagagagagagagagagagagagagacctatacctattaacaaaacaactaaaatttaactttatttcacaatccatgattacatacctaactaattatatgtatggatgctatatacctagaatcaaaatctaacaaaaacaagttcaaattcagtataaacatgctttgaactagttagtaaagtacttaatgttaatacctaagtaattgaaaaagtttcatactcatttgaattgggtatatactcaatttcaacaatgatgcccgggcaccatggagcaccaaacaaatttaatatatatatatatatatatatatatatagggctgcaggaat

SEQ ID NO: 74510 - DNA, 22572 bp, Oryza sativa
ctattcatattatttaaaaaattatataaaattacatttttacttgttttattattaaagaaattttaggtatgacttatactttagcatatatatttacactaaatttttaatttttaaataagataagtggttaaacgttattctaaaaatcaacgccgttatttatttagaaaatagaggttatacactccaacattattgattaatcatcataatctctgtatgtggagtgtgctcaactcgtcaattcccatcgtcgtcaagccatgagcccatgactgcatgcctagtgtgaacacataagatgaacgacgacccgatcagatcacttctctcccgcggggaccggggtcccagtccaacttgcacatgtacactacacgtaggcttgccattttgacttgttgaccggtcaaacatcaccatgcattttgacacaccatttcactctcaaggtttacgcgtacatgaaatacatgtaaagacaactataaaatgcaagagctctcgtgatcgagatcaagatcaaccacacaccaatccactctaacacctacgagctccgagctgcagccatggccatgaccttgccgtcaccgacatcgccgtcgttctacgtgtcgtcctccccgcgccaccagccgggcctgctcctccccctcccgtcgccgtcctcctccgaccggcgccgcccgatgcagctcgccgtcgcggcagcaatggacactactccgagacaaggcggagtgctcctggagatgaggcctagaggaggaggtgggggagctccccggaggccggcgccgccggccggtccgagagaagggcgcggcggagtggtggtcgtccatgcggtggcgagggacgctcctccggagacaggctctggcccaaagatccattgattcacaagaaatacaagatcgtcaagagcaagattaactgaacgttgttagggaacaaattagtttctgaacttaatatcttcgttttttaatatatgatgtcgatgatttgtacattatgtatgagcatttgttttaccttaattaagatgccatgcatttctgttacatttttgcgaacgattttggaagagttattcattatatgggtatgatgcacatgtctgaattaattaatgcaatcaagctatcatcaattatatatgatgcacattgtatttcttaattacaccttttgtacctctcacatactgtcacacatggtccatcgccaaacacatcacaaagatatataaattgatactaccatttgcgatcattcatgcatatgccaagttgaattaaaaggacgtatattattttaccatcattaattcagtattttaatctgatataacaaatcgcaacttgtttgatatagagcgtgcatcagtacagcagcaaaaggttgacgtgcaatttgccttagcatatcacaacattaatcctatatacctatacaaatcatccctactactagaattctctgcttcctggtgcttccacgtcaccccattttcttcccaccgttcgatctcaatcaagcggtcgcatcgctcctctcctctcccacatctcgctgcttcaccggccccacgcgcatcaacccctctctcccgcatcgctcctctcctctcctctcccctcgcacgctcgcatcgattccctctcccgcatctcgctctgccgcccccttcgtatcaatctcgccgtgatcctctccatctcccgcatcgtgctcgcccgtaccggcgctggcatgtcatccgcctcccgtgccacacagaggcaggatgagggtgtggcgcttcccctcccgtcgcccccatggcggctcgtgcgctgcttccccttcctctcccatgtctaaggttgtttgcctctttaggttgccatgattaatgaaaaccgtccacaaccaccgaggaaaacacttcacggctgttatcaagtaaatccattaatggcttaatgcgttttcttctcctcttatccctttatcagttctgcatctatatccaatttatcatctcgcttattcgtcgatctaccacactctaccaggctactggcgttttactaccgttcttgcaactctgcttgctggattcatatgcagccctcacctagttgatcctctccaattacttcaatgatctaacacaggttacctaccgatttcccctttccttatgttcaataaatctgatacccagcagagaattttattgttgttgtatcctctttttccaggttttaggttcttggctactgatttagttgattcatattctttatttatcctgaattatagaccacttctcattcttaagtggttgaagacgtggcaaatatgcatctattggttgatttgtcgtcacccgatcagatctaagaactcatcgagctaagtaacaatcatatgggctgctaagcggatggagctttcttcttttggtattttaattatggtctttaactggtgaagctatatatatctcggtacatctatgacgttgatgtgcttttcacttttgataaggtcctcatcaagaatgatgtcagattctccacacacagacacacaggtttgctcttaaatagattaggttgtcttccgtctcaaagttcattttattttctgatcatgtatactctagatatgttttttaagtatcttttgtcactcttgaattagcttggtgatataaatatttttggagttttctgaaagctaaaatcactccaaagagttaatcaaggatgagtacttaattatatatacgaggtaataatccttttcccaacttcccatatcttactcaagcatgaaaattttctaccattattatataatagtttgacaccttagttatgatttccttgctatcagtgataattggactatatttgtagatgtttaaaaatataaaatattgatgtttcagttatggttattatcagttttgtaattgtaaagtagtcatcactcatcacctaggtttgctacatgacttgactacattcctgatcagctatgcaactacaaatgcgctcctaatgttcatcgcatatttatacgataagatatgcataataattgctacttccagttaaataaacatttcttaccacaattatatatgatattctagcaccttatccatgaatcaattggcattcatttgcaagattaactacagaatttccaaaactgagatcaatgggtcaacgagggaagcggtactaggaaaaatgtcatgctgaataaaggctatcaagttaacgaggacagcagtatgacaccttacttacttttctactgttatttttcatacatgctatgttcataaacacatagtacataattttgggtaattttattgatggtgtatatttttcattttccagtaatgtttagtggccttcaattttgtttattaatacttgctctatccggtcaaaagccatatatttgagttgtaattctgttagttgcattggccaaccactgctacctggggagatactccatcatgtaatatttagttataattaccactgtatatactccatcaattatatggtaataagtagtttttttcttttttcttctcaaatgttatgcacatattgcatgtttaaaagttatttattatgtccgcagcaacgcgcggggtattatctagttaatcatcaacttgaccgatcgaccgagacagcagcaacatatatatcagatcaatccagggtcgagtcaattgcaagcaacgcgaagtcaaacgacaaatcgaaatgcatgtctcatatatatatcacaattaaataggagtaaattacgttcagggtaagaacttaggattttttttttaccatatgtatcagccggacacagcattccatatattttccacaaagttccaccgtacggtgaacgtaatttacttattaaatagtcataaacaattctagaaacatttaataacatatattataatgtcaaatatcgctccataagcatataaaaaactaaattttcaataatctatgtaatataagaaagggaaaattttggtaacaaatagaatctatccataacaagatttttttttgatagacttaatattttgcaagtagataagaaactatttatataagtattttcttttttaagggatttcttataacaatttgattgatacatttgaggagtaaaatcgaaacaaacgagcgctctcatgcgaatcccaagtcagagcatttctcattttactatattcttaattgaataattttagctcctgcagtcaaaaataataattttaattctaaagtaatacgccctccgtcctaaaatataagtatttttagtatagtgacaagtcaaacatttccaactttgactattaatagcaaaaaagtaaaaaagatcaatcatgtaaaattgatgttactagctagatttatcattaaacaaaatatcataatatgtaactctttttatttaaacatcttacttttatagatattgttggtcaaagtagcatatggtagaccatatcagagtctaaaaatacttatattttgggacggagggagtactaagatagcccagagaaatttgctccgtgcatatatagatgtccatatatcccattgaagtgggttatttttttcactcgagtgatgtacaattgtttcatgcatgccatccacaaaatcataaaataatttgagaaaaaataggtagctggatatataggtgaatatttgatatacacattcacaaacatgcccccagcaaaaataattcacaaacatgaaattttcaaatttaacttatacaagtggataaaatatttctagttgtataaaattgaatttgatcgtgcatatttgtgaatgacgacatatcacacatatattacctgatctatcttatgaaattgttttaattttttaagaccttttctaagtgacatatattaaacgagtgtacatctacttagggaaaactcttttaatcgcccgggtggatgtccacctgtttattacatagcatctaaatagttatgaaaaatttgataagatagatcaatatgaaatatatcactccacaaatatataagttcaaattcaacttcaacaaattgtaataaaaataacaaataaaactcaaattagtataggtatgttttcatttaaatttgttatttttgttacaactcgtagaagttaaatttgaacttacatatttatggagtgatatattacaaatattgaactatcttatcatttttttaaaaaaaatcataaccatttaacatgcaataagcaagtggatgtccgctgagtgattagaatccatcttcatctacttagtgacaaaaagaattttccagtgatacagtgggagctagacgtactactggtacattgaaacagatgtagaacatttgtacacacatacacaaatataattaaggtgtgtgcccattgtgtattactagtattactacttctctgatcatggagacagtcatatacttacacacgtactatgccatacacaattaacaacacatcacaattaattttaatccatgaccagatcaactcatcatgtatcggtcaagtccaacactgtgaatacacacgtacggaccaacaaaaatccattgaccacttcctctctctcttcgtcaacaccagtgcccagctactgttcggtcaaacgccacggttagcttagctcacctgaccatttcgccgccgcggcgtgtcgtggcgcgtggcgtggcgtcgccggctacaaatacggcagatcactcgacaacatttcatatcctcatccatccatccaggagcatccactgggcattagctcgaagctcgggactcgccgcgacgacgcgatcgatcggacatcggagtgagcgagttagtaggtgactaggtgttcgatcaccgtgcctggtggctgtggtcgatctaactagctagctagctcgatcgatcgccggaattaatggcagccatggcgtcgccgacctcgccgtcgtcgttcctcccggcgcacctcctgcggccccacgccgcgtcgctcgccggcgcaaacgtgttggtgagggacgctccgcctgagacaggcgggggcccgcaccacaacgccgtcctccgacagccgccggtgatgttggcggcggcggcgggcactccggagcaaggcagtggcccacactacaacgcggtcacgcagtggaagcccaggggaggagatcaactccgactgcccgcgtcgccgccggtgatcttggcggcggcgagcactccggagcaaggcaacggccccaagaccaacgccgtcctcaggcggccaacgccgcccggtggcgccggacctagagaaggcagcggcggacgcggcggagtgatccacgccgtcgccgactccgcgccgcagaggccaggcgcgccggcggagggcgccggcggcaatggtggagctgtccatgtcgcccctgctgctgctgcctcttcttgagtagaaagctaatgaaaaacgcacaaaattaaattaagatctgattaatttccaaaattaaagtaagattttctagaggtagctagattactgtatatgatattatgatgtagtggtagtacgtacatgtacatgtctgagttgaagttcagataaaaatgtctgaacttcagttggaaatgaagggaataaaatcaagcagattatataaaatcaagcagattaccaaatatcatgccttgcatatactcctattcaagttcctttctactttgattttgtaatatattatagttcagatctttgtgcatgaaaccctgtaattaaaacgagctctaaagcctacactagtgctatacataatactttttcgaaacaagttgcataagatagtgcgacgtttctattatatagttggaaaaaaaatacaagtccatggtcttggaagtctatagtcaggaaaaagaaaaagacaatcacatcatacgtatacgtatgatcctactgctagaaatagaacaaacagacaacacccataaggaatgggtcttctgaacgacgccaatgcacgagcaccgtccgcctccatccgtcctaaagaaccaggacttggttttcacctaaataacccattaggagtaataagctgttatacataatacatttgtaacaaactgtttgatatacatcatgagtaaattggcaccaggatatattggaccatacaaaattcaagctagacgtgaagaagttgcatatcagttggaattactagaagaatttgcaggtatacatctagtatttcatgtatcacaattaaggaagtgtctcagaaaaccaacaaatcaagttccactacaagaactagaactacaaccagacctaaaatatgaagaaatgcctgaacggattttagagacagatgaaagaagacccaggaatagaagtactacattttgttgagttcaatggaaaaatcacactgaagatgaagctacttgggaaaaacggttggaattgtagcgtgatttttcagaactattcttcctttgagctgaatctcggggaagtgattctctttatggggggtaggtctgcaacatactcaaaaatttcaaatttttgaagaaaatttatcgcgacgattttttcatttggctcttattgaattttactaaattggagcattttattttttttattcttttcaaatttatatcttaaaataaatacctttcgttttattttaaaaaatatatcaaacctcttgatactctgaaaatcttatttaaattttcttgccaaagttcaaaaattcctcaaacttctccctttagattccatctcctttgaatcctattcaaaaatcaaaaccctccacacaaaatccctaaaggttcctatttgttagggccgaatttcagtctatttggcccattccttctttcttcctctccactccactccctcctcctcaggccgccagcccacctagagtgtggcccagccgagccggcccaatcaagagcggcccagccgggcccgcgaggtcacctcctctctctcctatgggcgccgccgccgccgccaccgcgccaccacgggcgccgccacagcccagccaatcccgcgctccgccgccgccgccgcgccacccccgcgccgcaaccacgcctccaccgccgcaaaccgggtcaccccgtggcgcccccacagccaccgccgccggctccatttccgcggccgccgccgctgcccaccgttctcgccgccgccgcacgacgccgcgccacctcccgagccgcgtgtcgccgccgaccaccgaacctccatcgccggccaatccgacgaggacacccggcgccgccatccgtatcccgagccgacgccgcggcgtgccgtcgccggctacaaataccgcagctcaccggacaacatttcatatcctcatcaaccgcatccgcatccatccatctatccacctcgctcgaagctcgattgtcgcaactcgccgcgacgtgatcatcggacatcagactgagttagtctcgtaggtgttcgatcgatcgccgggatggcatcagccttggcgccgttcctgatccccgcacacctcctgcagccccacgccgcgtcggcgtcttccggcctgcagctcgccggcgcaaacgtgttgctgagggacgacgctccgcccgagggaggccgaggcccgcaccacaatgccgtcctcctcccacagccgccggtgatgttggcggcggcggcgggcactccggagcaaggcaacggccccaagatcaacgccgtcctcaggcggcccacgccgcccggtggcgccggacctagagaaggcagcggcggacgcggcggagtgatccacgccatcgccgactccgcgccgcagaggccaggcgcgccggcggagggcgccggcggcaatggtggagatgtccatgtcgctcctgctgctgctacctcttcttgagtgcaaaactaattaaagacgcgcaaaattaaattaagatgtgattaatttaccaaatccgaggcttgtttgacaggttacagtaaatacatagattcataattttgtaagattttctagaggtagctagattactgtatatgatattatgtagtagcacgtacatgtacatgtgtgagttgaagttcagataaaagtgtctgaatttcagttcgaaatgaagggaataaagtcaaacagattacaaaatgttatgccttgcatatactcctattcaagttcctttctactttcattttgtaatattaatattatcattttttttcaaaaaatatctatctattatattattaaaacagtcttgaaagaaagaaatatgttcgctgtggaggctagaaattcccacattaatcgaagaaaaagaaatgaacagttcaaatagagtacaatttagaaatatcaaaaattcgaaattaaaaataagtagtattagaagaagagtccttattgaaccaaatacgagattaattaaaattcagaattaaaaataaaataaattctgaaattagaaaagggaaaaaagagttcaagtagaaatagaagttagaaatatctaaaattcggaattaaaaataattaatatatgaagaagagtccttatagaactgaataagagaataattgaaatttagaataaaaataaaataaatttcgaaaatagaaaaataattataagagttcaagtagaaatacactttataaataaaaaaatatcagaataaaaaaatatggaatttttttttaaaaaaattaatcaatctagaactcaacgacaacaaataacagtaaaagaggacaagtaataggcatgtaaatcagtaaggtggtgaagggttgatgggacatctaaaaattataaacaaaaccagaaatagaaccccaaggatgattaagaggtggaatgacagacaggacattaagcagcatagtcatgacagttggcgggacttctataaagtaaaaaaataaatcgaaataacaatcatgttttatttttaaaatctcaatgataataaataggggagacaacgggcagaccatacaggagtatagtggtgtgaagccgctcttctagaaattaaaaaaatgaatccttaaaattcgaaataaagaataaaataaattttgaagatagaaaaataattctaagattttaagtaggaatacactttatagataagaaaatatcggaatgaaaaatatggaattttcaaaaaaaaaaattaaagtccatgtagacctcaacgatgacagataataataaagaggggagaaacattaggcccgtaaaggagtaagttggtggccgttgatgtgacatctaaaaactataaatgaaaccacaaatataatcccaatgatgattttcttttactgaaataatcccaatgatgattaagaggaggaacgatagacaagccgttaagcagcacggtcacaatggttggcgggacttctagaaagtaaaaagtaaatcgcaatgacaatcatgttcgatttttcaaatctcaatgataataaaaatacatgagtatagtatggcgaagccgacggcggttgggcagatttctacaaagtaaaaagatgaaccctaacgataattatgttcaatttttaaaatcctatcaacaattaatatgggagacaataagcggatcatagagaaatacaatattgacgtttgacaacactcctaaaaattataataacagaacgtgacgagacaatggactctaaaaagtagaaggtgtattttttaaggtttaatggaagataaataaaagccgtgatatagatcgggtaaacaaataaaggggtgataaaagagcaagagttaacgactggtgtgacttttaaataaaaactataaaaatttaaggatgataaggttcggtcttttaaggttataagacaacataatggctatttaataaattttaagtaatttcaaatatagaaaaatagataattttacatgtgtgctagcttttgcgcggatcacccagctagtttagaaatatttgaatgatatacaaacaccaagagacatctcttgagaatttaaggccgttctatatgtactccaaccgcaaacttcaatttactcgtttttcgttagcacgtttcctagactgctaaacgttttctgttgcaaaagaaaaaatatgtagaagttgttaaaaaatcaaaatttcaaatttacaataattaatatttaattaattatgtgctaatgagttttctcttttcgttttgtgtgccctgcaaatattcttggtgaaacaaacgaagccaaatccgttccgataaccccaaaactcgcactttcgttgcacattaactaaaacacaatttttaagtcacatgccgttgccgttgccgttgccgggccgcttctccggcgttttcctcagttcaccacatgccacctcctgcagctggtcctatacccttactgcaggtctgcagctgcagctccgccatcattcttcttcttcttcttcttccttctttttcttcttcttccagcagctcatgccggcatcagcagcgtccccatcaccaccaagaacagcagcatgctagtcttcgtgtccagctccggcggcacccatgggcagggcaaggaggcggcgagtgcgcaggagggcagagccggcgaagttgctggcagcggcgagagcgagacagaggcatgccgcgccgaccaaggcccgctcggcggctgcaagtagaggccgaggcggcgggataggaggaggagggagaccgcgacggcggcggcatctgttgagcggttaaggtggtggcatgactgtcacacacactccaagccgagacgtgcgggacggattcaacatcaaataactttgatttgatctaacctcttaaagacgttataactggaaccaaatttcttatagtcaaataacatacttagggcatatttagcagagcttgaactcataaatttaacaccatgagttgagtctggagtagagttatggagctgcctaaacctagatccacctcgttagtttattttgtgagagtgctccacccaactacactcccattctaggtggagctgaaattatttagctagactacagctctagtagagctgtagaggtagagttagagctgtgccaaactgactcttcgtacttacggtgacaccatgaaaacgagagtgaaaacactgacatgtatataatacatacggtgtgtccactgtccactccatggtgtattactgcttctctgatcgagacactgatgcacttcagcacttcgcaatcgatgactagatcaaacacgtacgatcaccacatgtaaatcggtcaagtccaacactgtgaatacacacgtacggacgaacaaaaatccattgaccacttcctctctctcttcgtcaacaccactcactagctactgtccggtcaaacaccacacacctgaccgtttcgccgccgcggccacgcccacacgcggcgtcgccggctacaaataccgcagctcaccggacaacatttcatcgtcgatcatcaaccgcatcagcatccatccatccatccatccgccgcgctcgaagctcgattatcgcaactcgccgcgacgtgatcatcggacatcagactgatcgccggaattaatggcatcagccttggcatcgccgacctcgccgtcgttcctcccggctcacctcctgcggccccacgccgcgtcgtcgtcttccggcctgcagctcgccggcgcaaaagtgttggtgagggacgctccgcccgagacaggcggaggcccgcaccacaatgccatcctcctccgacagccgccggtgatgctggcggcggcggcgggcattccggagcaaggcagtggcccacaccacaacgcggtcccgcagtggaagcccaggggaggaggagaactccgactgcccgcgtcgccgccggtgatcttggcggcggcgggcaccactccggagagaggcaacggctccaagaccaacgccgtcctcaggcggcccacgccgcccggtggcgccggacctagagaaggccgcggcggacgcggcggcgtgatccacgccgtcgccgactccgcgccgcagaggccaggctcgccggcggagggcgccggcggcaatggtggagctgtccatgccgctcctgctgctgctgctgctgccgcctcttcttgagcacaaaactaatgaaaaacgcacaaaattaaatcaaattaaattaagatgtgattacaaagattcgtaattttgtaagattttgtagctagattactgtatgtgatgtagtagtacgtgtacatgtacatgtgtgagttgaggttcagataaaaatgtctgaatttcaaattatgtgaataaaatcaagcagattatcaaaagttggtcttgcatattcaagttccatctttctactttcattttatatatatcagctcagatcctgtgcgtgaatccttgtaattgggaaagaatttttgtcactcgaatagacacacaattatttcatacgtgctatctaaaagtcattgaaaagtttttaaaaaattgataacatagctcaatacgtatactaaattgttaaccgtggtttaccccagagttagctgtttgctatacacgagtaaattaataatatattaaacccagtttggtcacatatacagttcgattattatgcttgaaaaattgtttcacacttttactagtaccaattcaacatgatttgctgttaataccacattctgttcatgatcaactgctctctagttgacctgaagtcaatgttcacacttgtcgtcttggtcttcatctcctaggtgttgcaacttgtatcactggcttctttgcagtaacgaccggttcagtttgatggatatataaaatctcggacattgtactattataatctgcatccacttcaattctcggattatctgtggtcccccaatttcattctttctgttacatgaacatagtaaaacgtagtcgcagtttcccgattttgagatgttgtatagcatggggtaggaaaaaaaggaaatgctacgggttaccgcacacacttggactatgttcttcgttcaaggatcacaatctcatctttctcctttttagcatgtacgcttcccaaaatgttaaacggtgtgtttttttacgaaagtttctatataaaagttgttggaaaaaatatattaattcattttttaattttaagttgatacttaattaatcatgttttaattcattgctccactttgaatgcaaagagtaggggttcccaactcctccaaaataacacagccttagctaccagtacatctttgttttttttaaaaaaaaatccatgagctctgcaacaatcgtgttctcactaaaacctggcacttagtaaataactaacaattgtgaagtaagtgtagctccattgcgtttccagtggtgaaacatatccatccgagttcacgttctagacttaacagttggcacgagtgctcgtatttatggttaattatttttaagtggtagatgacgttcctttcggagatgttcacaggagtgtgtgggcaatatacccctcgacaatgaagatctccacaacaaggtgatgcccagtctttagagatatgctcacgcgcatgtggtaactttgtaaatacgtggtctttggaagtgtttatatgaatgagtgtacgcacgtttatacgagcttctctatctcactgtactgtattccaaaaaaaaagtatagtaccaagtatatgagcatggtatgatgacttaattaaccttaaaccttacttttttttagataatagaataaatcacagcatttgcttcaaagaagctattgctaattattacaaaattcgctcaacaaatagcacaaaccatcctctcaaagaagagcacaaattatcctctcaacaaagagcaccaaagagcaataaaagatgcacaaacaaatgacctccaacataagacaaaaatccaatattattggaacctatttgtaaatctccatccattgacgaaaatctgcataatcattgactctagattacgacatgcaacatacatgagttcactgctatcatcaaatctctgtagttgtgtccaaatccagagcaagtgcgttaccctgaaaattacttgcatatatgatttagacggggatttatcaaacatcatattatttctactaaaccatagagcctaacatatagcagatgcttctacaatgataagttttttttagtttttcatcaattcccacaagccaattctcaataaatgagatatactatgtggatgatatagaccaaaagaaatatatattgatctccaaagtaatctagcaaaaatgacattcaaaaaaaataaatgatgaatcgtctcatttttcataaaaaaaacatcttatgctaccattttaattccttctcatcaaattagttagaactactcctttaaaaaaagcacataaaaatcttaattttaagaggtattttaagttttcagatagtctttttcttgttgatatggttattatatactctacataaataaaacgaattgaccattttgatagaaattccatttgaatatatcattttctttgatcaaatcttactaggttttgtggaatatatagtattactgttatatatcctttcgtcttaaaaaaacttaattccaacaataatcctgaacacatgcgtgtatatattcattgcgagaattgttttttttttatggagtagtattacctaacgaccaggcaaaaaaaatgctacattggcctactaacacgaatgacctggacttgggtcgttgggaaaaaaacaaatattgctttatcaaaaataaaataaacacgctttaaataattaactaattactcataattaattaattgcgaaaacatatagtattatatgacgacgactggagtggactgactattgatctgtttacataagagtagcagagcgagatagagtgatcagtgcagcagcagcagctagctctcttctcctccagcgactagctagcttagcttagctaggagcctaggatatggcagccatggcctccttcatggcactggccggcgcgtgccgccgccggccgcagctcctccggccatcggcggctcgccgcctcagcttcgtcttcctcagtcgtccatttcctcctgctcctgcacccttgttgcagctgatccagcggcagcgccatcgttcttcttcttcttccagcatctcggagaacggtgcggcagcgccggtgaccgagaatctgcaggcggcggcggcgaggcggcggaggcaatcggccggcggccgcccggcagctccgaggggaggccgcggcggcggcggcgtgagaccgacgccgcccggtaacccgagagaagcgcagaagggcggcggggtgatccacgcggtggcgccgccaccggcagcgccgacgagcagcaagcctaagcctgagccgccgggctacccgagggaaggcggcggcggcaatggcggagtcgtcgacgatgtttctccttcttctaccgatacctcgacgtcttcttcttcttcctcctcctcttgaggatcgagagattgaaaaaagagtgaagaagaagctatgaattgctactgcaacatctccattgatcgattggattgcttagctttgctgctgctcgtttaatttcctctgtttatgtttagcactggattaattagttgcaagtagttcaagttcaggatatatataatttgggttgctgcatatttgcaaattgtaagttaatttgtaacatgtagtgtttgtataattgtattgtatggtgtatatatatatatttgtactctactcgatcgattagaagaagatttaatttagtgatatcgttctaatgagcaggccataactgcaattaatgttcagcttgattcatctacgacctgaactggataatcttatcgttacttttgaacaggcaggcgtagctagtcagtacactcattgttagttggtgcagttgagcaaatgacaagagagatagatacatatacatagtactagtagttagtaatgtgcattaggtactcagtactaagtctggatgattcttgagcaaacagatgagacaaacaggtagggcaagatgtgaggtacatgaagctaattaacaagtaccctctccggcccacggtcaagattcgtattgctaagttgctgtttaatctaattttagtttgctatggccgtgtttagttattttggtaaaaaaaatttgacatatacggacacacatttgaagtattaaatgtagactaataacaaaataaattacatattccgcctgtaaattgcgagacaaatctattaagcctaattaatctatcattagcaaatgtttactgtagcaccacattgtcaaaccatgtcgtaattaggctcaaaagattcgtctcacaatttacatgcaaattgtgtaattggttttttttctacatttaatgcttcatacatgtgtccaaatatttgatgtgacgaaaaagttaaaaattcgaagggactatatttcaaaatgatacgagtaattaactataagcacatatatcatatcccactggtccgttccagcagacaagagcagtactgaagccttgccaggtcatgcatgtactactcatcaagccaaactatgatatactcatgatataagagattttaagttttttttatattgtttgaccactcgtctttttcaaaaaagcttaaagtactttggataataaaataagtcaaaaaaataaataataattctaaatttttttttgaataaaacgagtggtcaaacagtgtatgaaaaaactcaaattcgcttatattatgagacggagggagtatattcgtgtaaataatctggcaatgcaatgctaactacgagttggtggcaatcgaaatcgagttggtagcttaggtttcaatgcaggagagagcagtagtaaatcgaggtaggtgagagtgatcggcaacaggagcaggttttagtaattaaattcgtccaagctctttataggctgctagtgtttgtctgcatcgttttggctttcatctgcatgcatgctcagctcagctccatttcgattcatttaatttcttgagtttggagagcaggtggagagttttcaagacgagataggcagcagagacctcggacgactgtttgattttgatttttttagccaattattatcgttaattgtctatttgattattatatgaaataaatttagatgttttttttcgaaaattcatttcttttaccgaattttaaaaatagacttaacagaacaatttaaaacaagtcgtctaaaagcttttctttacaagaaaacatggttttcaaaacgtgatgtaaatgatccatttctaataatccaacgaataagctgaaaagatcggcaatgcatatatggctcaaatgacggcagtttgcgtacgtttgtatgcgcccttggacactaaggttgattaattaattgcatgccagcaacacttattatcaagaactttttcgcgttgatcatgtaattgctcagtttgaccaatcgttaatgggatcttcaatatgacagtaacagtttgtgcatgtgagtatcaagttgatgagggcaattagcagaatcaatacgtgctttcaacgtaattttagtagtggctagattgtttgtctcttacaatatatgtgaatagacgcatttgtaacaacatggatatggtgttacgtgtatagtagtgacggagacagtgccctatcaccacgaacgggtgcccgcgctccatgcatgccacaacacactactcccaaggtatatgcagcgttatgtaccttgcatacttgcctcataggttctaattaatggagattaattagatgataaatcagaaaacgagaaagcaagggccaaaccatcaagctgtagccataaaaaacatcaaaggccaaataggttcaaaacaatataacttactagcacctagcacctatgctcaatataatactagccttaaaatctaatttatctgcaataacattaatcttatccaggcatcagaaaatttctagatccgtaacgggtgtgcagtggtgtttgcgcgagtacgtgtgccgtgtaatcttagaagataaaaaagaatcaacgtgcaaggcaggggcattattggcaaatccaccttcaaattgtcctggactaaagcagtagagcagcagagagctcacctccctctcattatcaaagagagatatggaggaggaagacgacgagaaggttgtgaagaagagcagcgctagcggcggcctgcacggcgaagagcaggtcgatggcggacatgtcgtcacggcggagacggagatggcggcggcggctgcaccgtcgcggcagccgcagagcattctcatccgtgccttcgccggctgcctgctcgcgctgtgtggcggcggcggcggcgatccctccgatccgccgccgctgcgtccacggccacacggcgccaccgcggccgtcactgatactacttctgccgccgccgccgccgccgccgctcatcatcttcaacacgaggcagacggaggcagcaaacatgttgtaaccgtaagtgcatcattcatataaagcactggaagtaactatatttttttaatataaacttaatgggtacagggtttcaatttggaaattagattttatgccggggatgaccgaaatttcagaaatttctggtcgaaattatttgaaaatttaactgaatttgaataaaatttgatcaaattcacaaaaaattcaaaaaatcaaaaatttcggacaagatttgagcatgccggtggaggcgaaattaccaaaatttcaaaccatacattggtatcaaaattttaccgtgtatctcgagatatttttccaacaatgataaatcttctctttttttcttttatactaagcctaacttaattagtttgagtttttatgacagttgttgatcgataggttatgtataagtatttatagaaataaatatataatttaaaaatagtttacaaccatttgtgttagtcatatattggtactgccaaaatctagaaagttttgtcactaccaacatatatatatcaacatatgtttgttattcacaacttttggtggcaaatctaactttgccaaacacagattaaaatgctaacaacttgatagggcaaaatttagcttcgaacaaaaacaatctagagtttttggagatatcatactttgataacgatagttcgtttaatcagtaaggttgtatttagtttcacaccaaaattggaagtttgaagaaattggaataatgtgacggaaaagttggaagtttgtgtgtaggaaagttcgatgtgacggaaaagttgaaagtttgaagaaaacatgttggaatctaaacagggcctaagtctggtaatttgaaacaaggtcatctttagtttgtgggaggtgtgagcatatatatacacatccccatcaaagtttgggttctcgttgaaatcattttcagtgctatcttttctacattatttgtaccgagttctattttagtatcttttaattgcccctcaaaagtactaatatactaatacattttttcttttttaaatttgtaataagtatttaagatgtcgatgtgtatctcttattattgttactccctccacttcataatataaggatgtattttaagtgaatgtatcaggatgtgtcatattaatccaccaaaattttcttatattataggacagagggactactccgtaattttctatcacattttcaactgagctagagagatgtatccgtatcgtcgtctgccgtatggcagctgccatctgctattactgagtcgaccacataaatatatttataggttagttaaatagtttgatccatcagtagcactaacggaaactgccgtacggcagaggatacgagcgcatagagatggtattgaagatttcggttaattaaatatttcatatggtgtccttagttgcgatactgtatatatttgggcccaagtttaacgtggttttatttcaggatcgtatttttacattttaatcagcatgtacaaagcaataattttgacacatatgcaggaggatttattaggcactaatcggccaatgctgctggctagaacaagacctccaagaggacccggtcctccaagagaagggagaggaggaggtggtggatcacacaactaattaccctaattaagttcacagcttagattaatctttctgctctgaagtttgtcaagcacttttagccaggaaattagctaggaatgtacaagttttgtacttagagaaggcatattttcggatgtaaaaacagatcgatatacacaactatatgtgcaagtacagagttgattgttttttacatgtcaaacagtagcaaatctggtacataattaacagtaccatactctttccattatataaatataattaagtaacctcttagttgttgatcaggtcaatatcaagtgttcagacaactgaccagcaaaagcaagagaaattcaggatgtgtgtgagagatgctgcagttcacatctggttcagtggcctttccatggcttagctgaacctaaccctgcaaattggtatactactagtttagtttgagttaattagtgaacgagttcagtgtgcaggtttagtttattcagtatctacaaatgcatgaaaaaggctgggaatattgtttctgcttaagttgactgccagggagcagataaggcctggcactgcctcttctgttctggcttgtgatgagttgatggacagtgaagcaagaactatattgtgctgagcacacataatatgctcactagcccttgattgtaaaagttatttcctaaatagaagattaagtagtatctaaaagaagaagattatactctacatctctttagcttgccactaatcaggcatgtatgcatgtgctggaaatattcctcttataaacttttggagccacaaacattgaccttgccctaacagtactaggaatgatgcatggttaattcctgtacagatttatgtgtagtatatatttttctaattgatttctgtgtagtatattcagatggataagaataattataacacagttgaaagggagatgatcacaaaaagaagcacaatagtacacacaaaagacagaaaaagaaagatacttcaggggttaatagttaccaaagactgcagtcagtcaacagactgcattcaacaaatgatgattctattctcctccagtcagtcaacagactgcattattgtagcaagtttcagtgaacttctggaagaacagatgttgactaaacaaatggagataaa

SEQ ID NO: 74511 - DNA, 702 bp, Oryza sativa
tatgctaaaaagaaccatactatgccttccttgattatatgccttgcaagtagggtgttaggcttgtcttggcacttgccagtacattatttttaataatgtactgactcttgctgttgaattaacttttgcttgcatgttttagatttagtctttgagtgatgcgggtgatcgattgcttcttctaggacttgaacttaatggggtaaacccctagtcggtgtgcttgaggattgggtagtcaagcttcccgctattctatatctttatttcgccggtcggcctatgtaactatgaagtagttgtgatttagattattttcgtcttaagtgtattttgctatgtatttccatgcttaagatgaaagtgtgaatctagtgcacatcttgggaagtagattcacatgagtatgtgttaagaatatttgagatgttgtagatctttagccatttttgtcaagtctcctgaatgtgtaacacatctggtcgccgccttcgagtggtttgacgggcacatctcaggctgaagttgactggcaggctaaaagcccagcaatgtcttcaatattcttctctcgaggcgtcgaatgtttcattatgtttctttgatgacttgaattattcacttcatctctcaaatataatgggaggtcccgagagcctatgacacaatccaacttattcttgactgtccacgtcatag

SEQ ID NO: 74512 - DNA, 14599 bp, Oryza sativa
gttcccctctagctgacgtatccagccaagggtgggcgtgacggagtttggatgggccctgtgacggcctatgcggcttccggattcacctaggcacgagagggggctgccctctgcatgttgaggagtgggggcgaaacctgaggtgtggtgcacttggttagaggtggttatgcgaagggtcctgtcacaatctctttccagggtaccatggtggtatgtcggcgcacagaaacgtgttgtggggctgtgtcttgtgggtacagtcgtacacctctgatcagagtaaaactatttgaatagccctacctgcggttattggcgatcaaccaaattcaccgtgattagtcacatgcttaataatttgacttaatggaactggtatagttcaggtgcttgatttgggactgtcgcaacatggtgtagcattggatagtgattatttaatattgattaattacttcaacagttttactgatttcaactactgtcttaaagtgcctgctttatgcaaataaacccctagctcccttgtatatctcatgcatcataccctctcgtccggtatgtcttgctaagtacaatgggtagtatttagtcttgctctgtctcccacccccaagagttggagtacgcgtcagatggaggttacttggaggagtaggtttcatccgtgccgtcaaggatgcctatggattggagccgtcatgctgcaagcgccaagttatctagtttagcttgtttttaatttccgctgcatatgtaagactttttatatatttgtaagacgtggatctgtatgttaacattgtcgtttgtgcaccctggccggtcctggacaggggtttaatgcatattctgcttggaatcctatttggaaatttcttagcgtgacaacaaaggatcccttgtggctcctggagctagtatcaataatgttttccttaactcaagaggcattttgatgaaatattagcctgggggaagaccaatataatgttatattttgcatgtcactaatgtatacgaaggttatcatccgtatgtattagggattattttgagcttgacaatgtaaagccatatctagcaaatgttgagacgagctcttatagtttgtcaagaccaatgctaagtaaaattttagtgcatatgcatatttgtcaccataatcagaaagtttgcaataagaaataacttatatggcgttcaaacttagtgggatggacatcgtatatttctatgcgctacttgtccatttcatagtatttttctcccattaaactactatggacatttttcatattaattagtaatattcaataagacaaagtggaccatggttgacttgatttatcagttggtaaatcaataagaaatatagaagactaagaggcaaactaagtaagatcttgttaatcttgccatttattggcaaagatgaagctttactaaggggagtgttgcaactccaaatttagtaataacaaagctcatattcctcatcaagggaaataaaattgtctctatatcttacgtatactactcctaaaattttcttgtgtaagtttttgcgagaaatagggatatgcttaatgtcctggtttgagagagtagatgagtaaagattaatggcattaattttgggttgaatcattatgagacatcgtcaaaattatggccttattatttggccacatttctaggggagaataaatgtctcgttaaggtagagacacttcacccgtagaaaatactaacatcgatcattacttagatgataattctctaagaaagtcctcctcatttatgactcatagctcattgaaaaattaaattaaatttgtgtgatcaaagttcattgaaaatcagaaattatgcttccattacataaataataaaatcagtggaaactcatcaagagctccaacaagaaatattattctacctaatttatgtctcctagctccattatgtggatgctaaaataattttgcatctcttactatgtgacttgcagaaataaatatacatacgatagccggatggttttgttgtggaaagacaagtcacatattgggtgcagacttaagaaatccatttgtggacttaatcaagcatcaacaatgctttaaattccactacgtcactagtgaactaagcttaaataagaatgaggtggaaaattatacctgtaatgatggaagcaagatgtcgttaaaactgtgtcattctagttgatgccgcatttacaggggagattggaacatctcatgatatcgagatattctttcctttagattttaatgacgttgtttagccttaagggaaaattcactaagatcagaaattagccaacaagtgattttttttgctatgtttacccataagcgatctttgatttactttaaaagatttaagatactaattgttggcggctgttaagtgccaattttataccgctaacatttgcataaagtctagataataaaacatcatagtgataggtctaaatctcacatatttcacaagtcgtatatttgtatgcaggtgataaacacataagttgggaggagatccagactaaaagtgaaggagaaatctatccatgcaagaatgggcttttaaattaccaaagaaacggcccaaaattgcaagaattggataaggcaggatgaggaggaggcctagaccaggtttggaggccatctggcccagccctggttcggccgaaccctggtgaacggcgttggatctaggttttggtgtggacgctctagatgctctcctaatgacggttgaggggcagttcagacaattcgcatcattccaaccgtcatacctatcctataaatagacttcactttcttcactttcacacacacttccaagcttgagctgaattataagaggctctattgtactatttgtatactagaattaggaagagagtagagtagaagaagtcgaaagaattccggagctgtcagtaatcctctcttatttgttttattctgtttattactctgatatcaatagaattatcttcctgagtaatttagatttatcttgtgagaattatctcttagttcctaaatagcatacgggattattgttcactataatcaactaaaatatagtgattgctttggtgagttataaacactaaagtagatattaattgcttagacgtagtgtttaggtaattgttatccagtaattgccgcgtatcccacagtacgtttgaggtaggtgtagaggtggtgacagcctcaagagcacttaagtcccccctgtccggatacgtagtagagcaacatctgggaacaccggtgtcgagggaagatcctcaatagcggggagtcatgagaccccccatttgtgagttcggccggggcggaggctcgtctctcggaaatcactcgctcctccataagattaccggtaagcttgcacgcagtcggattatacaggttcgggccgctatggagcataacaccctactcctgtgtttgggattatggatgagttttacaaaggtttcttcactccagagagcgcacttgcttcctcacttctggagttcaggttttctgggcgtcgtccctttatctcagtgggtagggtcctccttttatagctcaaggggataccacatgtgccgcctctacctaccctccataggagggggatcccactccactttgggcttccaaccgtaccttctcccggaagctaagcaacaaccggttctcgagtggaacccggcgccgccccccgcctgacacgggggacagccctgtcattccctcataaatgaacgatgacttgcgacagcccttccttgagtgacactcggatgtgacgggtcatacccacccccactccgccgggtacaagggcgacatgaggacatggttgccctatccatcggatgtgacggtgacaggccggtcacagaccgatcacatccgttggacagaggttagctaggcgcgccgcacgtctgcccttaccgcattaaatgcggtgagggacagttggggcatcgcacatttatggctgttcagcctgtgctcccctctcgctctctccctccgccgcgtggcagccgggtgagggcctcggggcgaagccgcgggagagcccgagggggtgacgtcatgccccgaggccccccccccccccccgcgccgggccggatccacgactcgcgtgacgcttgagtagggcagcctgtagagtcacgtggccggagggaaagtaattcccctctacttcacatacccccgggcccatatcttcgacagtagcccccggcgctatatcagatatcgatttcctgggatcattctgacatggcgcctcacgactcctcgagctggggttgtgggcccggcagcgaacccaaaaggatatcaccgcgtggctaggttggcgtgctaaccacaacagcggtttgaccgcctctgacagcgctcatgatgaagatgcttgaggcgcgataaccgggggggtcagtcaaaccacgccttgattctcttgctcgctactccagcggcggtagcggtgacggtttgttcaacttgcgctcatggccgttgcgcactccacctcgagtgtgccactgacaggcgcactaaaggcgggagcggatacaacgagcgacgtgatgagcgggcgcgggatgcgaagagacaaatacgggcgcgaggatcgtgggggcagttatgggggcgtgaaacgaggaggcgagcgcgaatgaggcgaggataaaagggggcggaggcggagactctgccttcttactttcgccaaccgcccactcgtcctttcgcttctcgaaccctaacattctcgccacttcacactgtctcgtgctccacgctctccgccacttctccgccggttgccatggcccaagacaccggcgacgcagtgctcccttcctcccgcatcacggcagacaggcaccttagcctacctcgcaagatcatgccgaacggtgccgtcgtgcgggcgggagagtcatggccgcggccgtgatatccggagcgatccatgcacctcttgtccttcaccatggcgggcttgattccgccgttctccagattcttccatgaggttctggatttctacgaaattcacgccttgcatctcgcacctaatgccgtgatgacgctggccatcttcgcgcatttgtgcgagatgttcattggggtgcgaccgacgatgcggttgttccaggccttcttcatcccgcagctgctgcaaggcgcggtggtggggggatgctacttccagccccgaccaggcacagcgggtcagtacatcgagagccatctccgcaagaaatgggaggactggaagaaggactggttctacaccgcgttgccggaccatccgcgacttcgagttcccgctggccctcccgaaaggtctaccgcatggctagcgacgtcggagctaggcgaggaatacgacgcggtgtgggatcgcctcaggggcctgcggagcctgggcctcacgggggcgatgatctttggtgattacttccgccgccgcatcgcacctctccaggaacgatcccgtggagcgtgggaatacactggtcccaacgaccccatgcggacgcatgtgggcgatcgctgggactggggtgaggaggacacgaagagggtgattcggcgggtgctgggcctagactccgccgagccaacactaatcccagatgggattcttcccctctgctgcaaccgcgaccgggagagcatcctagccgtgatgtcaaccgtcggcgctggcaggagccggtccagctgaggcggcgccagcggtagcgccgtcggcacgggtggcggtggtgcgaccgcgggcgggagccgggccggcggtctaggcggcggtggctcaagggcgcccggatcgagccgcggacccggagacgattccgctggcgaccctattcccggccgccctctcccccgcgtggaggggatgccgagcgcgcaacggaccgttcgccagcgggccacaagcgacctgccgagcccgaggctggacggaaaaagaagcgactccggaagatgcgcgcgagcatttcagcttctacgcgatcctcaggatgagtattgccttcgagatacgcccggatgtcggtcatccacacgaactgacgaggggggttggggttgaccctctcgggccccgaggggcgcgggttgcctagagtcgggtcggagggcgtgtcattggcgtccctcaaagggctcagtcacgccgatggttgtgcgagcctttcctcgaaggtccctgggggagtggggctcgtgccgacgcaacacgcgacaactcgtcagcaattgtgttgtcgcgtcggggcacgtgccggagttaaagtccgtcgaagtggcgttccatgcgccgtacctcgcggacgtacgcttccatttgcgggtcggtgcactgatactctttggatacttgatttacgaccagctgggagtcacccaagaccaggagacggcatgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaagtcctagcacacaagaagacaaacgaaaaaaagcggaagactagggcgacgaccacaggaacttgacggcaggcacgagctagacaccaaagccttcatcatccaggggctcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagtcactcagttgctcaaagctactttgtaaacacggtcctagagctatacaatattattaaccaaggccgtgaacccacacgaacatgtcttaacccaaggcctacgatgattcagaccgaactggcaacccgaccctgggtcccagctagtcccaagccaacccaggccaaccattccacattttagctgttaggcaggttttaagaattaaaacactaacttgggtacattgctcggcttgcccataaccgagggcgcggctattcgaataggttatactctgatcagaggtgtacatctttacacacaagacacatcttcctcacgtgtaaccacgtgccacataccaccacggtatacggacggaagacatgacatagtttccaacccatcctagccataaacaagagtaccgacccaaccccacctacggccggaacccccgggacaggtaggcaggactgagcccctagcagcaggacaccggccctatgccatgacatctcgactaccgggccgcagctcgagtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggaggtgtgaatccaattacacaataatccaaccattccatagtgttcaggtgatatgaatatttccaaagtctagagttgtaaaaccacctaatgttgcctaattaaccagtgaagcatctacctaaattcatactagtggtaccatgagtagagtgtccactagttggggttttgtttaatctagggtgaacaaggtaataatatcaataacaataataaggtcataacaaaggtaaataggcatggctagataaaacagtgataacgcgggatatttaaataaagcgataatgcaataatttaaatcaaaataattttataaactgggattcaatatgttcaaggatgatgtgacttgccttgctcactttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaaaaagacttgaacggtccaattccgagttcaaatggccaagttatggccatttgaagtttatatgctttttaaatgaatatttgcgaatttcttcatttaaactttaatttaaaaagggtttattgcgtcagccgaggggacgggcgcgcggaccgggtccacgggagtggggcccacgcggcagcctcacagtccatggtggaccgggtgcacccgggctcacaccggccggcgccgtgggccccacacgtcagccgcacccgagggcgcgggcggctgacagccgggccccacgcggcagccactcggcgcgcccgagggcggccacgccggggcggtcggcgagaggcggcgcggcggagcggcggccaagagaggggagggaagggggaaaggaggcgacggtccacggctcaccccggggcgacggcggcgactgaggaggcggctggagcggagggaggcgatggcgcggctcgggtcgacggggacggcggcactccggcggtcggcgaccgaaacggagaggcggacgaggtcggcgaggatgcggcgaagccgaaggaggcggcgccgaggtgggaggcggtccggggcgacgacggcggcagaccggagctcggcggcgacggcgaagagagagagcgacggcgcgagctcgattccggcggggagacggtgcggcaaggggcggaaacgggcgagggaggcgcggggagggtttaaataaggttggaagggggagagagcggccggaggggaaggaaaccggcgcaggaggtccggccgccatcaatggcgccggcgagatttgcgggggcaaatccgcccgtttgaacgcgagagagagagagggaaaaatggggggaaagggaaagggaatcacggggagtatttccccccactttattgcacgcggggatggcgggagacggcgggattcacggcggcggcggcgctagggcgcgggggaggcggcgggagcggctggaggaaggggatgacgggtgggccccacccgtcagcgaggatggcgggcgggcctgcccgacagcggcgcgcgcgcggggagaggccgagtgggccgcggggagaggagagagagagaggggggaggagagatgggccgggccggcccaagggagggaagggggacttttagggttttttttataaaatcattttaactttgtttatttcttaataattattatttgtgctctgaaaattccactaaaatttatttatgcattttaggcttttaggaaatttacaaaaatcctctaagccttatttggcttttaactttgcacattttaattgttggaggctttcacacggattttaattattctaggcatcatttaagggatatattttagagtcgttttgggacgtgacacggcaaatgcccattccggctgccgccctcaatcccgcgaggagcccttcatattatgccatgttgttcatggctcggaagtcgagacgaacgatgtatttgagaacatccccgtttggcgaggtcagcgtgactccggcacctgcaccttgaaggttgagggagccatcaaaatgcataacccagtgcccgccgcgaatgtcggcgtttggatcctcttcttctccgggggggaaggggacattggacgaaacaggttcgtccaccggggtccattccgcgatgaagtcagccaggatttgtttcttgatcgcatgccgcggttcaaagtgcagatcgaactcagccagctcgatggcccattttaccacccgtccagtaccctcccggttgtgcaaaatttggccaagagggtatgacgtcactacggaaacccgatgcgcttggaagtaatgacgcaacttccttgaagccatcaagacggcataaagcattttctgggcctgcagataccgggttttcgcatctcaaagtgcctcgctgacaaagtagacgggccgctgcacctttcagcggggccggttcatgttgtcaggggctgatgactcggagcgcgcctgttcggaggtcccggggggatcccggactgcctcgggatcataaggctcggggccacctgccaaagcctccgctcctcccttgggggcctcggggttctcccgggggctggaagctttgggcgctaggccttcgggggacgaggggccatcgcaagccgaaggggcctcccgttcgccttcctcacgctcaactacaagggcggcactcaccacatggggggtcgcggccaagtagagtagcaatggttcctccggtcccggagccaccaagatgggggggaagtgaggtaagctttcagttgattgagagcttgctcagcttcctccgtccatacaaatggcccggagtgcttgaggagcttgaataggggcagcgccctctcacccagcctcgatataaatcgactcagggcggccatgcatccagtgatgcactgtacatccctaagcttgctgggggggcgcatcctctctatcgcgcgtattttctcaggatttgcttctatgcctcgggaagagattagaaaaccgagaagtttgcccgtcggcacgccgaacacacacttatcggggttcagctttacgcgcatggacctaagactatcgaaagtttcggccaggtcctgtagcaacgtgtcctggtggtgcgtctttaccaccagatcatcgacatatgcctctacattgcaccctatctgattacttaaggtaatacgagtcatgcactgaaaagtagggcctgcattcttcaatccaaaaggcatagttgtataacaaaaggtgcccacaggagtaataaaggtggttttttcctcatcttccctagccatacgaatctgatggtaccccgagtatgcatctagaaaacacaaaaggtcgcaccccgcagtggagtcgactatttgatctatgcatggtagagggaagggatctttagggcatgcctagttgaggtcggtgtagtcgatgcacatccgtagcttgccattggccttcgggacgaccaccgggtttgccagccactccggatggatcccctcgcgaatgaaatcagcctccaggagccgtgccacttcctccctgatgaaggcctgccgctccgaggtttgacgccgcactttctgccggacaggtcgcgcatccggccgcacgacaaggtggtgctcaatcacctccctggggaccccgggcatatctgacggcttccatgcgaaaatgtcagaattcgcccgcaggaaggagacgagcgcgccttcctatttggcgtctaaggttccgccaatcttggcggtcttggacggatcgtcgccaagggggatttccttgacgggcaccttgtcagctgaggtgaggcgcttcttggaagcgcgggacgcaaaggcttctggggcctgcggctccgtggccaccaccaggttgtctgcgcgctgctccgcgcatgcgagggcgaccttgacatcaccaaagatggtgatgggactagcaggacccggcatcttcatctggaggtaggcgtagtgggtggcgaccatgaacttcaccaacgcgggtctgcctagaaccgcgttgtagggcagattgaggtccgccacatcgaagtcgatccgcttggtgcggaagttggtggagtcaccgaaggtcaccggaagctctacgtggccaagcggccacgtgtgccctggagtaacgccaatgattgggagcgacggctggagcttcatccccggggccttgagcgcgtcaaaggcagccggggagatgatgctcagactggcccccccatccacctgcacactcttcatcttgacgttgtggatggtcggggagaccaccagggccaacttcccccccccccccccccgagcgagcaccgtcggatggtcgctctggtcgaacgtgagcttcacctccgaccagcgcgccttccggaccgcctcatgcgtgggaacaacggccagaagctctcgcctcatggccttgaagcttcggcgagaggtgtgagcgcaagccccccccccccccccggtcgagcgtggcgacggtcccctgaggtatctggaaatccagatcctcaccatctccgccatcatcggcgggggccttgtccttggcctcctctcgccggtcacctgttgaggtcgcgggggctttgccctcccgtcgaccctgccgcttctcctcatcagcctttcggaaccgctcggccaaattcttgaccgagcagcagtcgacgagactgtggcggtaagtgttgtgtaccgagcaccacttgtccgccgaccggccctcgccggagggaacggtggggctcggcttatcgccggtggcctttcctttccgcggggcccgcgtgggctcgtctgctgcaaggacatggccctcgtcatcggagcgggctggtttccttttgcctctcctatctcgccgcttagagtggggggcagattcgggagtagccgcagctgccgcaccggtgccgggagagttccaggcccacgcctcctccttccgggccaccttgtccgccagctcgaagagctcgatagtagtcttgggctccttggaggcgatcttctccagcatgcgattatgccgcacgccgttccggaatgcatatacaaccgcgtgggcttggatgcacggaatggtgttgcggacctgacagaagcgctgtatgtatgagcggagggactcatcatcctcccgccgtacagcgtgtaggtccgcctcttcccccgggcagggatatgtgccctggaagttcgtaatgaactgctggcacagatcctcccaggagtgaatggagccggggggctgggtcatcaaccagcgacgcgcctgacccttgagtgccatgggaatgtaattcgccatgacccggtcgtcaccccctgccgccacgataaccgtggtgtagatctggaggaactcggagggattgatgctaccatcatacttctccgtaaggttggggcgaaacttcgggggccaccggacattccggagactcgccacaaaggccctacaacccgtcctcccaggggtgagtgtgggaggagggccgcctcgtgaagaagagcatggcgctccagatgaggaggcgccttcccccatacgggcagctcggcgctcgtctcggcgtcgctcgatgttgattcgagcgtcctgcgtcccgtagaggccgtcatgacgcctccggcttcccgaggcccccgacgatgttggaaccgtggaccgtctcgagatcatggccgatcgacgagctcttctcctcgccgacgaggagagggtgaccgaggtacgcgatgtaccagcggcagtggatcgaccacccgtggccaactgtcgctgggcagtagtgaccaagttggccacgtcgtccaaccagcgctgaataggagtctccggccccgggtttaccgggggatgccgcagaagggtgcctactacctgaagcgcgccttggggcgaaccgccgtctccatagtcaagacggcggcgtgccccgacgcgtcgcggcctccctccgccagggggcggagagagagccgaatcacccgaacgagtgggatcctccctccgcgaaggttcgcgacagggaggagttgcagaaccatggcgacggtgacgaggacctcggctctcgccagaaaattaggatggaagaaagcgacttcctctcggaatgcgcaaccgcccctacctggcgcgccagctgtcgagggaagatcctcaatagcggggagtcgtgagaccccccatttgtgagttcggccgggggcggaggctcgtctctcggaaatcactcgctcgtccctaagattaccggcaagcttgcacgcagtcggattatacaggttcgggccgctatggagcgtaacaccctactcctgtgtttgggattatggatgagttttacaaaggtttcttcactccagagagcgcacttgcttcctcacttctggaattcaggttttctgggcgtcgtccctttatctcagtgggcagggtcctccttttatagctcaaggggataccacatgtactgcctctacctaccctccataggagggggatcccactccactttgggcttccaaccgtgctttctcccggaagctaagcaacaaccggttctcgagtgcaacccggcgccgccccccgcctgacacgggggacagccctgtcattccctcataaatgaacgatgacttgcgacagcccttcctcgagtgacgctcggatgtgacgggtcatacccacccccactccgccgggtacaagggcgacatgaggacatggttgccctatccatcggatgtgacggtgacaggccggtcacagacc

SEQ ID NO: 74513 - DNA, 29428 bp, Oryza sativa
gattttccaattgaaatcatttaatatttacaaatgttgtttagatttgtcatatattaaaattcaatttcaaactatttggaaaaaagttatatagaagaatgactaaaataaaagttgtagatcttgatgagaggatcaactttgttgttgaccatatttccatttgaaatcatttagtatttacaaatgttgtttaaatttgtcatatattcaaattcaatttcaaactgtcaggaaaaaagttatatagaaaaatgtccaaaataaaagttgtagatcttgaaaggctctacaagtttgttgttgaccatatttacatttgaaatcatttactattggaaatgtattatgactaataaaatgaattattacacaacagctatattttttgcactcacaaatacaaatacttgaaatggaaaaatagtcatcagtgatgggcgtcagttatagcccgatagagattaatctatctcaatcgggcattaccctatggccggtcagagatgagtcatcggtgacaggtctgattgtcatctcaatcgggcattagtatggagcccgtcaccgatgagtcatctgtgacgggccctacggcaatacccgatagagatagattaatctctatcgggcttaaactaaggcccgtcaccgatgactatttttccatttttccatttcaagtatttgtatttgtgagtgcaaaatatatagctgctgtgtaataattcattttattagtcgtaatatattttcggatagtaaatgatttcaaatgtaaatatggtcaacaaaaaacttgtagagcctttcaagatctacaacttttattttggttatttttctatataactttttcccaacagtttgaaattgaatttgaatatatgaaaaatttaaacaacatttgtaaatactaaatgatttcaaatggaaaagccataaatagcaaagttgtagagcctttcaagatctacaacttttattttggtcacttttatgtataactatattcccaatagtttgaaattcaatttgaatgtttgacatatttaaacaacatttgtaataaaacaaaattagccatataaatgactacacatattaagtctttgtaataaaacaaaatacttcattcattacaatagatacgtacaaatgcatcggtcacaaggttatgccttccgtatgatctgaatgagcatatgccacacgctcttcgggatcatcgtcaaggtcaatatgaggtcttacatgaagattctggttgtattctttttcatcgacgaggttgtcaactcatacaattcggcgcttgccatacctcacgatgtgtatcttcttgtttgaagggtcttttatgtagaatatctgctcgaactgtttcgcatgtacaaatggttcatcggcgtatcccacccttgatagatctactaaagtgaaaccttccttgtcggctttgacaccagtgcgtagattcacccaatgacagcggaacaaaggaaccttgaacttgatgtagtttagctcccagatctcctcaatgcggctgtagtatgtgtttgacccaacttgatcctggaatgcatctatacggacgccgttgttttgcactgtgcttttgtcatcttgtttgacggtgtaaaatgtgtatccatttatatcgtatccttgccatgtgtctacagtccaagacggtcccatccccaacaactgtactgtttcatttgggacatccgtggacattgtcacacgattcttgaaccattcgttgaaccgagaattatgttctctgttaatccatgtatcagatcgccccaagttctcatcttagattttcactaagtgctcctcaaagtatgggccaacttctaccatatgttggagcacagtgtaatgagcctgcgcgtaggacgcttgatcgggcctaattcttttccttccgattgtgccaacacctgacaaccttccttcgtgacgagatgctggaactccgataggatcggcatcggacatgaaattgacgcagaactcaatagccttctcggtcgtgtaaccttcaatgatgctcccctcgggtttagctctgctacgaacgtaggacttcagaactcccatgtacctttcaagtggccacatttcccttagaaaagctgggccacatagttttgtttgcttcaccagatgaacagggagatgaaccatgatatcaaagaaagacagtgggaaaaacatctccaggtgacagagggtattcacaatatcggtctgcaacccatcaagatcttctggatctataaccttctgtccgattgcattgaagatggcgcacatgcgttggatcgtgtgacgcactttcggtggtagaatgcctctgatagcaactggcaagatttgtgtgattagcacgtggcaatcgtgagacttcattccaaccagttttagctcgtccaatttaacatacttggttatcctcgctgaatagcccgatggaactttaatatctttcaagcatgataacattgcgattttctcatccttcgacaatgtgtggcaggctagagggaggtacactctttttgtctctacatctcgtatgggctggagttcactgcgaatattcatgtcctgtagatcaaggcgcgcgtttaacccgtccattgtcttcccgtgaatattcaacatcaggccaaccaaactctcacacacattcttttctacatgcatgagatcaatgcaatgacggacatcaaaatctttccagtaaggtagccgccaaaatatggattttttcttccacatacccttctcctttgtcttgctacgttttcttttcttcccaaactcattacttatgtccttgaccatattgtggacctcatctccggacaaatcctttggagcaggttgaagttatctcttaccgttaagaaaattcttctttcttctaaatgcgcgacgtagcgggagccacctccgatgacccatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttttttccaaagaatctcaagatcatcgataacaggttccaggaatacatcgatatcattgccgggttgcctcggaccttggattaacaagcacaacataatatatttccgtttaaagcataaccatggcgggaggttatagttcgcagtaagaaccggccaagtgttgtgagtactactcatgtcactgaaaggattcatgccatccgtacacagacatatccttatgtttctagggtcggcagcaaattctttgtatttttgatcgatattcctccattcaatcgaatccgctgggtgtttaagcataccgtcattccttctctccgtggcgtgccaacgtactaacttcgcttcgtttgggttggcgaagattctcttgaaacgatcaattataggtagataccacacaatctttgccggaccacccctctttgacttctttccttcgtcaacacttttctttcgcttgtatcgagaagccttgcagacaggacaagcatccaagtccgcatattgcttgtggtacaatatgcagttgtttggacaagcgtgaattctacagacctctatataaccccagtggacacagaacctgctttgcttcgtatgtcgtctcgggcaatgtgttctcagtaggaagcatagccttccaaattcctaaaagatctatgaaactcttgtctgtccatctactacttgccttcaacttcattaggtccaaggtaactgacaacttagtgtgctttgctttgcatccagcgtacagaggcgtctcagaatcactgaccaacctgctgaacttcatggaatctctctcattctgggctgggtcctcaacgtcacgtaacatgtcttgcagcagatcgtgatccacatcaaccatttcaccgcccaatggagaaggtataaacatgtcatgctcatcttcatcttcctgattatgtgcaccacttctgtctgctgctgctccacttcctgattcttactctccatgcttcacccaacatgtatagcccttcatgaatcctcgttttatcagatgatcgtgaacatcctctgcgctatcaaacatattctcattcttgcaatctgcacatggagaacacatgtaattgctgtttcttcttttcctatcctcctccgcggcgttcataaaatttattacgccatttctgtattccagaaaatgacgtttcatatttttcgcatacatccaacttcgattaattgctacaaaataaaaaaaacaaattagaggtacatcttataagatcagtattgctaaagtaagacgtgatgaaattgctcaattaatgattaatattactcacttgattgctccattttaatcacttttgggaattttctgttttccttgcaaaaaagacaaagaaccaccccctataccctcccaccaaaatagtgaacaatgggatatagttacactaggttgtggggggtatttatactatgcaacaaatatctgtaacggccctaaaacaatcaaccatgacgggcatacaagtaatctctaccgggccttaattaaagcccataaaaaaagagtgtcatctgtgacgggcattaaacttatctcaatcaggcctctagttggagcccgtcacagatgaccctcatctgtgacgggcttcttttagggcccgattgagatatggcacccttatctcaatcgggcctcaactatggcccgtcacagataagtgtcatctgtgacgggctctagttttatgccgatctaccatggctatgcgaccatatctcaattgggcgaaactttgacccgattgagattacttccttgtgacggcccacaaattctagtcttgctaggggccgtcacagatggaaggatcggtactagtgtctctctctaaaatccatccaaattcatttgttgttttccttagagccatccaaacacattattttttgaattcgcgtgtttagatttgcatgggattcgtacctacctttcgtccaataaaaaatgaatgtaggactagatgtgacatatcctagtacaatgaatccggacagaggtatgtccaaatttgttgcactaggatgtgtcccattaagtactaggttggttttttatgggacgaagggagtatatgatatcctaatccaacgtttttcctgtttccatatttctaaaatcctgtgttccaaaggtgtccttaacttagcaactgcacaaaagtcgaattccaaatttagtcttgtttgggaaaacagatgaagaaaaacattggaaaaaaatctatttaataggaaagtatggcaactcatgggctgagcctcttcttatttttcatttgagaattccaatgcaactactctatttgtctttcttctctcgttcaaaaatctatccgaatttgtttgttatttttccatgagcaatccaaacacatcatctttcgaattcccatgttggattcgtacttacgtgacagtctaatgatgtttttttttcactattcctatatttctaaaatctgtgttctaaagaagccatacaactcaatattagccatcagtttcattggagaacttctattaggcctcctttgaaacaaaggaaaaatgtaggaattccaaagaatttatactctacaggatataatcctatgaaatcttttgaaacaaaggattgattcttaccaattcctttgaaattcatatggaatggactattgtaaagtaatttttgaggaaaataagcatgaggtcttacctcatgttttgttcttcttgtgtgttgaaatcttacgtttttttttcctgtcactatcaaatagtagttttaaaactttcatctgttttcgaatcccttaggtatccaataaatatgatattctatttctacttttttcctattcctgtgtcagtgaatatgatattctatttttatgatttttttttctattatcatgttttgacaattctgcatttcaaagggcacttagccttcacctcgtttctattttgctttgaaccacaagaaagtggaaattttggttgagcaacttgctttcctccattccgaagtccaaacacctccatatgaggagtgaaaaataaaatcttttatagatcgttgcagtaactatgtcccaattaatgtctcgtgtagccagccgtgaaaacttttgtcaccaaagtaaagtggcaatatttatctttgcaaatgattatacatctgtaggtaacatatatgtttaccaagtaaaaaaaacataaatattagggaagtgcctaatatcaaataaataaaaggggtgaggctttgaatctaggccgactaggccatcatattgtggagctcctaagcgtttctcatatggtcgctaaggaaaattttgataatttgacacttttttcgttgcccaattgttttaattgatatttgtgaggatgacatgtgaaaccatctaagtaaatgaaagtgggtcatgatgtcgaataatcgaaacacatttaaaagagtgttaaactatcaaatctcttgccaaccatgcttaaccaattatagacacacccaaatccctaattacctatgcaattgattaccactcgtataaacatatatctaccgtgcttgtctcggttgagtagaaaaagaaatatatatctacagtgcagtgctatgtacagttcctcaattcaatgtactatcgaatccaagtcttcaagcgctcgcggcgatccggcgcctccgccgaccatggtcgagacagcagaaagtttcaacccaaacaagagacggcgcggcgcagggctcgccagggtggtggccgttcgcccgtggtcttgcccatgcgtcggcgagcgtgaagcagtcggtcggagtcgggagagccttgccgaagaggggatcgcggatcacggggttctccgggcgctcaggaggagggccagtgaacagaggagcattcttcttggacattggttcgaccatctgcagaaagtccaaatgcttcatgggtcagctccgtttatcagcattgagattcgttaatcagacaaaatcatatcaatattgtagagatcctgccacaatattcatctatagataaaaagggaaatttaaaaagtcatttgaattttgaaaattacaccccataaatcattttgttgtaaatataaatgcgcaccctctagccagttcgattgcaaaaatcatctcaatacgcgcgtgcttaactgaatcaatatatttatcaatgtaatatttaacaaaactaaataccttaggagtatagtcttaacacttttctttgagatttcacaaataaaaatgctgatgagaatttaaacattatcgcactgagattcgcgttaattagaattcaatgaaacatgaagaataaatctaatgtaagcacttggataagattgacttagctatcttagtggtcatgcacatgtatattgggatgattttttgcataaaatgaggggatgtgtatttgcaacaatatactccctgcatctatttttgatagttatatttctaaatctgaaaaatttatttttgttaggcatatttcaattcaacaacatatactcttaatgactttctcggatttaatgcatggctctctattctttcacacaagattgactacatgggcatcgagaaaggtaaatattaatgaatcggttgtttacgaggaatgactagcagtatgtttaaatgaatgataagtagaattacttatctttgatctgtgtaccaagatgaaatatgagtatcaaaaggactcatagggtgaagcaatttcagtacttccgagacaaaagatcatgaatgtgcaggcaacaacaaataggtccccaactaaacattatacccatgactcaaatatattggttgtagctctgttgagtcaaggccgggatatagattccattatctaaaaaaaataactcaaatatatactaacgtgttttggaaaagcctatacagcaccaaagaggagctagcgttaattagttttagatttgacaaaacctatcgtacgttccaaaattttattctgaagataaatcgtacgtttcatcatagtgctgcagttcctcctgtcccaagagttaatggccaaatgtaccgatttctgaagccatattatgtactgtgcacgcgacgaatgcatgaaaacagagaacagaagaatgaatagtagcaaatgcgtagcagaactgcagtatggcgaggcgaatccagaaggatcagaaactggaacagcggcagcacgtacctcgtgtaccaggtcgccctgttcagcgtcagataccacgcccccatccccgcgagagacggccaaggacggcggctggtggggtgtgggccggagtagcagcaccggcggcggctgggacgacgatccttctgcttccatcgaaaagcttctcgcaatgcaacgcgaactgcagcgtgcgtcgtcgccggccgggtcggtttgcggtggccggcggtgatggcgtgtagggaggaggagtactcgcatatggcgcggggtgggggaattctggaaacccgcggtgaatttatggttatgacgagagagatagaggcaagtaacggttggtttggaaagtcgaaaccgaggggtagggaatccgccattgaaggagtctccacgtcggtgtgtacatggccagttgtccgtccacgcccgagattccctctgcctcttcgactgcgaggatgtgtacggcgtcgtccgtgtgttgcgctgcggagggaatcagatcgggggcttcattagattgcgctctaattatagcagtggagcatgcgggaagatgccccctgccgcagaaaatctgcatgcgggtaggtcaacacgttggatgcttggagtccaaataattactcggtatgtctcaaaatataagtattttttggctgtgaatctgaacaactgtgtattcaaatttataactaaaagttattatattttagaatagaagtagtaattagcaactatttgcacgctcctccccacgcagcgcgcggcggatcgagccatgtgactcgcgcggagagggccgtcttcggaacggtgcgtgtgcctccgtttttttcctgtttatttttctggtttcttttctttttttatgtacgtttgtacacgtacttatacataaaaatatatacacatctcttctctatctctactattactagccatctaatttggtaaaaaaaatatttgtttttagagaaataatctgctatatatttgtggaatatacatgatgtttagtttggatgatttgtagcatgggaggaaatgaatggacgaacaatgcatgtgcataaaaaatagattatttatttatatctaatatatggattgacaagatcatcttgtgatatatttgccaaaaccttttagtacctgatgtgacaacaattttttgggtgagcctgtatataaataatagaaatttaatacaaattattcctattttttaattttttgttgaatacaaaaaaattaaacaataaaaataaaaaatgaaagattatatttagagttcatatagaaatgaaatttagaaataatataaattataaattatattggatgaagtctagaatattctccaaaagaggctagagtgcatataggaatacaatttagaaaaagaattgaaatttgaaataaaaaataatatttttttgaaagaaaaataaaaatggatattgaaaggagagtttacagtccatataaaaatacaattaaataataaaaataaatccatatcaagagatacatttaacaaaatttctcactacttcaatttagatagaaataaattaataaacagtcataaacaatttaaatgatattaatgctatttgtgaaaattaaaaaaaacttaaaatcaataagagagaaaaaactgatttaagcccgacccaatagagcggccttatgtgcttcacacatgcggtcggcccatgggatggcccaatagcgcagcagcctaaaacgtcgctcggcccgacgtgggagaagcatggactgtccgatctgatggacagtctcgattggtcctgacctagataaatacccgcaaccctaaccctaaccttaaaatatctctctcgataccctaacgcgctctctctccctttctctcttgtaaagtgacggtggcggcagcgactattccaacgggtggtgacggcagcggccttccccaccgagcagcggcgacgacgctcttttgccccgcaagcaggaagtggtgccctaccctcttgcaagtggcggcggtggtgacaccgctccctctccccaccactggctccttctctcctcatcgggcaatggccgccgccccgctcctcgccagatccggcgggtcgacggctctccaacagcacggcggctcgggatctagctccttcctctccttctcagcatccagcggaacgacgggttggtagctcctcggcggcgcgattgcacagcggatcccccgagttcgcgacctccactacagcgaggtggcgaggagcagcacacgacggcctcatctcatgttaatattttgaatgttctttgatttgtattgtgatgatttgagcatcattataggtgcccctttttttataaaaaatagcacctataaaaccgacacctataaaatcgagccgagctagccagggagatatttttttctcccgtggggcccacacccacaccggcaggaggggataaggccgtgctccattcctctctcggctcctcccctcatttctcccccactctctctctcccccacttctccctctctctctctcctctgtgcggcggtggcgggaggagcggcggtggcgacggacgacatggaggtggttgcggcccggctggggcgggaggggcggcggcccggatggcgtgggggcaaccggccggacctcgccttcgctagatctggtggtgtggaggtggctgtggcccggcgggggtaggaggggcggcggcccggacggcgtgggggcggcctggtggacctctgctccgccagatctggcggtgtggaggcggttgcggcccggcgggggcgggaggggcggcagctaggacggcgtggaggcggccggccggacctcgcctccaccagatccagctgtcgacgggggatacccgtagaccggatatagagggtattgtggtacgttggaacgaggatctacgtaatacgacatcaagcaaacaaaagataaggattatactggttcagaccccttggtaagtaatagccttaatctagttggtatgggattatatgatggaaaccacagattacaaagggaataatggaacttggcgataacgacgagatcgtagtcgagttggttcgactagatcacccggcgacttggctcctgtaggctccggcttcgtaggctgtggtggatgtgttggcggtgagattcgatgccctaggtcctgcccgggggatcccttttataccacgggtcagttgatctccaagtaggactcggagatattagacccctcacgatatggtaacgacccagtcttgtccaagtaggactccttccatctgtggactccgcttctgtcagatgatagatttccttaacgtatacaggaagtatctgtatatgcgtgggtataccgtatcagcatacaacgtatatatatccaaggatagagggtatacctgttgatgaaaaacatgaggcatgggagatctgcttaactccagtgcaggtccaaaactcgccttcgggtatgctagcgtgccagttgatttgatcctacaatcaacaagaaacaaagacaaggaaccacttcatctgatttgatcctacaatcaacaagaaacaaagacaaggaaccacttcatctgatttgccttcgggtatgctagcgtgccgacttaatagatcaaactcaactgatacagcattaagtatgaaaagaagaacaatatctagacaatcaagccgctggaagtttcagagtggtaaatatcttgcataatctaaatcaacgtcagaatctaacctaatcggctgccctctactaacagatgttaaccgattgtagattagatagcgatattgccaaagattatgtgagatatatgataactcgacgaattacataaacaagattagagtgtcataaagatggaagcactaatcccgagaacgcaagccgtcataacaagctttacctcttgttgaagatcgaaaccgatgcagctcaacccgaacgcaagaactcgtccaaataaaactaaagcaaaagagtggcgatgcactgaaattgtattgtacgtgtgttaaaaattacatagggctcggggtcttatttatagccgagaattacaagatatgtctataccggacacgactattatctctaacaaactctaatataccataagtctttgcggcagacttttgcccaagcatatctctaaggaaattacataaaatatcctaattaatagatacaattgccttctcaggactttatccatgcgcggcaatcatcttgaagcaccacaattcaacccgatatcgcacaccaagttgtattgtcggaatcggctgcatcaggctacctagtccgactcagactcatccgatcctaatcgtagccgatctagactctagccgattcctgctctgttcctgaatcgatctccgcctccgactccacttcgatctaattttcttttccgatgccgatgttaccaaatttggttgttaacaataccttatttgtaaccctgacagtagcctctgacttctgcttaaatgaactcatgcaaccgatggcgacttctgatgtcggaatcgttgtcattctcatctggtcgatctcgatatgagaaccgtagagacaaagagttattgacaacatcgtatgaagttcaacggtcatgagtgaatttaaattgaagtctgaaaactgccgcgcgtaacgtacccagaattttttggcggcaatctctctcctttccttggaatacgcaccgtcggtagtgcgcttatttaaagggattttggggatccattccgaagtccgtttgccagaaagctctcctgccttctagcgcttttcgtcttctccgtccccgcaaaaaaccctagctcacttcctccatcctgttctccgtcaatcctccagcggcgatggatcttgagaagtcttcctcgaacaccgcgttcatgaagaagctgcagtatgatggtgccctccctggtcgcgggaccatgcagagggaggctggaggtatagaacctgaacccatcttgggctgcatggttgtagttgacgattacgtttcttgcggtttttagcctccgccttccgaatttcttctcctcgtcttgaacttctatggtctttctttgcttcacctgaatcccaactccatcgccttccttagcattttctcctatctttgcgaggcctatattggggtagagcatttccttgatcttttcccttttttactatgagttgcgttggatggaacccaaaaaggtatccgactgtgtcagattccgacttcgggatggcctgaaatcaagatacatccccttccaatgccctcttctcgcagcaaatggcgggcgggatggttctatcttcagatagagaactcggatcctgttcttgtagtccctgaagaacaaccagacaaaatcccagagtggaccgctaagcccgccctgactccctcccttcaatcattcatcggcatcatcgatgaccttcgaactcgagggttgtcggggtatgaagtcgctgccgacttcatatgtagatggatccaaccgctccaggcccgcgcccatttggcctttgattactcggggccagaggacacgacccgggtctctcgtcggggtatttttttcttatatttcagattttattccggatgtgcatgtttctcctgacttatcgagttcctgttctcgatctacaggtttggacagcaacaccgtggagcgccgcgtcggccaagtgatgatcagctcccccctcagcgacggataatgtcccggtccccctttgcgagaaggggccagccgaatgcaccgccgcaattaatgtaagtgtactcgatgactcctttacatccttctcctcgagaccgtattgtgacttcatgttacacaggctctccctctgacggatatcatcgggccactcgcggaccatcaggcggcggcgtcgttgaaggagggcgtcaccaaggaggcgtccgacgtcgcggttactgccactacaagcggccgcaacgttctgaagaaggggagaaagttctcctccatactcgggacccgtcggaaagcatcaaccccggcggtaagcctctcctatcttttaatgcgttgtcggaatgttttgacctcacaccatcttatcttgcttaggcctcggacgcatctcctccacctcagcgaaggcagaggttggtgacgatcggcatgaagtaagtatatgtttttgaagtcttttcattcacgagaccttggtggcctaattttacgaaagggctgaaattcttcgcagggcggcgcgcgcgaaggcgacgcaggacggggccggcgcgacttccagcgcgtcccctgcagcgacctcaacagatgttgtggtcatcacaagggaccgggaggcgacaccaagcagccccgccgtcggcctggtgcctattcggagcccggctgctgatgcccttacctggggggagctccaaaccgagatggagcgtatcatccaggtagatgcccgcggcgtaggccgcgagatcaaggaggccagggcagcggcatcttcggcgactcagcgtgccgacaagctggcgtgcgacctggcggaggcccgcgaggacctcctcaagatgagggagctggtggctggcaacgagagacagcgacaagggctcgagcaccggatgtcgtagctcgagaacaacttgtcagagttccgcggctcgctgcgggtgtcttacaccggcctacactagctcgctggggaatacggtgtcatgaccaccatccccgttaacccggacaagttctcgctgacgtcgtcactcgcggagctggcgacggcgatgggggcgatcccctccaaacatgcagccaggatcggcgaggagacgtccaacgggatctacaccggggcgtgccacgtcctcgcgtgcatgaggttggcgcaccctgatcttgaccttaagaaggttttcgatcagggggccgccgatgacgcgcgtcggggcgtgatggaggaggtcggtgacctgggggaatccgtgctcccccttttttgaagagtagggctttatttcccttgtaccccttaaccaatcatgctgtaaaaactttcgtgggttcaaactgcccttatgtatgtagttgttcctttgttttcttagcatgtgattccgagtactttgttgtcgttgtagagatgtcgttatcgaggatgtccagcagcgcgggcagcctaagacgccagtgatcgtcccggcacttgcgcttgagtcgtacgtgccgcaggaggatgtcagtcaatgcctgtccgcggagacgaacatggcgacgacgtccctaggtttgcaccttggtttctacttccttcactcttctgtccggattgacttaatttgctatgttctcgggggagaagaacaacttgacttagtccttttcgtgttgggcagacctcgagagtgcattggccgactgagatcgtcgaatccaaaactggaagacgaagctcgaggtggccgaactcgagaagaccatggtggaggtgaagaaagaccaggccgtggaagccctcagaggtcgcgaggtgtggttcaactcgtacctcaagagctgctgcacggcaatggctggagtctgcagggagcttcgagttcctcgcgggaatcctgaggagttgacggccggatacatctcgtggttgaatggggcctgcacacagctcgaaggggtcggcaagcgcaaagacgaggccctgaagcaggagttccgtcgatcgagccgctatgccggagggcatgtgctggcatttatccgagatcatcgccgcaactgcacctcgagttcctccacgaagggttcttatgttctcgtaggactcccgcagagattgatgatctggcgaaatcgatggcgccgctcgccgagaaggtttttcagtccatggattggcgttggccgtcctagtagttgttgtatcctatagaaaatatctcaaggaaacatgtaatatattttggaatgtttatgaatttcaagaggtacttgtgaaatagaatagaaatctatctaagtaagttttcttactctggatgtgctgtgtatgagtgttttctcatttcgcgacttcgatcagtcgcttgagtacactctccctagcccccagccttgtcgtcggagagttgttctcggaggataaggctcttggacccttgacttgccttagttgaaaaggcactgaccctagcccccagccgtgaagttggaaaactcaatttccgattacacgacttggttaatacgtacggcgagaactcttacatgaccagatcttacatggtcgtttgtctcttcatgatctgacaaggtcttatttgctctgggcgtccccagccgaagttcccttaggtttcacagaggccttgtcgagacggcgtaaagggacatgaggataggtttcagcgctaggtgtcgtcgtggtaagggatcgttgggaaggaacactttgaccgtaatctttacctgaaatcaactttattgaaattgtaagacgtcttacaaaaaatggatactattgatttatacataaaatttacgtaattgatcaatgttccaggaatttgctaactctcgaccctcgccgtctgcaatcttgaatgcacctggccgtaagacttgcgtgatcgtgtatggtccttcccacttgggtgagagcttgttgcaccctgcttggctttgaacccgtcggaggacgtaatcgccgatcgaaagtgtgcgtgctctgatgggcttctcctggtatcggtgaagggcctagtggtagctgactggtctaacggcaactctttctcgatgttcctcgagtaggttcacatcgtcgcttcattgttcctcctatgcctcgtcggagtacttctgtactcgtgtgctctaatgttgtagctccgtggggagcatagcctctgaaccatacacgaggaagaagggtgtctccttgttggacgttgtcggtgtggtacgcacgacccataggacagaggggagttcttcgacccacttcttgtcgtgtgacatgagtctgtcatagacacgggtcttgatcccttgtagtactatgtcgtttgccctctcgacctatccattgctctgagggtgagaaaccgaggcaaagcagatcttgactcccaatccgatgcagtaatcctggaaatcggcactgatgaactaggagccgttgtctgttatgatgcggtgaggcaatccatatctgcaaaatatccctttgataaatttgatggcgttgtcggccttgatttcccccatgggcgtcgcttcaatccacttggtgaacttgtcgatcgccacgaataggaacctgtagccgccctgtcctcgtgggaatggtccgagtatgtcgagcccccagcatgagaacggccaagtaagagggatagtctggagcgcttgcgctggtagccttgtgtgtttgctgtgtaattgacagacttcacaccgctgaaccatgtcgcaagcgtctttgagcgcggtccgccagaaaaacccttgtcggaaagcttttctgactaatgtctggccggcggcgtgtgacccgtagatcccttcgtgtatgccgtcgttggacgaaatgcgtttgagaagtaccccgattggcgcctttttgtatagatcattgccgatcatacaatagatcttggcttgtcgggttattttcttggcttctgcatcatcctcgggcaactcgtcgctactcaggaacttgacgagtggtgtccactagtcgtttgtggtctcgatgtcggcaacggtgcgttctgcctctgtagcccccgagctgatgtcggggatgactgtgctatcttcgtcgttcacctctttcaccgaaggctttgttaggacatccagaaaggtgttaggttcgagtggctctcgtctggacgcacgccgtgctaggtcgtctggttcgatgttgtccttgcggtatacgtgtcggacctcgatcccatcaaatcttttctccagcttcctgacttttgcgagatacttggataactcagggctagagcacttgtagtctttgtgcacctggttcgcgacttattcggagtcccctttcatgattagtagcttgactcctagtgcggctgctgctcttatctcaacgagtagtccttcgtactcggctgtgttgttggttgccctgaagttgaggtgaattgcatgcttgaactgatctcccgaaggtgatgtcaagatgaaccctgtccctgctccttggctattgagtgtgctgtcaaacaccattgtccatgtgtcgttgtcggcctgactgtctgccctattgtcaggcatagtccagtcagctacgaaatcagcgaggacttgggacttaatggctgttcgtgacacaaagtgaacatcaaactggcttagctcgactacccatttcgcgatgcggccgacaacgtctttatttctcacgacttctccgagggggaaggaggaaacaactgtgactctgtgggcttggaagtagtggcatagctttcttgatgtcatgattactgcatagagcagcttttggatctgtggatatcttgtctttgcgtcatggagagcttcgctgacgtagtaaactgctctttgcaccttgtctctctcgacaacaatgacggtactcactgagtatggtgtggcggcaatatagaggaataattcttcgtttggttgggggccaacaagtacagggggatttgacaggtagtttgagtgcgataaacacatctttggcttcctgtatccacacaaatttgtcttttttttcaggagagcgaagaagggttgtccttgttcacccatcctagcgaagaatttgctcaatgccgccatgcatccagttagcttctggacttccttgagtcttgtgggcgacttcatgttctcgattgccttgatcttcttgggattcgcttcgatccctcttcctgagacgagaaaaccgagtagcttgcccgatggtactctgaacgtgcacttatctggattgagcatgatgcaatatcgtcggaggttgtcgaacgtttcccggagatcatcgattaatgagttgtttgtcttggtcttgataacaatgtcatcgatgtaggcctcgacattgttcccaagctgatcgttaagtgccccttggaccgtgcgttggaaagtatttcctgcggttataagtccatgttgacgaaaaaatcgaacacaccggcctgggagatctgcttagctccagtgtaggtccaaatattgatgagatgcgggcatgccagtcagtttgatcctgcaacagacaagatatgtaaacagcagacaaaacagctgatcggctaggcagccgatggagcagttccagccggtagccaataatagccgataccgataccagccgatagcgatagggtttaggcaatcagctatatgtccaatgtagataatgatataaaggcaatcggctgatgataatataatatagcaatataatccagtataaaccaatcggctagcaatgatatgataaataagcatcgatccgaaggttaaagcacacatcggctggaggtctgatgttttgaaatccacaagattagattaaacagtgaaaactttgttgtcatcggctagatgcaactcatatgtatatgcaatccttatgagccgatgcaacgtccaaataacttatcggctgaaaccccgatgaaacccttattggcagtcaaaaagcaggctagagattatggttctaagcacgacttaatagatcaagctcaactgattcagcactaagtgtgaaaagaagcacaatatctagacaatcaagccgttgactgattttcagggtggtagatgtctaggctaatctaatctagcaacacgatttagccgataccggcagaaaccctaaaacgagaagcagctgatagagctaaattgatatgctaagactagattaacagagacatatgataagtaggtaggcaaatatatcatccaaaccagagcaatccaagaggtcgaatgtactgatgcagccttgaatgacaccgacgtagacgatacaattgcctggactgacggaacattggacttatcccttcgccggagatcgaacaccgatgcagccccacgtcaggtgccaagtcccgccggacgataaaataaagcagaaaaggtaaaaggtggcgatgcgccaaattgtattgatcatgaagatagattacatagaccccgggtgtacatatttatacccatgtgttgatacaagttcttgtcgaataagaaagaaactttcctaaagataaaaggaaaagataaagcctttataggacactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacactgacgacttgacaactctcattggctaatctcaggccttcgaagccgatgctgactctaagccgatgactactccgggcttgccaaatttcactgttaatagaccaaacagcatcttaacgtagcagaatacaccgaacggcgtgatgaatgatgtcttctcctcgtcatcttttgccatgctgatctggtggtagccggggtaagcgtcaagaaaacttaacaactcacaaccagctgttgagtccaccaattggtctattcgaggaagagggaagtgatccttgggacacgccatgttgaggtcggtgatgtcaacacacatcgtcctccacttcccattggccttgcgcaccatgactgaattggctagccactctggatggagtatctctctgatgaagccagctttgagaagcttgtcgagctcttctcgtatggcttgcttctgatctagtgctaatctccgcagtttttgctttactggcttggcatcgggtcgcaccatgagtttgtgctcaatcacctccctagggacccctggcatgtcagacggctgccaagcgaacacgtctgcattgtcgcggaggaaggtgatgagcgtgagttcctatttctcatccagtgacgccctgatcttgatggtcttgtcggggttggcgctggagagtggaacgatgttgattgcgccgtctggcttcggagtcttgttggttttgctcactatcttgggcggttcaactgtggtgggcgggttgggagtatgctcgaccatgtcgaggctccgcttgccgcactgcaccgctagcttcggcccaggcatcttgagcacttgatatgcgtagtgggatgcggccatgaacttcgcgagtgcagttctcccgatgatgacattatatgctgtatcaaactcggccacatcaaaggtgatctgctttgttcggaagttgtttgcctggccgaaggtcacgggtagcgtaatcttgcccaatggtttggacgatgactgaggactaattccatggaagggttgatcagtgggcgtcaaatcgcttcgtgagatccccattgcgtccaatgcgctggcgaagagtaggttaatggagctgccgctgtcgacgagaacccgtgcgaccttaatgttccaaattgtgggctcgaccacgatcggatatcgccctggagtaacggcagccttggggtggtctgcttctgaaaactcgatcttctgctctaaccacttcatcttgggtgcagccccctgccatgtcgaacaaactttgtgctacactttcttgtactctcgctttgaggagtacgccgtggaacctccaaagatgtgtgagacatggaggtcggagtctgggtaggctgagtctgagtcctgagtggctgcttctgtggccttctcgactacacatactcgcttgcccttttctaacgctagtttgtttcgcaagtgcctttttgaaaacgaaacaagtctctagggagtgcttgtctgacttgtgtaaagggcaccatattttcttcgtatcgttgccttgtgggtctgggtgtttgggcgggtccgcatactctgctgtgaggacttctgtttgagctttccttttcctactcctgtgactcttcttcttgcttgactcaggtgcatccttggctggcttcttctctccccctatcttcggcttgtcgttcttgcgtctcagggcgtcgtccgcataggcgcatcgatcaacaatctcgaataacttacgagcagttgtgatccttctagttgccaattctcgggtagtgtagcgatctcttacaccagtcttgaaagcacggattacggaagcatcggtgatctcggggatcgtatttttgcacttattaaagcgctgaacgtagtccctcaatgattcacccggattctgtgtcaacgtgtgtaggtcgtcctcgatcgcgtggcgcttgtatgttccttggaagttggcgatgaactgctgccacagatctgcccatgaagaaatcgagtagggcgggaggtgaaccagccatgaacgtgcaaatcccttcaacgccactggcaaataatttgctagtgtgttgttgtctgctccggcagcgtagagtactgtggaatagacctgaagaaattcctctgggtcggtgcttccgtcgtatttctctattgctcccgatcgaaacctctcaggccatcggacatcacgcagggcacgactgaaagccctacactcgccgccgggggcagtgggttgtcggcgatcatatgttctccgcggatgtctatccgttgacgaagacgatgatgatgatgacgacgatgacgatgaatcactcagttccggtgtgcgttcgggttcttgagaaccttgtcgccacccaccgttgttgttccggcgctgatctctgtcgttgtcttcattgcgtcggtgtcctcgaccagtatcgcccggcacccgttgttcgcgattatcgtatttgcggcggttgtggcgattatcacggtcttggttcccgctcggatgtcctccttgctcttcattctcacgatgtcgtgaagagacgcgacgtcgggaacgattctcgttgtcttggccacgtcgcgtttctcggcagccatttagatggtcacggagatcactggcgccgcgaagcggagggcttgacgaggtggcgttcactgcgcaggctgttccccattggcgccgccggtcggcgattgctctggttgtaacctggcagcggcctcctcgaacgcgttacagagattagccactgattcccgttgtcgttctgtccagtgatcgagatcagcgttcaggacaggatcataaggtgtttccctcagtattgcgttgatggtcctgatgtgttgggccggcgtttccacttgattctccgcttctgtgttaccgcccctagacgtgctggtcccatcgatagcgtacacatcgcgtggtgtacttgtcgacgatgaggcctggtcttcgagcaaatgtagaacagacggctcgtggggattgatatcgattaccccaacgaatcgatctgagatagctgtcgctcctcgttccttgtccgtatctctagaagagatttgtgactgctggaccttaggaggtggcgtcctcatggcgctgagaagaaccttgcagcttgagaagtcgtgattctttgtcttatgaataggacaatagacatcatgggttggagaagtatgttgaattccacgctctttgcaggcacggatctcggcttgtacgtcaagaaaaacccagcaggcttgcaaggtgtgttttctggtttagtgaataggacaccaggaccttgttgcctcggaagctgtcattgtcggctcgtgattctcgtcggaaggaccaaatttggccgcattaggatccttctcgggctcagatgtcgtcgatgttccgttctccacttttgcgggaggatccttcgacatggagccgtccggggtcgtaaccacatcgttcttgcttccggtcgttgatggaccagtcgagatcgacaccgtcgtgtagaccgggaagacgatttcaccgacttgagtccacaccagcattgttgaagctaaaactccttggttgatgccggggttgacgctgtcgtcgacgaggcttgatggcatagtagtagaaccttgagcaccaagtccccctaccaggcgcgccactgtcgacgggggataccggtagaccggatatagagggtattggggtacgttggaacgaggatctatgtaatacgacatcaagcaaacaaaagacaaggattatactggttcaggcgcattggtaggtaatagccctaatacagttggtatgggattatatgatggaaaccacagattacaaagggaataatggaactcggcgataccgacgagatcgtagtcgagttggttcgactagatcactcggcgacttggctcctgtaggctccggcttcgtaggctatggtggatgtgttggcggtgagattcgatgcccttggtcctgcccgagggtcccttttataccgcgggacagttgatctccaagtaggactcggagatatcggacccctcacgatatagtaacgacccagccttgtccgagtaggactccttccatctatggactccgcttctgtcacatgatagatttccttaacgtatacatgaagtatctgtatacgcgcgggtataccgtatcagcatacaacgtatatatccaaggatagagggtatatcttaaccgtaaccctgacaccagcggcatggagacggcggaaggattcatgttggaggcgactgcggtccggcgggggcaggagaggtggcgacgttgtctatttctctctctctctctctctatgtgcggcggatggcatggtggcggcggagcttttgaaagttttgtgtgttcttgttggaatattccatgtgttcttgatgaaaacagtgtgttccatgtgtgtccttttttttggatttttttttgttggaggggattctgactgggatttttctggggtgggggacggaccaaaaatcccctgacgaacgaggtgacgaaaggaaaaatatgaatcttttaattagttaagtaagataaaaattaaagatgtttttaccagtactttggtatgtcatctgtgtttgaatcagttttgattttatgtttcggttttaatctctatctctaataatataaaaaagaacgagaaatcaccgccgtctgtaggaaaaaaatgtccgactcaaaaagcgataaaaaaggctgggaacaagaaaacatctctgtcacagcctgaatttccgttttaggatttataaattatttaataaattattaatagaatttatattaaatgctcattaatttacaagtgaagttaaatgtgggaaataaaattttataaatataaagcatggatggatttaagttgtattaaattctccatgattaattatactctctgaaattttctcggaatttttcggagctcaattcctaatgttaataatacaaagaacagtttagcaattatttaattaataaattaatcattaaatggtatggttttaatatttttaaatactttgagtgtccaagtatgttcaatatttttcttggaattatttgagcattgaaagtatttttaacaattgaaagatcatctcattggttaatttatttggaaaagtaataaaaatcctcctcctcagcctgggccgaattcagcccattctctcccttcctcacagcccagccaaagtctgatctacctccctggcgctacagtactccatcttcctcctccagacagaggcgagccagccgtgctcgtgcacagtgccgccgcctcctcccaccaatccaacctcccgttgctcctctttccaaattagttgcgggaatggaatcccctcaatctcctcttccttttccccaaaaaatcaccaaaattttctatggaaattctttccaatttcgcggatcaaatccttcctttttccggcgagaaccctagactttcccgagtttttcccgtcgttgtcggcttgatccggagctcccgtgcctatataaaggaccctctagtcgtcctctccctatcccctcaagtcccgtccgccgccgtcgccggaaacgctctccccgcgctctccctctctctccacctccggccgccgctccgccgccattcgccgtcgccccggccgtcgccctcctgtgccgccacctccctcggcttcgcagtgaagagctctaccccggccacccgttcttttgcgccgaaccctgccggaagtcgccgtcaccgtgaaggccgaaccgttgccatgttttgatctccggcaaggccttgctgctccttccgtcatcgccaagcttcgccgtcgcctccattggattcgcagctgcgaagtgaaccccgtccacccctctgttgcctccgttcgtcaccggaaaatcgtcgccgccgtggagagtacctcgccgcccttcgaagctcgtcgccggccatcttccgtcgccgtctgtcgtcgcgtaagtgttggtaaggaccgtcgccttgcgctcttcctcctggtacactccatttgcattattgtaccgtggttcgctggtaactgccgttctcgtgcttgcggtcgtcgatcctgcgtggcagccatgtcatcgctgacatcagcgccatcttggccatccaaaattaatttaaatttgtcatctcttttcaatgacatattattcctttttaatatatgtcatctaccaaatatgatctaatctttttccggtggatgttttaatcttctgtctcagctataaatcatttgtaaattgtttaatcaatttagaatagtcttttctttaataggtttaattggaattaaatcttgtaaaattcgtaactaattcatacgaaatcggaatgagaccgttcaagtctctaaatttatctaaaatcatgatctacatgtttgtttacttttatgtactgtttatttggtttttattagtctttttcctcgttttgcgtgttagcttgtcgtttccgtcgtttcgaaggttcgtgagtgcgccggaagtattcaagaagactgattgaagaccgaatattgcaaggcaagtcacacagatcacaaacaaccctttgagcatgttgatgaattaacatattgtttgttatagcccttttgttcttgattactttattacttgataccttgggttattataacttgactagttgagctttatatattggttcaactagatattagatatgattgcttagccatgcttagaaacattagcacactattgggataactaatgtttcactattacttaatgatggatatttaattgtagctcacgatggtcaatcgtgattggttaattaattaatgtgcctactaaaacttgataatggtgggttgtgagcacatggttttgatggtcgtgctcatgacaattaaggactggttcacgatttttggttgtaaaacattaaccgtgccaaccacaagccagcgtgggcaacggctttaccttttgtatatcatggttcattgcagggcaccagacggagataagcccacgggggtcgctggggagtccatgccttgtttataagggggtgattatgatccaggaacggtgcgctgtggtggattgtgttgtgcgaggggtactgtcacagctcctttccgaggtaccgtggtggtatcgaggcgcatggtgacatgtcgtggggctgtgtcttgtgggtacagtggtacacctctggccagagtaaaactattcgaatagccgtgtccgcggttatgggcgggtgtaacaatgtctttcgtgattagtctcacacttctcaccataataaatgatgctataaatggtaataatttgattagctcctggtttggaatggtacattcctggtttggagatagatctgtgcagccgggtatggttgttcaggatggttgggcctgtgcagcatgggtgtgctgttcagtgttgattaatattgatgattaattactctactgttttaaaattctcaaatatttgctaaatgctgcttttgcaaatgagccatcctttggtatattgataaatctgtatattaaattccgctgcagttttcttttcttttgcaaattccgctgcagttttcttttcttttgtaagtatgtaacgttattatattgataaatctgtatattaaattgtcagtttgtgtacctcggctgattcctggacgaggatttaatgcacaaattagttcggaaattactagtgaatttccgggcgttacaagttggtatcagagccatctcgactgtaggataagccaaatggtcaaaccttaaggacgaattttccgaaaacatgatttgtgaaaatttctcctttcttccttatctagaattctttgcaaattgtttcattgtaaattaatgaactatcgcggtcgtccgaataaccctcctgaatcacaaaaccggacattcttcacccccaactatgcaaaccagacgaattacccccctcgacctaatcagcggtggttttggtctacgtggcagtccagtcagtaatttatttattaaaaaataggtgggccccacctgtcagtttctatctctctcctatctcttctatctctcactgtctcactctctgcccttcttctccttcggacggcgacggccgaggcagcaagcgcggcggaggaggcagcggcaaggcggtggcgttggagagtggcgggggcgaaggagagacaagcgcggcggggccggaggagaggcgagcgtggtgggggcggcggagaagcgagcgcggcggcgagg

SEQ ID NO: 74514 - DNA, 19335 bp, Oryza sativa
caccgattccatcgctcacccgagcaccgccgccgtttcgccgccttctgcagcctcttgccgccgttcccgtccacctcaagccgcgccgccaccaccactagcttcgctgctccgccggcaagcccggccaccacgccgctcctccattccacccccgagccgcccgctccacggtgaacccgagccacagccacttttgtgcctccagtcgcacctctgccgtcgccctggccaccgccaagccgtaccgtttccttcaccggctcggccgcttcaagccacagatcggtcgccgctccaaaccaccggaaacccaccagtgctccattcctttcgatccccggtgagcccgccgccgcctaatccgtgccgccggccaccttctcgtcttcgtctcgccgccccattcgctcggtgagaaccgcctccctctccactctctcgccgcctctcgcgccgtcgccgctcgccgccggcgtcgtcgccggtggtctaggctcggcggtcgccgccgcctgtgggcgtgcctgcctggtcgtgccgctcggccgcccccggccgtccgatcggccccggccgatccggagcgtcgggtgcgcgcccacgtggccggctggcgccgtggactcggtccacggtgggctttgccgctgacgtgtggggcccacccctttgtgacgcggtctgcgcctcaccccttgctgacgtcagcatagcctttttcctttgaaaaattaaataataattgcgcaataaatcggtaataattgtaaaaatccattaaaatggctcaaaacttctaaaattcatatctaattcattcgaacttcgaattgagccattcaacttgcaaaattcatctaaaattgagctctacatgtttgtttagtttttatgtactgtttccttggtttttattagagtttttcctcgttttgcgtgccagcgtgttgtttccgtcgtttcggaagtccgcggtcgcgaggaaaagagttcggaagatcaaagtgaagaagcaaggcaagtcacacattccccttgagcattttgatcctaatttacaaatgttttactgtttgcaaataaatatgcatgttttgctaattacacgggatcagggtttacctatctgctcgcttgtgccatgtttacttgatatctatcctttgtcaaccttgagtaataaatcgactagctcatgttacttatgtgacttagctagaactatatgcttagccatgcttaattaccactagctcagttgatgggataattacaatattagacctttttagtatcagagtgagctgcgtgctcgagacatctggccatgcttcatggtcgtaattatccaactaaaatgcgactgaatggtgggttgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagcggggcgggccctgcgatggcctctgtcgcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccaaattcaccgtgattagtcccaccttaataaatcgactcaatgcactgtagttcaggtgggttggttgggcctgttcaacgtggtgtagcgttgatcagtggagatttaatgttactctaaatactcaacagttttactgttttgctcaataaaatgttttacaaccgcctttatgcaaatagccacaaaccatccttgtatccccttgcacgtctgcatcgttggagtggcttgctgagtacggtggttgtactctgtcttgctattattcccccttttcagaagtgtagtgcttctgagctgaagatggagttagaggaccaaagctcagaccccagttgagttttgcctgtggagtggagctgaagccccgctaggatcgcctttttccgctgctgctgcttttgtttcggtgtgaggattaagtgcctcttctgtaagtattttacgctttatttacgtttggaactgtatattacttgtcgttttgtgtaccctggctggtcctggacagggatttaatacgcaaaatagtctggaaatttgggttaaatttctgggcgtgacaagtatggacttcatcgaaggtttgcccaaatctgaagggtatgacacaatattggttgtggttgataaattctccaaatttgcgaagtttattcccctttcacatcccttcacagctttgcaagtggccactgcttttattaagaatgtctatgatatctttggcatgccccaagtgattatttcggatcgcgataaaattttcactagtgctctttggcaagaactgttcaagttggccgatgtgaagctcaatatgagctcttcataccatccccaaactgatggacagacagagcgcttgaatcagtgtctggaggcttatttgcgttgtgctgttcattcttgcccaaagcattggtctaagtggttgtcgcaggttcagcattggtataacacagcttatcatagtgccttggataagtctccttacgaagtgttgtttgctaggaaaccaactccatttggccttattgatgttggcgacagcatggtacctgatgtacatgtttggcttcaagagagggctcatatgaatgaagtgcttcatcagcaacttaccagggctcaacagaggatgaaataccaggctgataagcatcgttcaaaaagagttttcaatgttggggatatggtttatttgaaattacaaccatatgttcagatgtcagttgctaaacgtagttgtcagaaactgtgtttcaggtactttggtccatacaagattttggagcgcattggagaggtggcatacaaattggacctgcccccacaaagtcaagttcatccggtagtccatgtgtctcttctcaagaaggcaattcgtcctgatgtccaagttcaagccgatcttccagcaagttgcatggcagaagatgcagcaattttccctgaagaaattttgcaccgtcaactcatcaagcgaggtaatgcagctgtgccctatggattagtccgttggacaggtttgcctgccgctcttgctacatgggagaatctatgacagctgcaatttcgtttcccatcttctccggcttggggacaagcctcttcttaagcgggggaaattgttatgtgttgtgtgtgctgtagcttgtcagctgttgtgttccctgtattgagtataactgggtgtttgggcctggcttgttgtgggccgtggaccgtgtgtgtgtgtgtttacgacgtgccgtgctggactggcggtcgcgtcgagtgcgtgtgtcttgtacccgttaaaaggggaactccctgccgatgagcaggtatcgatgagaagaaatcaaatacaatcaaactacctctctctctctctctcagttcatccccttcctctctaattcaacccaaatcccctagcgaattccggattagcttggcgtgacgccggcggagtcttggagttcgtcacacgatctcttcctttttatgtatctggtcatctggatatgctgatcttctgaatggaaaaaaaattcattattgattccctcaagtcacaaatacttgcatcggacacatgaaagtggctacatttcagtgtgtcttttcaaaaaaaaaaaaaaacttgcatagtcctctcgtgatttttaatagttgaggttattaataaaaaaacacgaatattagagaaagacctaatatcaaataattggaaggggtgaagcttcgaacataggtcgtctagcccaccaccctgtggagctagccgggagacccctaggcgtttctccgaggttattaacttatggacacatatttgattatttgtcttatgcaaatacataagatataaattatatttaaaacgcacaaacaaaatcaatgataattacttatttcatccagttccataattcttgacattttttacaaggttgatatcaaacttttttaactttgactaacaataactatgtactactagagatttgtcttacaaaatactataataaaagtatgaaaaaaatatttattatacatattataataaaagatatagttaaaatttttttgaagactgttattttctaaatcataaaagttaacaaaccggagataataagtttttgaataagacaaatagtcaaatctgttgaaaattcaactgcagtgcttactgaaagacggaggcagtatggcggacttaaaagatgagtgctaggttggcccaccaatttcttgggccaagctgtgacccactctaaattaatggacgaagctaaaattgtgattatgtagcgttagtcaatttaatttagtcgtccaaatttagtgcttgttgctgatcgccaaaagaaaagattgcacgcagctacgacggtgttgagcagcgtgcttgtggaccaatatttaacatactatctttttttaaactcaatatattaaacattaatagcaaagtacatggataagttcatgatgcaaaaacagaaattgtgatatttaacatgctaaatgcaaaaaccagcatgttaaatgctatgattatgatctaaggattatcattaatctatcatgatgcaaaaatggaaatttcatgctatccaatcatactagctatgacgagtctaacgaagcaaaaaaaagtttcagatgctgctctggtgttaattgaggagttcaatcctggcaacggtttatagattcttctatatatagatctctgaatctgaatccttgaggcacgagctgttgtttggtgttgtgcagtgatagaatgaaagattttctagcattatttatatttatatagatgttaatgaatctagacacacatatatatcgagattcattaacatctatatgagtgtggacaataatagaaagatttatattataaaacggaggaagtagttcgtatcacatattgtgtttctttattattgtaggactcttgcacatttatttgcttgttttattcagtcatcacccgttttcacaaatatccaagatactgcatatattcgccatttctgtgtgaaaacatgaaggatttgactatgatgccaacaagtaaattatcactactcattttgctagttgagatatatcattttttaagataatagttgagatatatcataggttcaatcgttcaagttcctttccttttgttttcacgaaatagatccaatttctgagttttccttcaaatctaggaaatgttgtaacctactcccagttatttttttcggcgttcctagcacttgttcttacagataatggtgtgaacaccatggaaaaatgctgtgaaacaaacggattaacagagggcctgagtacgccaccaacaaatcacccaaaaacaaaattttcagaccgagagccttcggtaaactgattttgacggcaatccactcacaattgatcataattgagtgtttcaaaatccaatagaggtttggcccaagaaattgatgggccggcccaatgcacgtcaacttcaagtccaacatagtattatgcaagtgaaaaagtatgcaaagtatattttaaaatttttatgcgcattgaagtttatatgttttcatttcaatgtatccgatgcaagtatttgtggcaagagggaattaacaatcaattattttttccattcaccagatcatcactgacccagcctagattacatatttaaatttaagaagatgggtttggtttcgatggacggtgatacgaaatgggatgccatgccggcggccggcggctagccgagctcaacgctggcaccgcggcgaggcgttgtcgaaggcgaggctgatcggcgcgctggcggcgtacgtgaacaccaccggcgaccccttcacgatctgcaggccgtcgttgacgaggcagaggccgtcgctgccggcggtgtggatcttgctccggtcgacgccggcgggcacgccgtcgaggcaggacaccacgacgtcgccctccgggcacgagcactcgttgccgatcgtcacctggaactccggcaggccgcccacgacccgcccggtcttcaccgtcgcgatggtgatgtccgacgggtcgcacggctccgggtcctcgccggcgacggcgacgtggacgtggcagaggagcgccgcggcggcggcggcggcgaggaggaggagaagggtggtggccttggtcgtcatggtggtgagctagtgattggatgcgtttgcttcactctcttttgtgtgaagaattagtgtagagaatgtcactatatatagaaaattttggaggagcatatatgtatatctgggcaatatatatcagattatcccaaaattagcgatttgattgtatcttcgtgattacggcgatggatttaattcaatcccctgatgagtgaagatatattgttctacgtggctgtgtatatccattttgagagactggatttctatccactgtctttaaattctacacatttgttttctttctaaaagtacagtgcaagtggctggtatgttatatcatcattctaccggaaatcgtgttttagaaactgtgtacattgagaaaaaaaagacaaatttatgtgtcgatagtattatatgctgaatttgatgatatttacttcacgatgtgtgagttaattttacacttgaagttttgtggtacatgagtaccggagtcaatgttagtactccctcaatcacagtacaatatcgttatagaattcctacagtaaatggaagaagctaactttgatcatggtaagtgcttaggcaaaatctaaattatgcatgcatactatttagttaattttatcgggtacagataacatggtccgcttgatcagtagtcagaagtggcactaataaactactccctccatattttaatgtataacgccgttgactttttaatcaacgtttgaccactcgtcttattcaaaatttttatgcaaatataaaaatacttatatcatgcttaaagaatatttgatgataaatcaagtcacaataaaataaattataattacataattttttgaataagacgaaagatcaaatgtttgtcaaaaagtcaacggcgtcatatattaaaatacggagagagcacaagtgcagcgtgccggctggcgtcgaccggagcaagatccacgccgccggcaacgacgggctctgcctcgtcaacgacggcctgcatatcgtgaaggggtcgccggtggtgttcacgtacgccgccagcgcgcccatcagcctcatcttcgacaatgcctcgccgcgcgcggtgcatgccagcgttgagattggccggccggcatcccatttcgtatctagtactatcatcatccatcgaaacgaaaaatattgtactgtgcttatatgtatctaggctgggtcagtgtgctgatctggtgactggaaaaataattgattattaatcccatctggtcacaaattttgcatcggatacattgaaatgaaaacatatataaatttcaatgtgtctaaaatataataaaaaaatacttgcatactttttctaataagtactccacttgcataaggccgtgtttctttcagcttgggattattataatctagattattgggagtaaactgaaagaaacagacaacttattaaaatagtttattataatctagagcccagcttatataatctaataagctcatttaggtgagctttttctagattattgcgtaaaaaattacccaccatgccactccactccctctttagacctgcaaacccaataatctaggctctaataatctaggaaagaaacaactaaccgcttattttaatacagattataacaatctagcttatagtaatctgactcaataatctagattataataatcccaagctaaaagaaacagggcctaatactgtgttggacttgaagatgatgtggattgggctggcaccaatttattgggccaaacctctaagatcttgttcggtttataggaggttgaagggaattggaggggttttaggggaaataattccacaccacaacaggtgtggaataaatcctctccaatccttctctcttgggaattaaccgaacatagcctatattatgcaactctcaattgtgatcaattgtgagtggattgccgtcaaaatcagtttacccaaggcgctcggtctgtaaattttgtttttcggtgatttgttggttgcgtagtcagtccagaaatgctaatgggcgggtgatcgctcccccgcttgtccagcgatcacccgtccgccccctccctatactactagatacacttctccctccttccttactacagtacaccacacaaaaatttaaaaaaaaacaaaaagttagaaaaaattatgtatagaaatactatatataaaaaatttaaattcaaattcaaatttgaatcgggtatgtaaactttttgacttataaactatgggtctataaattttaggtgtataaactttagatgtatagaaatactatatatagaaaatatttaaattaaaattcaaatttgaatcggatataattcaaattcaaatttgaatcgggtatgtaaactttttgacttataaactttgggtctataaactttgggtctataaactttaggtgtataaactttagatgcatagaaatactatatatagaaaatatttaaattcaaattcaaatttgaatcggatataattcaaattcaaatttgaaacaggtaaatttgaatcggatataattcaaatataaatttgtaacatgtatctaaactttagatgtgtaaacttgaggtgtataaactttaggtctataaactaactttaggtgtataaactttagatgtatagaaatactatatataaaaaatatttgaattcaaattcaaatttgaatcggatatataaacttttgacttataaactttgggtctctaaactttagatgtgtgaacttgaggtgtataaactttatgtgtataaatttactaaaataggaaagtaatacggtgccaaaaaaggaaattaggtggagggagggaggggggagagggtagcgaatctgatcgctaccccccattggcgggcgatcgatcgcccattagggctgccctagtcagtccctctgtaatccttttgtttcacagcattttccatgatgttcacaccatctatctatctatctatctattatatactaaaagtccattaaactttctacaaacgttctcctcatcgttcgatcggggtgtctttcatcctatccgtacgcgaaaaaaaactcccgtgccacgcgtggggcgatttgttgcatcgtcatgtgggatttgttggcccagggctagcagctcttaagtcgccatgtggcattctagaaacgctcttaacttgccacatgttactctagcaaattagagaaaaaagcaaaacatctaaccgttgattttcactaatattcgataatattcgatgatccatattttctaccatcagattgatctaaagaggaaaaagaaaaggcccacaccccacctccagccatcaaaagaaaaggctcattatgtatacgtatgtagttacgtaccatataccacaccctggcctcacgtgatgcacgagggagacctcccctcctattttcaagcaattagtatatagaaaacatattttgtgataaaaattttaaaacaactgtattgtctaaatcatagagctgattttttttattcgtgcatgtcatgggattatttacaataaaaagtttataattcaatttccaaattaactatatttaacaagtacaataaatgtattactttggatcctatatggcaagagactagctattggtcacttgatacatttttagcaaaactcacctagatttttaaaccatatgattagcatcatttagcttatattagaaaatacaacacctgatatattttctcagagatctaaaattatatctatcactaaaaaaaaaaaatctccggccctattcccgctgaacatatacctatggtcctctcccttcttactcccctcctctcctcttctatttttttttaactaacaacctaatataaaacaacgtagctaaacgatttatagtatctaaaattatatttgatttttaatttgtttgaactattttttatttacaattaattaaataattaaagatccattatagctgtattttactatacaaaaattaaaatactctgcatggaaactaaatgacaatggaacattacaatttaaaacatcaaaatatgtattatgtcatattaaatcattctacataataaaaccaattaaacagcctttagatcacacttaagtcaccattaagtcaccatatgtcacgtcttaaaattacaaaatatttcaattaaatcgatgaccaattatttttaactattagatctaatttaaaaaaaatcttacgctgccacgtattatgtcttaaaaatcataaataatcttagaaattatgaggaaaataatgaaacctatcattattggttttaagttacattatttagaaaaggttagaaaataaatcgcatccacctcctcacccccatcacatgcgcacaccattgcatgtcccctccctatatttagctattaaaatataagagaaataatcaataattttagatattaaaacaaccataacttttaagttacacatcttatttcatatatacaaaatatcgcattcagccacattcgacccatgcgctttgcataccatccaaatataatcgaaatagctcaaacaaattgactgcatatattacgtcattttacatcattccgtaaacatgcatagctaaattaaaccaatagtatccaaataaaaattacaagtgaactgtcgtacattttattattgaggtggaatacccctgcccttttacatgtcatttgaattgccataaaagaattttgaaatgatctaacaacacaggttgcatcatcatatgttgtttttgcaaacacgtgtagctaaattagatatacactatctaagaaaatagaactaactataaaatatgaatagtccaaagaaaatccaattccttaaagaaaaccgtaaacaacgagtttacctaggtaagcgagtttagctaggtcttaggttttcaccaatggacccaaaacattcaactaaaaaaagaaaaaaatgactttctttgaatctatacttaatttatttaacatgttttataaacaaactaagtcttaaatgatgatgaagattatttataattgcttatacagttaaattaaatatatatataatatagattagagaaattatcaaagcgatacggacgatgaatatttgtcaaggaaacatactctcaaaacattgcagaggctattcgattaatatgatccattctcaaacgctgctcacgatgcatgaccgcatgaatacgcgggctatctccctagttgttataacaacaagtgcaaaattgaacaaatgtgctaggaacaccgaaacaataactgggaataggttacagcatttccttgatttgaaggaaaactcagaaattggatctatttcctaaaaacaaaaggaaaggaacttcaacctatgatatctctcaactagcaaaatgagtagtgatattttacttgtttccgtcatagtcaaatccttcatcgtttcacacagaaatggtgaatatataggctgtgtttagttaccttcaaacttcaatttttttttgaaaaggactaaaacacggcttgtatcttggatatttgtgaaaacgggggtatctgaataaaacaagcaaataaatgtcctagaataataaagaaacgcagcatatgataggaactactctctccgtaaaaaaaaatgcaaaccctgggtttccgtgtccaactttgacggtccgtcttacagggaatttttttaaattcgtattttcattgttgttagatgataaaacatgattaatattttatgcgtgacttgtctttttaaattttttcataattttttcaaataagacggacggtcaaacgttggacacggaaattagagtttgtctttttttttttttgggacggagggagtactctataccactgcacaacaccaaacaaccagctcgtgcctcaaggattgaaattcagatatctatagaagtacctataaaaccgttgccaggattgaactcctcaattaacaccagagcagcatctgaaacttttgtttgcttcgatagactcgctatggtatgattggatggcatgaaatttccgttttcggatcatgattggggatcctatctcaggtgttggtctctctattgcagcatatttcacgatggaccagcagtctatcactgctagaaaaaatatttttcaaggcggacaaaatcagtcttcctaggcggatggccggtccatctgtacaaagaggtttgcgaaaatgaagttttttcgcaggcgtgccgcctggtcacatagccacttgcgaaaatgggacaaatctgcctggaaaaatatacgcgccaaaatataacttttttctgccaattttttaatattaacttttaattaataatgttgcaattagttaagtaatacataaatacatttaaccattaacaaacatttaattcggatataatgcatatattgcttaagttaaaagtgccgtcaatacatacagtaatatttacaactaatattgtcatttcgaaatgcacgaatataatttttattatttcatcgtgttggtataatcccgaggagacttgtattaattattcactcattgctatgctgacttcacttgcggtgtatgaagtgacagagatcccgctgtatatttttaatgcttgtgtcatcaaagctagttcgacgtttgtgtcatataatattctaggtgaaaccccacgcattgctacaggaatttattatgataataataaaaaaaataacatgtaaaatagctagataacatcagattaagtaagttaatgtggtttatgataatttaaatttaaatagtatgtagaatggtgattcaaacgtaaaaagtaaggtggtatgactttataaaagaagaaaaatagggagatagtttggaccgtagattaatcgatcatctaaaggctaaaaacaattgagatgatatggcttaattagagaaaaaaagagaaagataattttgaccatatagattaatcatttaagcactaattaactgaggatgaactatttaagtatttaggatatcataaaacataataaagatatacattgaaatattatgtgaattatgtgggatgataatttaacatgcttgtattttaaaagctcttaaattataaaaaacgataaaattattgataatatagcatgtttgcatgatgtttaaatgtgatgattgttagtggatgatgatgtagcatcttgttaattagtggatgatgatgtgacatctttagatgttaagcttaaagagttagtatgttataactttatagtaagataggattagtatattaattagatgtgcagttcaccattggaattatatctaagagatttacatcttacatcctttgcgttgctgttgtacctgtcattaaccctaaggaactcatatgtgtaatatccacaaaggacactgcttttaggttttcttgtgacatttcatgacatacacatagaaggaattagttatacattgcaggtaaaatttttaaataaataagtgtgtagagtattactagccagtatatatgcactagcaacttctctatcatttgcagttgttccctgccctttactttgtagtagttgtacgcactgtacacataataggatttatgattcgtattaatgaacaaaatttaataattatgaatacttcatgaatagtacttgcatggatcagaatcacttactattgtaagattattatgaattatctatacgacctgtgattataatcgacgaggtccagaactgtaatgttctcgtacttcgggtagagcaagaaacatacttacttacagttatatagagagaaatctatcatacttacttaaagttgtatacggacattatgactcttttattttgaaatttgaggaatgctcgtcccacatactcatcccacacatttatcccagccttccataaattctacatatgttccgtcagtggctcaagaaatacgtcaatatcaatccaagccgtcaggaccttatattaggacacagagtagaacggactttttcttttgacaaagccagatagaaagattgtacatggtcagaagcattggccaagtgctatgtgagttgcttatgtctccagatgagttcactccatctgtactcaaagcaaacataatattttgtgggtctttagcaaattctagttactttgcatcaaagtttttccactgatgagcatccgttgggtgccggagtatctcatctttcttgctcccttcttgatgccagcgcattaattccgcatctctggggttttagtacaaacgcaatatgcggtctttaacagaaatataccacattaccagctgggggattttttttcttattttcctcgaatgagttagcctcttctttctcaaaacttacacatggagaagtgtttttagttgatttgtacctgttagcactgcatgttgggaatttatccaactaagcgtactccttcctgtataggatgcagtggttcatgcacgcatggatctttttaacaccaagaaaaaggtgataaattagttttttcgcttgatatgtgttgcaaggtaatgagttaggcttcggtagcatgtttttcaaaatttgtagtaagccattaaaaatactagcaaaccaaccatacctggccttcaagcgcattagttcaagcactaatcgtagtgttgagaaccccctgtcacaatcctttgactcatcatacaaaagatccttctctgccttctctaaagattcaaaattatctgttgtctaatggacaactgcgtcacgtcgaaaggcgtggttctctcaacagtagttggaagtaaaaacaattgtattgcttagtgaaaaatttttggatccccctattacatggctttagggggctatttatagtcccattacaggttcccctttagggtttaagttttacaggggaatttacatggttacccttatgatagggaaattattgggggcacatagtgtcctttacatgtatgggcccctattgggtttaaatggctcggcccatttatttgccgaaatccctcggaggcgcaacagcccgcagggcctcctcccggtgaggttcggtactttgcgaaacccgtgccttcgtgccaaggctttcgcctcaccgtcttcgcctgtgcggccctctaacgaggtctttgcctggcgaagtccgcgtattccgagccatggctttcgccatgtggctttcgcccatatggtagccttctcaaccttcgccgcttgcctccggtctgagtctgttgcctaagctcttggtttcggtaggttcggccgagggccctcgtggtgtacctccaacattatctaaacccctaaccgaccccattagcacatcaggttctgtatggcgtaacatttcctctaaatcaatgatattatcaccacaactatcaccatcagcagcctcaatgtgatcatctttgtcatgataagtccatattgtgtaacccttcataaatccacacgtcaccaactgatcccttattctcgaaccgtctatccatactttttcattcttacaatcagtaaatggacaatgtatctccgttacattgttgttgtaagcgtgtgttgtggcaatatcaataaatttagatacttcatccgtatatgacgacaaatacctcggcatatgatagattcattgtctgtccataactctgcaaacaattcatttacaattatattataaattaaattgacataatagtacatatttacaaccaaactaaactgtgcttgttatgagaaagagaaatataaataagtaggggatggggatctacaacacataaatttttcctattatgtggggagtgtggacaatacatattttctctctctttgaaggaagatgtttttctctctctacactagatctaggtgactgggaaagagcaatatacatatagtttggtaatttaggcacaatggaagagagaataacatgacaccatggtgtatacatagatcaaccacaatcatagcataacaaatcataaaaatgaaaaaaaattgcatgcaaaacatggtgctttcactatttttgcatgcatagatccatcactaataaggccaaaaaataaaaaaattgtaagaattaatggaatgcacggatctaaccacggcagaaaaatccaccgaatttcgagttcaaacctccccaccccccaaaaaaatttcttgttttcagagagagaaactccatatgaactgttgggaaactcggggggaggaagcacaatatatataggaccttctttccgtgcgggccacttaagtgctccacctgggaagatggatcttctaaggtggtctgccatctagcccctccttcctatcttacagacggatcgatggggcacatttttagttcacctagaaatacggtagtacctcgtttaggaaaatggtttttctggtactatgttgtatccaccctcttgaggaacgtaaccttgggtctatttgggaagcgaggagaagcagtagaacacgaggaagggaaggggatgagagagaaggaggaaggataaaggatgagagaaggaggcgccgcagttgccggcgaacctacgctccacactatggccctgtttggaagattagcccaggactaattttgagaactaatatttagtcatgaattggtaggctaaacattagcctaaggtggtatgtttggatccataggctaattcaaggctaaaaggtggagagagagtagaaagtgaggagagagaaggagagagagagctgcttttttatggtccccacacaaaattagccccattagcatcccttggaggggctaattcacttgagccaaaaattagcccacctgtttggatcctcgagggctaattcagagctaaaaggtaggggctaatgtttagcccatggaaccaaacaggacctaagtcgcctcgcgtgtcaccccgagagaaaatggtggattatccccttcacatatttgtatctgttattagacaataccaatcgaccaacatattttgcacccacaatgacaagaaaaacaaaactgttcttctttttagaaggtaaagtcggcgttagttttatattcgtcacattcaaaaaaaattatataattatttacttcatgttagaacattttcttttatgtcaagaaaaagacaacaaacaaatgttggtcacgtttagtgatttaaaaagttgggtaacatatcgatatgccctctgattaaatagatggcgatgcatcgttaccattgagctaagataaattttattatccttgagaaagtatctggaggtatcaagattttactctagaaattttggtacccatcaaattttagagcatattttccatacttgaagaagtactatgaggtacgaggtatcatgaggtaccaatctaatctaactattggtttaaagaggcaggatcggctaatgaaaatgaggtgcctctgctaatcaccgcccactcggccaatagcgagttcgtccgtgccgccctcttctcctctcttccatctgccgcatcgccgttgcatcgccgcagcatcgagtctgccgctgccgccgtcgcatccagcccgccgccccgcggccgccgtctcatcgagcacccaggcactttgccagacggagctccaaatccatcacctgtcaatttgtcatctcgtcctccaccctcgtctcagcttccctggcggacgacagagcaagcgccccaaatcggtggctttcatatcaaaattttattcggcaaaattgctattcaaaaaaagttgaaatttatccaagaatagcctgatgacgaacatttatcaagtaaaattgctcttactaaaactccaaaaggtctgaacataaggggaagatgaataaaagtcatacatctgtctacgtactgaatactgaaagcaatatactaatatccatccatcagctgatgccggtgctgttcgatctgcttgctttcttcttcgtgcatgaagcatcactcggcaccacaaaggttgttgagcgtcctcgctatctgccgcttgagctgtggcgggggccaccgcctacatcaacgggattatcgcgatgagatttggcgactgctgtgcttggggcagccagatccaccccgctctcgcagcgcgtaggccttgcggtcggcggcaagtcggcgacagtcctagcgaagtcgagctgtgagaatggaagaggaatgtggccatggctgggccgccgggggatatcggtggaggcgtcgtccctggcttcgctcctctgctcgggatgcatatgcgaaatcatagttttacccctaaaacttacgaacggagtggaggcacctggtggaaagaggtgcggtactgggaggtaccaaatcttcccagccgtttgatcatgcgaaatcaatggctctgattcggtacctccatccctcaaggatggtaaaatctctctaaattttacgctagaaaatgtggtaccttcctataccttttcaagaatgataaaattacccttgagctaatataaaacctaacagttgtaaactagcacaaaagcattaggaagaagtcaaagcgggcggaattacgtgagagaaaacctcagaccttgtatgtgtgtactattaattttgttttctgaaatgtgcactcagagttcctatttttattgttgcgata

SEQ ID NO: 74515 - DNA, 57750 bp, Oryza sativa
agcatcaataaatagagctgaaatgcaacccccattgctcacaaaccccaagaatttcaccaaaagggagtgcttactctgagctaaagaaagagtactctgaagtctgaagtagtcttacttcttccaagcaatctgaagtctgaaccttagaatggatcagaaggattagctgcagatgaaggagaatacattccaggaaggaacagccatggcgtcgtcctcctcatcatcgtcctttctcgctcatccatcgtcgctgctgcgtcaggtcgtccatggcttcgccggctacctcgccggcctctgccgttctctccagaatctgaaaccatctgcagctccgaaacaagacgctgacgacgaatttgccgtcaataacactgctgcgtcaagctccgtaagtaaaacatacaactgtaccaattaatttcaataaatttcatgtaattggttcgttcaaagaacaataaatttcatgtaattgcatgatctagccatctaggtgctcaattgagcgagcccagtgattgatcagcaagtttggttgctttttttttggtcttctgagctgatgattaattttggtgtgtccttgtgagagcaggaagaagttgagaatgttcagatgagaacaagagcaatgccgcgttctgaaaggccggttttaagagaagggaacgggggaaaaggcggagcacaccacaacgctggcctttagcttcaatcgatgcaaagctttgatcgatcgatcgacgcgatcattatgtacaataataagttcgggtaatccatgcatggattactgttcttcgaaccgagcagtggctttgatgatttgttaccctgactgtacgaggaaaatatcaagtggaaataaaatttgcactcacagatttaaccatgagtaaaaacttagtaaaagttttactgtggataaatctcaaacatattccttatcctatacttgttttcgggttttcacagtatatgggaagtggatttttgtctctcgaggagacatcccctcgttttgtgcataacgttcaaaaagttataaaaaaatttgaaaaattttgttaagatagatcaatatatgacatatttttgcaaacaaagttaaaatccgacttatacaattcgaaacaaaaataacaaatttgacagtgaattacgcattctattcctagtcaaatttgttatttttgtttctacttgtataagttgaactagcatggtggcccgcgcagattgcgcggctagcatcattacattttttttctcatataatagtatatatgttttctcattatattattcaaacatattaaaatgacaacataattttaaattttgcaataactttacaaaactactaaagtgtaatattcatattatattttatatacgtgttagttatttattatttttaatatcaaattttagttatttgtaaattatatatattcctatatgtactctagactcgtcttttaatatttctattttttaattccgaattttctgtaaattgtatttctatatagactcaatgtttttccttcaatattatttatttttatttctgaattttcatattatattttatatatgtgttagttattaattatttttaatatcaaattttagttatttgtaaattatatatattcctaatggactctagactcatcttttaatatattttttaattccaaattttctgtaaattgtatttctatatagactctatgctcttcttctaatattatttatttttatttctgaattttttattatttctaattgtatttctatgtggactctaaactcatcttttaatattctttaatttttaatttcaaatttcagttacttctaaattgtattcctatatttgtattcctatattgatcttaaactcttcttcccatgtttttcttaatttcgtattttagttatttgtaaattatatttttatacggactctaaactctacttttaattttattatgtttattccaaattttagtcagttttaaattcctatatgaactctatactctacttcaaatattccttatcttttaattctgaatttctgtttttttcttaattgtatttctatatggactctatactctacttctaatattccttatttttaattccaaatttatattatttcctaattgtatttctatatggactctatactctacttctaatattccttatttttaattctgaatttcagttatttcctaattgtatttatatatggactctagtctcctcttctaatattccttatttttttattccgaatttcagttatttcctaattgtatttctgtatggactctatactctacttctaatattccttatttttaattctgaattttagttatttcctaattgtatttctatatggactctagtctcctcttctaatattccttatttttttattccgaatttcagttatttcctaattgtatttctatatggactctggtcttctcttctaatattccttatcttttaataccgaatttcagctatttctaaattgtatttctatatggactctgccttttctttttctctgattattgtgagaatttctaggccatgagagcgaacgtggagactctttttttatttctttaataatataatagatttgaatatatatgtttgttaagtgacatatcacatggctattcctgctcttatagacttatccttctctttaatttctctcagctctctcttatgccgatcttatcctctccttcttccttacgctgcagagatcttaacctctcctttttgtgctctgcagcgaggagcgagcaagggcggcggcggccagtgcgcgccggagacgggagggcaggcggccgggctggggaggtggctgaccctgaaccatgatgatctgaaatggacgaaattcaaaattttggatggattttgaccaaattgagatgaaatgggagttccactgtcttgttgaatttcagacgtttcgatctgaataaccccgaacatcttgccaattgttcatctgaatcgcttaaggtaggcatagtgattgcaatttggacaccacaatccacaatccccaccccccccccccaacccccctcccgggcaagtaattatatcgcccaacattttcgaatttctctcagaatttatgaatttggttaaaatttaaactaatttcgtgtcaaaaagtaccaaaaaccccccaaattttttaaaaaaatttcggtgtcagcgatcaaatttcgtccaaatacgacaaacttgggagttaaacaagagagtaggttgttgggttttgatccaatactctaaaaatatgaaataggactacatgaaaacaaatcagaaaattcataaacgccaaactgtatatgcattggtgtgcgccacatgtgcgtgttaatcaatctctcaaaaattaagctaatcatcattgattatccccagtgatgactgatgacagcttatataattatcctgatatttctgatgatcaccaggttaattaaattaatcaatcaatcagattttgctaataataaaacatggaacccgatgacgccggtgggacgctctgctgatactggaagctctgcaggatggtcgcgatcgtcagcgactcgtcgtcgccggcctccacttcctcctccgccgccgccggcgacaggtaatcatcatcgtacagcggcgacggcggcggcggcggtggcggcggtggcactgccggagacagcgcgtgctgcggcggcgaagggtggtggtggtgcatgtcggggtagaggaagttggtgcgcgcggcggcggcgccggagatggagatggcggagaggtcgtaggcgacggcggcctcctcggcggtgtcgaaggtgccgagccagtggcgctccttggtgtacgggttgcggatctccgccgcgtaccgcccccacggccgccgccgcacgcccaggtactcgctcgacgcgcgcgcccgccgccgccgcatcatcatctgctgcggcgtcgtcgtcgccgccgcagtctcttcctgccggtgatgctgctccgccgcgtccgccattgctgacgtacttagcttagcttagctctgcctgtctgtactgtggatgtaggtggtagggcttaattaggtttttagcagccatggaattttataggaaagcatggaggtgatcgacaaagcttggtggagacgttgcgggctctgcatgcatggcatcggaaagcgtgccttgctccatgttttcctcgacatgataagcccatcatcgatcactttcatgagttggcaatttgtaagttgatcctacatttctacttactccctccgttccatatcgtaattcataagttgttcttaccttttttttttctagtcaaatattttaaagtttaactaaatttattagaagctatactaatatttttaatataaaacaaacatattatcgaaatatatcaatgttatgtttcatgaggctaactcagtgtttgtagatatagctaaattttcattcaaacttaatcagatctaaagaaatttaacaatattttttatagttaatgagatcgacatacaacctttatatatacgtttttacataagattaaatatgaaaatagaaatagcaacctaagtgtcatgccattaccatcatcattttatttttcttataaaaaacttggatatgtcattttcatatgactaataaagcttactttcctaaacaataatcgtagtcaaaattaacttatgttaatagtatacatattctaaaattaatgacattcttacacgaccagaagaaaactccctaacccaatcaattcataacatgttgtttgtgtcatctttgaccgcaaattatgcatgtactccctccgtttcaggttataagtctttttgattatggtcaaagtcaaaccgctttaaatttcaccaagtttatataatatatagtaacattttcgaccaagataaatttattataaaaatatatttaattattgatttaataaaactaatttgataatgtaaatattattatatttgtatataaacttagtcaaacttaaagtagtttaactttaaccaaagtcaaaacgaattataacctaaaacagggagggagtatttgagaggtatcatcaacaaaactagaaacaaggttgcacaaaagtatggcgggtgcgtagtgaggtgctcgtgtatgtctcttccgtgtaatcgtaaaaagtatatatacattatggacaggtcacaacatggtcctggcacctgatgttgcacaaactgttgacacacttaactgacatgtctataaaaatgtagcagggcgaatgttctctgcaactttgcgtcttaatccagtccagtctcgagagtacaaagcactagtactgaagagtacacaaagctcattcagagacaactcatcagaaacctctccaagggtcttctgaaaacagattaatatatataccccccaagttggaggcagaaacatctgtcagccagctgatcttttatcagcaggcaagggtgacacattgaatgtcaagaaaatgttaattaatccatacactgcgtgcaccccactagtatagacaggcaccatcagcttcagcacctttacagagtcagtgccccttgtttcctgacctctgtttacatacctaatacccaaatgatatatagtgcagattcatattcaaacaaaatactaagaacaaaagaaacaatatatatgtatggccaacagctgtgttcaatttttacaatgtcatccagggttaacatgtacaaatggagataaattcactaataatgttattacatttgacaaggcaataagtcaaaattgcctcagatatctttttttttcataaaaaaactgcttactctggagacttcaataaaaaaacactacacataaatttgagtatgtatcaaaccaaacaatacgtggatttccatatcaggtattttactattttactatcatataatggatggatgaagaagatgaaccgctgcatctaataattcgcatgaaagagaaatacaactaagtaaccttgttcagctagatgcattgcaaccaaaattcctcatatgccagagaatcagagatgaaatccaattttttagctgaaccccaaaatttaaagagaaaaagctccccccaaaattaatggcggctcacttaccagcttactacagacaatgacggcgaagacgacggtgcgaactggagaaacgaagtcgagcgggccgcttaattgggtgggctactttcaatttgtgggaaaattcagttcccgaggtccacgaaagcccccgagcacagaacagaacggcccaatagaaataacagcccaaataagacaaccacatccaagagaaccagcagggtttacgtttccgatgaaagccgaccagttgtcccgaaaacctgacttcctgacacggtttggaattaggtgctgacggaagattatgatgtattttgacccaattcaaatttgaaataaaaaaatcatttaaataccatgatatttaaagaacttaatggcataaatcccgtaaaaataagtaatggaataaaatattttcaaaaaagcaagtagcttcaactagttagggttatggtggtagtacctgtccacccaggtgctcgtatttacggctaaaattattttttcaattgtcggtgatgtgcccgttgacaatgaggcgcaatacactgttgaggatatgttatgcgcgtgtatacgggagcatgcgcctttactctatgttggtccaactgtgcgcagcaacgagctccgctttggcctctccgtgtgagcccgagaacaaaccaggggcaagctcgagctccactttggtctctctgcgctttggatgtcaccctcaattgttgttggtcaagctcacccttggccgcgggccctcgagctcgtcctcggcggtcacccttgggctcgggctctcatcccagtgtcatcctatagtagtccaaagaaagaagagaaaagaaaagggagaaaataaaatttctaagtaggccctaattgttagtcggtgtaggattgatgatggtgtcacgtcagcgtttgtgtgatggaatttaggccgtcgatgatacatttaacaaatttaagggtttaaaggtgcaactttaagtttttgacatagatgacgcccacttacaagtttaagtatcatcagtacattttactgaaaagaacaacctcaataagaggcagaagcctttctcaaaaagtttataaaatctttatgatgatattatcctaggcaaatctacacataccatactttagtttttaaaccaagcaaattgacaagttcaaagtatataagttattcttaagtaacaattattaattccggagggagtatagctgaagtgtgaattcacccatttataaacaagtgaattacctcgcactcgaaccatcgctagttcactagctcactgtcagtcaacccattgaccctcggccttctaaatccccgcccacccaacaccacacctcacatgtgtggcacacctgctttcttcagcatgcacacctcctccactgacactagagagcgccacaactgttgatgctatgccaaaaatggttgtaatggcaactctccctcctcttgccccctccacctctacttccctaccattctcttccctgccttttcttccccaactatatatggagaaatctccctgcaccacctttctcccttacatttggtggctcccatcaccacatcatccaccacctaattatgtgtttggttggaggaatttggtgggttgggataggtccatcccatttttgtaggtgtttggttgtagaatcaagtgggttgggttggatccaaagagaatattcttgtgatatccgggatgggctgatccgccaaaatctggtggaccgcgcggacccagctagctcccacgggtcatgtgcagcgcatgcgtgtagttatgggcggggaccctatgtctctcgtacgcgcacaacccctatcccctttttttttctcttcccttcttcgatccagatctgcgcgatgcgagataagaggcggcggcgaccgcgcgtgtgccaagcgacggtgagcttgggcatgtgctctcagccgcgacctcctcctcatccgtcctccctcgccggttacccaacctcaccggcttgatgcagtggcaggaaggaccggcgactgtggcagcaggaaggacacagctcgtcccctcaaggtagcaacggccgcgacctcctccttcctcccttgtccctttccccatcaaccctcatcgtttcccctcattgcaggattgcgtctaggaatctgtggtggaaggatgcggctgcagcggcttctggcaacatcacctccttgccctccactctcgtcgtcgcatactacatagctagagtaaggaaaccctatcacagaatgaatttttgttttcatggtcagatctgttcaagtattaatttgtgatgttggcaaatcagttcaagcaaccctagcactgtcctttgttgcaaagaaaatcagttcaaatattaatgtgtgatattagcaagtatttttttatgagatgatttgtgcttcagcatgatatgtcaacatgtttatttttctttgattgctgtattgtagatggataagacgaccaagttttaatttttgttgctgcttcaaatatattattgtcgatgatgaccatgattattcagtgtaggaaaagaaagagaggtgcaaggaagggaactcctccctctagcttcccctcccccacccctaccctcattacgaatgctaactttgtagagtttgatggagctcatcagagctcaccgaagctagagaaggttgtactacattaatcgtatgtagagcaaatgcatgtgaagatcaaagaatttgtaagattttgatttgatttttttgttgaataccatttagcacatccgtacatttacgttccaaattaattctcaaagtatataaattacccaaaattagttcactataaataaattagcaccgtgtatcaacaatctccgcgtacaggcatgaaaaaagaatttttcttatttttacagtgtattcttgtgtaaaagaggtggaggagatcgagattcctaatgtgctatatatagtaataaatgtatacacaaggagagtttatgtacactacggttctaataatgcaaaatgagttaaattagtgtgattcaaaccaattttgttggtaatgttaaatacatttatatgctatcacaacgtcaactatattgtattttgcaaaagtgttaatcacattttttgccaataagtgttaataacattttttgccaatatacgatattaattacattttcttgcagctattatgttattttcactagatagcttaaaattgaaaggcacataacactttgcaatctcttttacatcctcacatgctagcagccactaattatctatccatttttacattctcacattcaagcaggcacttgtccatccatttttacattctacatgcaactatgcaagcagccacttatctatctatttttacattctcacattcaagcagtcacttgtccatctatttttacattctatatgcgactatgcaagcagccacttgtccatccattttgacaagcataagcggcaagagaatggcaaagtgcacactgaatgcttgttataaagcaacgtcactggatttttgacaaagagatgaagcatttttgaccgacggatgaaacactatgctcttgtgtgtcccatgcattatgttgccttccgtattatggtctcaacatttttgcaatgaaacagtaccatatcacactagattatcatttttgcaccatattgcaccacggccaacctactgtgataaaatcacactgttaattacattttatttttggaaatatgttagttacatatttcggagatattgtgtgagttacattttttttttgccaacgcagtgttaattccatttcttttgcatatatagcgttgattaatgcatgatcatcaagattgaaacataggggctgtttggatgcttgtttcaatttaccaaactactatatagctaaagtgtggcatgccacaatttatgtggctaagaaattcttggccacaagttaggcaaatgttggcaaaggtatgtgcctatgataagtggggtcacaaaataaaaaattgtggcatgataaagatatggcaaccaagcaaacactaggctaagttggtcaaagtagcttgccaaagttgtggcaaagtatggtcaccatccaaacaaccccgtagtgcataactcattgcaatatatctacttcatcatataccatcgatcggccaaatatccttcctccggctggatgagcacacaaggcatgagaaggttagagtgctaatcaaatgccagttgttaaggttacatgactaattggtctctaaaactagaggattttaatggaaaaactatgaaaggaatacaaaagttaatactacctccatattttaatgtatgacaccgttgattttttgtccaacgtttaaccattcgtcatcatttattttattatgacttgattcgtcatccaatgttctttaagtatgatataaatattatcatatttgcacaaaaaaattgaataaaatgattggtcagaccttggtcgaaaagacaacggcgtcatacattaaaatacgaagggagtatgaaatgttggtaacaccgacgataactggtggtagcgggagaagcactcaatgtatgtcatatgccagttacttagactaccaattttgtacatacacattatagctcacttccgttttctttttctttttcgctccacgagaaaggatcaaaaccggtattgcaagatatttgaaatctagttatgtagttatttatgttgtccaactcttagacaactatgaatatgatattaaaacactagttattatatataacaccagttacacatagtatgtagggacctgggacccatgaccccacgtcgtccctagcaggcagctcgggggaaaaacgccaccccactcctccaccactccctccgtcttgccactgcaagagcaatccgccagtcatcgtgcggtgagccgagatggcggaggtgaggctagaccccggcggtgagccaacgcaaggaaatcaaggcgatgttggtgcgacagcatcaacgaaacaacaccacgacgacgatgatgggaaattcggtgtcctatggagaaaggcggagcaactgggcccctccctactcctaggatggcggtggtgggctactcctcgacgtgccagtagtgggccttccccaacctccactcttctggatggtgatggaggtagagctagggttgatggcatcgtcgaggaaatccatgttagtctctagttataccctgctttgacacctaaagaggacctttgagaagtcagagctaccgtatcgagctagcgttcaacgagctgttggcaacaatgactagaagggttctgcttagtttcaagcagggtttggttgttgtcttctaagtcagagctgcagcacttttgcgagctcgccaacgatgaccgaagtctacaaggctcatcagtctaactcttgtgtggggtttcaagcttttcgtttgcaaggctcatcagtctgactcgaccatgcatcaatgagtttgttggtcgcgaagtcgaagttgcggcattgaccggacacaatgtgtggcaacgttgacatgagcccatttgagttatgctttggcacatgctaggttgttgcccttatactagtgttttctggcgaagtcacagttgtccaatcacgaggatgatcatggtatgatggcaataatattgtatctttgccagtgtgcgggagtcttgtttccttctagcttgctacttgttcatgtggtaaatgacatttgttgagtgtcgcagttggctttcctgttcttgctgccttggtagtttaggttagttggtaaagtgtcgttatagttgtaatttttgtcatgttttttcttaattaactgtgcaccttattggttctattttctctttaaaatagacatctttctctttatataaaacaccaacaatggcttgaccgtttggagaaaaatacacagtacgtagctctgtctagctactggcactctggcctactcgaaggccatgcaatttccaggattagctctgaataccatttattggccggcttcacacctactccatccgtccgtgaatataagggattttaactttttttacttaaccattcatcttattaaaaaaaattaaaattattatttattttatttgtggcttactttattatccaaagtactttaaacacaatttttcgttttttatatttgcacaaattttttttgaataaaatgagtggtcaaacgttacacgggaatagtaaatatcccttatattcacggaggagggagtacatattaatggatcaattccgctttcttcaacctagctcggcctaacgcaatgtaatccttttacttgattacatgcaaggtacatgtctttcctccggccgaatgagcatatatgcatgagaagagtagagcggagcgttgcctggttatatcagttgtcaaggccacatcactgtataggttctaaaattgctggattttaatgaaatgagtgtcgaaattaattttgttgtgtcaaattgcatgcctccggccacaaccagcagtgggccatggccactccattgcatcttcatgtagtaatttttaaaattggagggattcaatagaatggtgttgaatagttttatataaaaaaaaatatgatggtatttgtataatgcaacgtctttaattatttttacgccaataaattgaatgtttgtaaccattagcatgcatgtttctgttcggacgcgctagttgctacagctgctgcggctatgataattgtaattgagctctatgctactaccggtttaaactgtcgcagctgtagcaattaggtaaagcagaacacgttcaatgattgtagaatcaaacgacctaaatttgtactccctccagttcattttaattgacgttttggacaataacacgatctacaaaatatatctttgatcttatttttctattataatatacacaataaataaatgcatgttaacttttattatagtgttttgaaagacaaatctatatatgttgttctagtttctttaaactaaatacttttgaagttattaatggtcatagttataaaagtttaacctcaaacttgttcaaaacgtcaattattatagaaccggaaggagtatgccagtaattaaaatgcacttcttcttttttgggaaattaaaatgcacttctgtaaatctgtaactagaaatgttataacttataaacaacaaacaagagggataacacagcccagcacgtatgtccaacttgaaaggagcctgagaaaggagcctgagatataatcaaatcacaattggataccttttgtgacgggtgctacacatagctatcctttggattcgtcctaccgtaaccgatcttcatcgatcacctcgaacaatccgtttgatatgaccgacgatgacacacactagctagctagctaccaaacgaacgtttcgctaggcaacaatggcgctgccgtcaccggtgacgaccaccgtgccgcgaagcatgcacggcgcgccggccgatcatcacgcccgtggttttgttccttgcaaagttgcaaacgttgtcattgctgcagaaaaagccaaacctcaccaaatcttaaaaagagttctatgtagaatttgtgcgtaaaatacactttttagcagttcggtacacattttcaggtgaaacaagaaagtagacgaggacctaagttgacacgtctttatagtaaactatactcccgctgcctaaaaaatatatgattatattgacttttatataacgtttgaccattcatttcattaaaacaaattatacaaatatcatttattttgatctaacttattttatcatcaaagaaactataaccttaatttatgctggtacatatttatactaaaattttaaattaattccatagaaaaattataagttacaacaacttttaatagatcaaatagtgctaaaactactactataaatgcaaaaataactgaaattagctagaattttaaaaagcttattttactgatagatgaaaatccgatccatcaattctgaaccgatacccgtttcatatttttatggtctcaatattatgtgagtggtctaggagcatggttaggctgaattagaaaggaatagtgcccaaggcactgttcattgtcttccctagccgaagccggaaaataaaagaggagggaagaagggcactgtgctccagtgatcaaacggcgatgaggaaggtggtaggatatgtcccatgatgtgactcgttcatagatggtggaggttggcaataaagaaaccagaacagcaagaacgcagatagcaatgacgtggtctagatagagagagaaatgacaacaacgagctctggtaataaacacgaccagatgagtgtatcaaaacgcattcccaaataagggggttccgttttccttgaatgtgtaggaagaacaaagatggagaaaaaacgactaacactattcattgtcttccctagcataaacaagaaacaaaagaggaggaaagatgggcgctggtgctccggcgaccaaatggcggcgagtaaggtagccgtacgcgtcctaacaatgtgactcgtccataaatggcagcggttggcaatgaataaaactaaaatagtagggaatacaaccgataacgatgtggtcccaacagagaaagaaacgacaacgacgagctctggtcatgaacacgaccaagtgagcgcgtcaaaacatgttcccaaacgaggaggttccccttgaatgcacaagagggagcgggcgcaagggagaataggggtgttgagaggaggggcgacaggaaggagaggggccgcgtggggatgggaagtgcaatatttgttggggatcgcgagggagagatgggggcgccgagagggaggagatgggctgcatggggaggggagtgcaacatttttttggtattgcgaggaagagatgtggagcgctgggaggaagggcgtagggagggaggggtgaggcggacacacgaaaaataggtccgaaagctttacttattttttaattaggtatatagtttctttaaaataacatgaatgaccaaacgtaatgtaaaaattcacgacgtccgatattttaggagggatggagtagaaaaaactattactttgctgtttaactttgatttctgacactaacatcagaagtttgattacaagacaggcaaaaatacaaataataatattattattattattaactaattaattgatagtgccaaatgttactcctatggcactgagtagcatcagctagccgaggacctgcgccttgaaggcgtccacgtgcgccgggtcgatggacaccgagagctgcacctcgccgtcgcgccggccgccgacgagcaccatctcgccgtcgtggttcatcgacacgagctcgacgcgcgccggcctcccgaacccgaagtcggcggcgccgtacgccccgaaccgcgggctcgccgccacgttcgccatgcgggagaaggggatctgcatcacccgcgcgatcgccgacccgtccgccgtcccggcgagcggcgccgcctccatctccgccaccgccgcctgaaccgcccgcgccgcgcgcagcagcccgcgctcgccgcggagctccgccgcgttggcgcagcgcgccaggcacatcctcacgcagttcccgaggtacccctcgccgacggcggggtcgagccgcgcccggaggtcggcgaggaagatcaggtacgtgtcgtccccgtcggcgagcgccttggaccggacgaacgccgcccaccccatcgccgccagcgccacgaacgtcgacaccggcttggcggcgccgccgccatcggcagcctcctccgccgaggcgagctcgtcgatgcgccgcttcaacgcgcggatggcgtcggcgccgaggtggaacgtccggcgagccagccggaatcgctggctgaagtcctgctgatccccgctcgcctgcaagcatccatggcgggtggtggtgatctcgtcagtaaatttgcattcacggcgagcgagagagagatcatgacgcgtgcatgccattgcttgctccgccacgccaccgcggcgagctccgcatgcgcttaacattggggggagaaggaaaccatggttggatggcgtaccaagcaaaggttgacgacacatacacacttcgaagaggctacactacactacagtacatgcttcatgcatgatggaagcttcgatttttgtttatttatttgaactaccagaaagattttttgggctgttttttttatttggttgaattttattcagaattcaaatacattacaaccattttgcaaatctcgctgcctcgggacctctcttttggaagatgaccctgcctcagtgtaacattgtggaattgttgacttggtgttgaccatatatctgcacatctcctactctttttttttttgttgttgcaactttgctttagtcccaaaaatttatgtattctatgaaaatcctggtgaatttctacattttgaaaaatagccgtgtggaaacatctatagataaaattacgatatcacggaaatagggaattcttatatctttaaaaattgaagtcacttttcgtatatcttgcttaatgatctaacaactcatacgattgttcacattttctatttagacacaattttatatttcttcaataaaaggttgaataacaaattattctaaatgtaaaagcattcaaacataaaaaaacatatgaaataacaaaattttcagttaaaataaacaaaaaatgcaagtgatgcaaatcttcttaattttggacaatttacggttaaacattggtgaaatcgaagaattttatttttaagatgtgaaatgaaaggagctaggaagtgggagagtgacgatagcttaccacggccgggagcttgggcgcgaccaacttgagcatgtggcgcgcgagctcgccgccgtcgggttgggggatggccgcctcccggcggtagtgcggcgcgccgagcgacttggtcaccggagagccgacgcgcgcggccgacgaccacgcttccatgaactgccacacggcgcggccgtcggcgacggcgtggtgcacggacaggccgagcgcgaggccggcgccgccgccgaggcgcgtggcctgcacggacagcacgggcgccgggagcgcccgggtgtcgagctccggcacgagcgcgaggaacgccgcgacgtcgtgcgcctcgtcgccggcgagcctgagcacgtccatgtcctcggcggcggcgtcctccgcctcggcctcgacgaacgccaccccggcgtcggcgtcgtcggcggcggcgcagtccaccacgacgtcctccgtctcctccacgtagaccagcttccctgccaggggcaggtaaagcaccagcgtggcggcgagcgagcccttgagccgctcgaccgccgccgcgaacccatccccaccgccgccgtccgccgccgccgccgccgacatctcgtacaggaacacgcgctggatcggcgggagcacgacccacggcgtgtcgaagaaggacagcccgacgcgctcccgctccaccggcgccggcgacggcgcgacgcgggacacggcgagcacgcgcacgcgcgcgcgcgcgccagcgtcgccggacacggccgcggcctcccccatctctccctctatctctctcccaaccccggcgtgcttcgttctcgccgtcactggagcgcgcgcgagatgttcgacgaattgatctaccgtttcggctcgtatgatcgcgacctcatttataagtgcgaggtgtccgtgacgtcgtcgtcctcctcctcctgcataggaggcaacggaacattggaggcaatttttttatttttttgggggcgaggatttttttttttttttggagggtgaggtatcattaaatttttgtggttgatactctacatttcacagctcaccacacagcacacagcaataaaattcatatttatgctgatttggtttgagaaaagttcacagaaaatactatcaattatcgaaagcaattgaaatatatctaaaataattaatgtatgaagttaagaaaaggaaatgtaaacgcggtagtaaatttctattccctttttcaaaatataagtatttttttcaaaattatttaattagtaaatttccattgttttctacatgatctcttatattactctttcacaattaatatttgttctaatgtattatcaaacagctacaatgtaaacatcgcttgaaagtttttttaaaatacgattataatcatatggcataaatgactctaaatatatatagcttctattctaaaatataagagatcttggctacgtgactagacgtacttgttaaaatacgattaccctccaggttaataatacttgtcgtttcaaataaataagaacacaacccctaaaaaatatctttatcactattttctattgtaacatatatagtaatatattttattggaataccttttaaattaatctggtagtctataagaaaaatattttagaaattattattagtcaaatataaaatttgacattaatcttatcctaaacgataagtattatcaacatgtagggagtaatatattgttagtttggctattagtactccctccgttcctaaatacaggacgtaacttcttttcaactggattccataatacaaggcggcagcttctcggtgcatgtgcatctgcatgcatgctggctattcgctcggaaagtgcaggtcgagcgcatgctgcatgcatggtggttaatgctagcgtatctaccgcgcaacaaccgaaacgtcgctcttcgaacggagagaattagtcagcataactgctatttaaacagttttattggtctttgcaactacaacaaccacgtcctatattaaggaacggagggagtagaagttaacaaatatagaccttatattttagtatactaagggttttctcgcagaaaaaatatattctatttttgatgcagtttttcacattaattgtgcaaaattattccagtgacaaactaaagaaatctggagactaacgtaatggaactgaaactggtatacagctcggtttatatttcctgtcaaaataaacacggattttgcgttccatgactcggatttgatttttctgtcaaatcaaatctgcattttgtcccgaggcttcaaatttcttgagacagctcaagtacactaaggacaatatataattggacactaataactgctggttgatcgatgtagtattagctggttaataacaactagctggacgtcccgcgcaattgcgcggttagcatctaaccaaaatcatatattattcagcatgattttacttaaaatttattaaatagctatccctgtattatccccatatttctaattatgtagtttttaaagtcacaccagctgctaccccttacttctgtcatatccttatttatttgcttgctcggtctaccactatttctattcattctcctgaaacctttaaaaattagattttatagttttttaagtttattatctcgttgggtttcgtttttataatttctggaagtcccatcaaacgctgccattatactcctctatggcccgtccactgttttttctctttattgtcattgggattttacaaatcaaacataattatcgttcgagtttattttttactttttataactcccgccaaaccgtcagcggctttgcaattgtactcctttatggctcgcccgttgtctcccttctttattgccattgagattttaaaatcaaatatgattatcattattttttttactttttagaagttccgaacctttaaaaattagaccttgtagtttttagaatttattttcttgttgagctttattttttataatttttagaagtcgcgtcaaacgatgccactatacttctttacgacccatccgccgcctaatctttattattgtcattgggattctaaaaatcgagcataactatcgttggaattcattttttttattttttaagaagtccccgccaaccatcggcggctctacaactatactcttatacaccctcctgatgcttctctttttattatcattgagattttaaaaatcgaatatgattatcaatggagtttttttcttttactttctaaaagtcccagcaaccatattacccgtttgcttcacggcctgcctgtcgtccctccttttaatcatcataatgattttatttggtgttttactagcagtcaaccaccaccactcttatcttttataggcttgttacttaatttatcttatcgtgtgttttatatggtcttctttttcaatagtctttatttttatcaccaattttagttatttataaattgtattcctaattgaaatcttgtttctttttctaatttcagaatttatttttatttttattctgaatattaactaatctcgtatttgggttcttatatggactcttctctcaatattccttttttttacttctgaattttagttatttttaaattgtattcctagatggactcttcttttcttttctaatttctgattttattttatttttattctgaattttgattaatatcatattggattcttctatggactgttctttcaatattgcttatttttaattccgaatttcaaatatttttaaattgtatttctacttggactatccttttctttttctccgactaatgtgggaatttttagcccccacagcgaacgtggtgtctcctttcaaagctgttttaataatatactagaatagataattggggcttcaaattttcttctgtccaggtttcagctttgctcatttggaagctaccagctacagtagctaaattaagcatatgtccatttggaagcctttcatgctggcgacgttaatgacttaattcacatgacatttggcagctactgtactacgtactgccagagaaaaccaactagctagtcaagagatatctcaatgtgtgattacagattagaaggttacctactgtttcttttgacaaatcaggcaattaatcagattaattgatggattgtatgactgagcaccagtgagcagcaattccaatttaattgcgattgtgttggtttcagaaattttgatggatttttgggatgtcagtttcagctgggtgacgggtgcatgatgaaacctcaggtttaaaaactcaactacttcctctgttcaaattacttgtttttttttaactttgtcgtaagtcaaatactattaactttgatcattatttttctaaaactaatatagtttaacaatatgaaaattatgtattatgaaaacatttattatgatgaaataaaaacataattcttagaatgttaaactataaaaatttctgaaaattgatattcgaatggaggaatctaagttagtacaaagctaaaacaataaataatgtgaaacaggggaatataaggtttttttaaaaaataatatttttcaatagagaattgaaaatataagggttaacgtattaaaattaagtttaacacctcattgaacaatcaaagttcgacacgggataaaaaaaatgacaacagtcactgcacaacgctgtgtgacactgtacaacatatatgtgagtagtgtgagacactgttcatgcattttcatttttttaaagtggaccaacaaccctatcggataaccgcagctcgacaagtgtcgaactacggttatttgacagggtattaaacttacgattttagctgatcagcttctatttttataatttttcattaaaataatattatttctaaaaaaaattaataagggaggcataatcattttcagtaaaatcaacgcacactagtacagaaaaccccatatgtgccggttgggaaacccacataggtgcaggtttcctaaccgacacccccaaagcagcaccaatgagagaaatggtaggtgctggtgtctagaaccggcacttataaggtccaacgaatcaaaaaaaaatccgactcgatgtatcggctcgatttgagccgatactcggctcgatttgatccccacaatatctcatcaaagaacaattcatcaatatcttcattcatcaacatcccatccaacaagaacaaacaaggagactccgagatcgagattgaaagatacccaagaacatcaaagaacaaaattaagcacataattaagaatttcaagcacacgagactccggatctggaagatttggaaagctctgaggccatcgggagggagggtgccaccggcggcgacgtgtgggaggtcgccagcctccccgccacacgccgccatggtgaggccgccagccaccccaccgcgcccgtggagaggtcgaccagccgcccgtacccccgcgtgccgccatgggaaggcggcgttcaccccgccaccgccgccgtccgccgcgaccggctgctagcccagacactaaccccgtctcctcccccctccccggccgccgcctggctggatgcagaaagagaatgggggaagagagaagagaatgggggacgaggaggaggagagagggatggtgagtggagcagtggaggagaccgggtgagtggataagtacgcgcgactttatccactttatcgaccgcgcccccggcttctctctcgatcggctcggctcgtttgataggtgccagtttttttagaaaaccggcatctgtaatatattataggtgtcggtttttatttaaccgacacctataatatatcataggtgtcgttttttaaaaaaaaaccggcatctatagtataggtgtaggtttttctattgaaccggcacctataactaattaaagataccggttttttttattttcagcctgtgaaggtgggaaaaacactataggtgtcaattttagctatttcggtacatatagtgccgaactgtatgtgtgtttttgtagtagtggcatgatgttttcgatccagaccatgcatgttgaaaattaaatgttctcatttttcataaaatcagtagtcaatcctatagaatagttcaagaatatattttggccgaatatgtatgaccacaagacacaagtgtgatagagattagagatcgaatagctgtggcatgtaaaccatctagagcttggaaatgtatacacttttcgaatataaaagacaaactagtagttttcgctatagaagaagagttcaatggcacattttggtcgtatttataggcaatcaggaatagatgtgactgagaaaagtaggagcatttgtggctacatattcaggtgaactcatggtatacagtgcatcagcggcagagctgcttctagagacgacacgctggacactagcttagctacaatgtctctaaatcaccggttaaattaacacaaaggattgacaccgtaagagatgacgtcagataatttagatacttatggagtcttcgtttgaaaattccctttttccaaccacatgcatggtggtgtgaaactgtgaattcgaattcaagttgatacggctagctatatgtctgtgagtccggttggaatgacttgagtagtactccaagatactgagttcaaatctttatacgagttaatttcagattaaattgtttgaggagactaagtttttaatttaaaaaggctacatatatccgatacgatgtggccgagttaaaaaaatatcattctctaaaataaaaggctataacttaatttgtgagtaattatagcataatcttgtgaatcataatatatactaaaatgttaatcatgagacttgatcacaggctcacgaatcacactacatgtaatgagtttaacgagctaactcggacattttaacgggtcaagttaagtttcaattcgttcccaacttattgtgttaatgagtcgagccgaacaaactcgttaacttaacaagtttttacgaattacttcctccgtttcaagttataaagctttcacattgcccatatatatatatatatatatatatatatatatatatatatatatatatatatatatatatatagagagagagagagagagagagagacctatacctattaacaaaacaactaaaatttaactttatttcacaatccatgattacatacctaactaattatatgtatggatgctatatacctagaatcaaaatctaacaaaaacaagttcaaattcagtataaacatgctttgaactagttagtaaagtacttaatgttaatacctaagtaattgaaaaagtttcatactcatttgaattgggtatatactcaatttcaacaatgatgcccgggcaccatggagcaccaaacaaatttaatatatatatatatatatatatatatatatatatatatatatatatatatatatatatatatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtaaattaactggtgctacatggagtatgggctccaagattcaaattgagtatatacccaatttgagtgagtatgaaatttttttaaatgcttagatatgaacattaacttctttactatgttagttcaaacaagtttgaactttttttttgttagattttggttctaggtatataacatccaaacatataattcgttaggtatttaataatgaattgtgaaataaagtttagtttgagttgttttgttgttaggtatttgtatgaatcaaattcatatagctagatatatactcacaatttgaaaattttaaaaaatttaagagaatttgtgtgttttataccttaccctaccatagccgccacagtcaatcaatcgctacaaatacaagtactgagattgtgacaacaacggaatccccaagctcttcgcaaaaactgcaccaatttttattttccttccaccaaccgagccgatcgcaggaagccgagcgagacgtctttccttcgtctcgccgccagccatggcgccaccaccatcggtcaccgtcattgaggacggccgcgtcgccgtgccgcctccgccgccgccagcttccggcgacgccgcgccgcctcctcaaacgacgctgttcaagctgaccgcgctcgacgcgcagtggatcccgctcccgctcatccagcgggtgctcgtgttcgacggcggcgaggggcgcataccgccgttcgaggacgtcgtcgccgccctccgcgcgtccctggcggagacggtggcgcggctactgcccctcgccggtaggatcgtccacctgccggagacgggggaggcggcgatcgactgctccgggcgcggcgtggccggcggcggcgtcaggttcgtcgtcgcggagtgcggcggcgccgacgcggcgcgcgtcgcccgggacgccgaccacgacgtggcgctgctggagcagctcgcgccggtgctcgacgccgacgcgctcccggcggagacgatggccgcgcaggtgaccaggctgggcggcggcggcggcggcggcgtggcggtcggcgtggcgctgcaccacgccgtggcggacggccgctcggtctggaggttcatcgaggcctgggcggcgtgctgccgcggcgacgacgcgtggagcgccgcgccggcgccggcgttcgaccgcgccgccgtcgcgctccctgacggcgaggagctcgccagggacgtgctccggaagtacgtcccaaacctgccagtggtaagcacgcaaattcacaggatttctttgaattccattgtttttttaaaaaaaaattacatttcaaaagaatatgttcaaatatttttaaaaagaaataaatgttactccctccgtcccataatgtaagggattttgagtttttgtttgcattgtttgaccactcgtcttattcaaataatttgtgcaaatataaaaaatgaaaagttgtgcttaaaatattttgaataataaagtaagtaaaaaaagaaataacaattctaattttttttttgaataagacgagtggttaaacagagcgagtaaaaacttaacatctcttctaatataggagggagggagtatttttttcaaccgtgcgatcgatcagattagtgggccatgaggtacggcctttcactgtccaacttttaatgtcttcattgcagtgcatgccctgctactgctagttgtgtggttctatccaaatttgaggctcctgtcagatttgagggaatggcttcccggcagatcaagaaaacaaacacaaaattttaccgtaacttaccccccgataacttcaaaacagtaattaacagccattccatttggaatttacagctggagttaaatgtaaactcattatatttatacagtgtaaatttcacaagaaccagacctacaacataagctaaagaatcatatagcctcaaaacaatatagtaccaaaccaactaaaaaaagtccaaattttccctctaaactattgcggtcgtctgatttatcatactcatttcaaatactagatattttacaccttaaacttttcaaaccggaccgataattaacctccttaacctcccataaagcagtatcagtcttacgtgacacacgtacaacagtttagccacatgtccatctagtcaacagtttgggaaaatattttttcagaaaatataatagtggccccacatgtcatattcttatatcttcttcttcctcgctctctcatagtcccgtgccgtcgtcgcccccgccccccgttgatctctccagctctccctgccaccaccctccacgagcttgctagctccactagtgtggctgcagctcgttgcatccatgtgccatagcacaagccaatcaagctcctctcaactgaagaggaacacacccatgcgaccttccgagccattcccccttccctctcactgagatcgatgggtgagatgatgcatgatgcggcagggttgctgcctttctggggatgacgccaccgctatcgcctacacatcaaacctttcttcctctgccgtctcagggaggccatcgccatcttccttcgcctcctcactgctcctcctgttgtggggaggagggagggagagagtgggagatggaaggaaggagacgagaggagaagaagatggagctcgctgatttttttttctatctttaatttctagcttactagactgcagtcacgtaatatcaaaatcactccggattgagttaggggggttaagcatctagtttaaagagttcgagatacaaaatatctggtatttgttgaatgggtaaatcgaacgatcgcaatagtccaaaaaggtaattcggattttttcctactaatttatagtcacttttttaaaaaaaataattggagttacaatctaacatcaacatatttacactgtaaattgcagaacttcgtagaaccacacgtagttagggcataatcggatagctgtttacgttttacagtcattttatgctggggataaagcatttttagcatagtgacaaatcaaatatttttaactttgattattaatagcaaaaaaaatcaatcatgtaagtaaacaatcataatatgtaactttttttatttaaaacattttacttttataaatattattggtcaaagtagcatctcgaaaacagtgtgaggataaaaaatgcttatattttggaacgaagggagtattagtttttttttttgaaaaatggactaatatgatttttcaaaacaactttcatataaaaatttttgtaaaaaatacacaatttaatagtttgaaaacgtacgtgcggaaaacgagagatatgagttaggaaagtgaggtaatgacgtggcatcctaatgactatactaactcaatcgaattggctatggtgttatgttttggccttggttcacacgtgttacacaagtcactcatcacataaaagttctctaaacttttgtactagtagggcaatttataccttttaagttcgagtaattctatacaatttactcaaataacttttataaatatagtgtttttttaaaaaaatgcaaaataagttcataaatttggcttattcgcgccatttccgatgagcaggcaacggtacccaagttcctcgtcaagggccgcctgcagctctcccgccggacgttcaccgtcgccgccgcgcaaatgctccggctgaagcagcgcatcgtcgtcgccggcgccggcggcctcacgccgccgtccggcttcgtggcgctcgcggcgctggcgtgggtgtcgttcgtccggagcaagcacgcggcgggcgccatcgccgccggcgacgaggtgtacctcttcttcttcatcgactgccgcggccgccgcgccgcgttcgacccgccggtgggggagggcttcttcggcacgtgcatctccggctgcctcgccacggccaccgcgcgggacctgctcggcggcggcgacggcgggctggtcgccgccgccagggccgtgcaggaggaggtgcggcgagcggcggaggacccgctcgccggctgggagtggatgtcgctggtggggcggatcgcgctgagccggctggtgaacatgtcggggtcgacgaggttcccggcgtacgaggcggcggacttcgggtggggctcgccgagccggacggagttggtgacgatgaaccatggcgggcaggtggtgctcgtcgccgccaagggcggcggtgtgcaggcgtcggtgtcgatgaagccggagcacatggacaagttcaagtcggattttgagagctacttagaatgattatttgactagaaaaaatacccgtgcgttgtacgggtgaagtttattttaatcttattattattatatggtttagttaatataaaattcactgcgagagttcgcttgaaaatatatatttttagaaaattatgggttgtagttaggaatccaatcaccttaagttagcatgcgagtttttttaaacatatttttttatgattccttctgtattaaaaaagtgaattatcttaaaaaccgactcaaatacggatatgtattttcaaaagcaaacgaacttaaaaaccgactcatacacgaatgacgtaaaaaataccaacaaaaatatttttaatttttattatagtagagatcgaagaagatgaaaattccaattggaaaccatcgatcgtactacgtgtttcttgtttgtagtcaaaaattttggagtgcttttgaattaaatggccgaaaagacgtcatgtcaagttggcaaccaactgttaagattttgagaaaaataatatattgtccccgatatcttggattgtactgtacatgttgatatataagaaaggataatagaaattcttgcattgtccctgataacagcacacatggatattaataggatctggtcttaaataattaagcaaatttcataaaaccttactcactccgtccttaaaaaaaaactcaatctagaaagagatgtctagaacaacgaatctggacaaagggttacatcccatcctaagttaagtttttttttgggacagagcaagtatgttttggaattggagcgcacgtcacacaaaacccattaaagcttaaaccttatgaaacattgtatcataaaacatgagattcttcaaaacaaactattatacctgaggttttgaattatagatgcttcaaaaccgagttttatgaagttattacattctagaatcgctggattgctactaaagcacagacaggttactacaataggaaataaataaatgctcatggtttaagagaacataacgcccctgttttttttaaaaagaaatcattcgtccaattagtacagtatattatttacatgattatagatataaattaaatattataataaataaacttaacaaatagcttacacaaagcatcttaaaaaaatacagaagaatgttttttttagaaaacatattaatccagtgaagttcatgatgaattgattccacccaccccaaaccaacttccaagtttcttactacgaattactctagttttcgccacttggacactaaacaaaaatacagtactaaaaatgaggtgctctttcaagcttcacttgttctgtggtgctaccaatttacacaaccgtgtttggcatattccttttaagtgaagtacttacatatttttcacatttactacatatgaattaatttatccttccgttctactctctccatcaaaaaaaaaccaaacgtaggactagatgtgacatattcagattcgttgtagcaggatatatcacatctagttctatgattttctttttggaccgaaagagtatattatataagtcatcttaggttggttctaaatcaaaatacttttagtttctagcaaaatatataaacatctataatcaaattaggcttattaaatctacgactaaacatattctatggtacatttattttgtgttaaaaatattgctatgtttttcaataaatttagttaaatcttaaaaagaaacagaggtagatcagactatctaggcgcataggccatggcccatttacaaaactagcccgatgccaaattgagcgggatatataccacggcccatttgaaaagattatgcaacgcaactacctcccctccttttttttccaatttattttcctactgaaaaatggtggttgccggacacggaggcggcggcgggcgttgctgtcagaggcgatgaggctgtccgcgatggatgccctgtggctcaccgctgccgctcatccagcgtgtcctcattttccttcctttaagaaaataagagatttgaaacatgttgagaattaaacaagagagactttacggttgaaaccgtacgtttcttattactgcactcgtgttcctaccaccgtccagcgacgtcgccgtcgactgctcctcatccgccacggtcgctggcgtcaggttcatcccggccgagggccgaggggctcggcgccgacgcgcgctgcctggggccaaagctgtgcccttgcttgatctccaattttgtgttgtaatgtttaattcaagtatcggttattgaatcttcagctcacttggagaccttggatggaatcgtataaggtcagaattgtgatcgaaagacacacaagatttacccataggaaccagaagcacgagtaatccaaatcatagagcccataaaacatggaaatttaactatttgtaactattaagtttggtaattgtctaaatatccttcttaatttatactttttttaccgcttttaagacgtgatttcttaactatttattatttttgcccacgtagcatgccaacgtggtaacgtatggtaaaaaccggtgtgagattcactggtcagtgtctctccctccgccggccttctctgtcgccgtcgccactagggtgagcatgagggtgggcgcccaccgtctcgttgttcaaccacctccgttgcctccttgctggcggctcgctcgataacgacaacagcatgggcgacgtcacccgcgttgctagggttcgttatgacccgcatgcccacgttgtctagattgaggaattcctgataaccaacgccaagttacgtgccagtgccaagaggccgcacgaatgcgatactggcaacggtccgaatgtctagttccccaccgccggcacacatgggatagttgtctcactaacgatggtgactcgtttcgtcccaacgctgctggtgcagcagcagacacagcatcgttggcagctgccacgccgctggttcatgcgtggagccggagcgacggtagtgaaaaagggcagtacaacagcatcctccaggccgtgtagagcgcgacaatgagggaaaggtggacaccgacgatgtaactcatgctgccattatcatcgtgcaagccgccaacgaggaggcggtcgaacaccagggcagctgtcgggtggtagacacccaccctcatgctcaccctcacggcgatggcagcaaagagggcctagccacggcagcggcagtgagagagaaggccagcggagggagagacactgaccagtgcgtcctacacatggtttgcagtttcgtttttggtgaaaatttcggtagcaccgaaatttacaaacttcttggttttcagcacttttgaaccgaaattatttaaaattttaacaaattttgactgaatttaaataaattattatcaaattgaacaaaagaaattaagaaaacccgaaaatttatgtcgatgtaatgacttgctgggggtccgaaaatttgaatcaaaattgcaattatcggtcccacaccattttcaccctatattgccatgttggcatgccacttgagaaaaaaggaaaatagttcagaaaccacctcttaagagtaataaaaaaatagcaaatctagaaagaacatttagataattgagaaaatttatagtggaaaaaaaattaaattttccctaaaataacaacaggtgactagaagtcttccgtctaattgaaacgaaaaattaccgtgcgaatgttgttagccacatgttctttttagcttatttatcatactattgaaatagattatttgattcacacttcaaaaagtatatgtttaaatatatgttttccccaatgtgccaagcccagatgagcgtgagccgccatgggccaaactacacatatctgattggatttggatcacaaccgaactcctacagaaatttcaaggactatttttcttcaattttaaaccataccatcaaacatttcatgcaaaaggagaatcaattttaaacagcatcagcatcaacaattaattaacgcggtaattaagtaataataaaactacgcgtgtgcctagctagctaattagtattcctctttagtctaaaccattgcacgccatggaggtggccggcgaaccccctctcgccgccgccgccgccgcctccgctctcctcctcgccgccgatgccctcgaactccatcaccctcgacccgtcgccgccgcagtacgccttgttccctgacgccgccgtcgccgccggcgcgtagaacgccgtcgtcgtcgacccggccccggcgttgtacccgacgccggcgtcgccgccgcccatcatgagcccgacgtcgccgccgccgtcctgctgctgatgaccatggtgtgagtgtgacaggccgccggcgagcgggtaatgcccgtcgatgacgacgccatcggcgccgccgccgccgccgccgcagcaaccgccctcgccgtggcgcgccgcggcggcgccgccggcgccgccgagcacgtcggccttctcgccctcggcctcgcggtagcggttgaggtaggacttgagcgggccgacgtaggcctcgaaccccagcgtggtcatggcccagaggaggtcgtcgccgttgatggtcttccgcttctcgcgctggcacttgtcggaggcctcgcctgtaacgaagctgatgaactccgacacgcactcctgcaccgtctccttcgactccttggagatcttggcgttcgccggcagcgaccgcttcatgatgcggctcacgttcgcgatcggcaggaacctgtcctgctccttcgccggcgagtccccaccgccgccgccgccgtagacgacatacccggcgctgctcccgcagccgccgccgccagccgcagccgccgccgccgcctcgccggactcgttgtccaacggcgggctgcccaccgggctcagcaagtgcccatagctcttcctactcttcatgtgaagctaacaacactagctatagctagctagctagctagagagagagtgtgtagttagagagagagagaagggggaggttatgggagttgaggatggagtggtgatgctctccttttaaagaaggaaaggaggtgaggagatgcgagtgggaagacggtatcgatgcggacacaaagcaaacataaggacgctactatatatattatgtgtgtcgcgacattctcgtccctacccgatcacctttcatgtaaaccatgtagtaatagttcagcggtttaatttattacctatgcaaagtgagtagagattaaggataacaaaatctacatcatgctgaaattaattcttatctatcaaggtgctctatcgctgcattgcgtcacgttttaaatagtgcgcgccgttgcaccaataaaaattaacttggttgtttgcattacatgtgtgcagcgcattcaatgatgctcatttacttcttgcacaaataaataaagatacacttgttagctgatgatcattttgaaaagactaaaaaatcttaggtgatgatcaaactacgacgaaaaaatattgtttaaggtgtttaattatttaatttatactaacatatactaatgaccgaaggaagtattacattttcttttgttattggagtctaggcaagggattgatttattttatgagaattgagatatgtataattgtgcatgaaagtatggtgtatagctagagatgaaatggaggtggggagatggaggtcgatgagagagagagagagagaggggggggactagttgccattgctgacgggctcgaatatcatgttgaagaacatgagaccagagttccaaaaagatcaagacaggggaaaccagaaaatattccaaaggatatcatggcacagtccacagcctggatgaccaccactagctagccatgtcacctcaagaaaaaaattgctatctacaaagatttttgatttcttggggttcctaggccaatggcaaggcatcacattagtggcattgatgcactgcaatctttctacccaaaaaaagggggtcacacacttacatctcatatagttttgcttgataataaaaaagataatgcatattgtaagctcattgctaaagatggcatctgcgagtgcatatattacattgtgaaaattgtgacatgaaaaagaaaaatatctctgctctcacttcacttgtgatggaatatggtatcttgtgcattttcataaaaggaaaaggcaggacaaagggcaaaggggccttgtgtgagatgcttctcttatccccttttccactctttttttggcttcaaagttctatggattattcgcgccatcacatcgcacaataatagaagaatatatgtgataacaacttgggtagagtacgcggattaattaacataacctcagaagcttaaggttgaaattactaggttttaatttccactacttcatcagctgcaggcttctggattaggaaatcaattatatgctttgggaggtttgaatggtaaacgggtgattagttttagtagttagcaaccggagcttcatataaacaactgagatcgtgccatttgtcagattccagaggaagccactgccgtaattacctgttgtttagtgtttaaaattattgctctttctcaactggattcatttcctctgttgtgctcgggcaaatattctacatgattaaataacatccgacctctgcatcaaggatgcgggcaagtactcattttagaaattctataagtttagtgaaacataagaagcctgaaaaaaaatattcaagctttcctaaaaaaaattaatccaatctgcacatatatagctgttactaaaattttcaccggtgcttgacaaacatattcactgacaaaagacgagctacagtactgcaggcatacgcgcaccgttggatcggctaaacattcggtcaagatcaaagtatgacttcttttaattagagaatttgctggaatatttcaaaaagcttagtgaatttttcaatggaaccgtgggtcatttccaacgttccattactttgcaaaccgttaatttattattgctcttttttttttgttaaactgcacactttgtgtccagccgattgaaaacaactcattttttaaacccgtttcaagagaaatacattgcaaaaataaataacggggatattgggagcacgacgatgcaaaggcgagagatgtaaccaaacccggattatctaaaattatttggaacatgaggattcctctaggagttttgagaaactcatgataatttcatcgaaaatgtttatcaacgactcaaacttgactaatatcccaaccaaattaacgacgaaaatagattcggtttgggcctccaaaaaagcctttgagtgttcctcttcttcatttttcccaagtggaaaagggaaagatcaggaaatgaggctgagaagacatgataaaactaggtgtttaacaggccaaagcccaaaagcagcccaaaaaacacaaaaggagccaagtgaaagtggaagagcttttgtcaaagtgtgttcctacctttccttaccacttgcacttttcccccctcagctttcaagctttttgtccaacacgtggccagaaccttctaaagcaacatgtacttaaactaaaacaagagtactgaaactagtactaagctagtaaaatataaaaatagttagattatgatcagagccaactatacacaatacaatagtgatagggagtaccatgtttcttcatttttaagcttttgaccttttcatcttctccgagttgcaactttaacagttcctcagtgtaagtgaacagtaaaatatactaggagaaccaaacatgacaaaagtattcttaaattaaggtagtgtaacaatataatatttgtgtaaccagttcaaatgatttttatttgattattgccagtcaaaattcaaacagagaagctactaggaaattaaaaaaaaatcggcctacaatgcgcaactcctcggcaccacagccaccaactttaataacctaatttggaagacctaggcgccacgaaaatgcaaaaccttcacatggctaatcatccaaaacagagtatggacctccgacagactagcaaccagaggatggccaaacagttccatatgtcccttatgtcgtcgatctcaagaaactgccctacacctcttcacgggttgtagatacacaaagagaatctaggaggcaattgcagaatggacggcgtgtgaggggttgaaaccatgtcggtggcagcaaacctccacggtgttagaatggtgggaggctacctcaaatatccaggaggcacccaagaaggctcttcgcacactgatcctgctggtcgcatgggagatctggactgagagaaaccgcagaacctttcagcaaaaagagctatcgaccacctcccttctggctaaaatcaaggaagaggccaaaatttgggccttagcgggcgcgaaaaatcttcataattggctttcttttagttagctcggaccaaaggtcttgagctcgttttcgcctttgtacagttttactccttctatattcaatgaaaattggcagcttgccttttcttcaaaaaaaaatcatatcaagttcatcacatttctttgactggttttgtgcaatactaattaatctactactccttccgtcccaaaatataagcaattttaccatagtgtcaagttaactatttttaatttggactattaatagaaacaaatcaataatgtaactattgatgttactagatttattattaaacaaactatcataatatacaattctttttatttaaagcatcttatttttatacttattgttggtgaaagtagtatctcgaagactgtgccgaaatctaaaaatgattatattttgggacggatggagtaccacaagatagatatatataaattaatatgcataaagaaaagatagggaagaacatttcaacatcgcaggccaccacacggcataatatataaatgctattcaatttgacaaaagtaaagctaatactgcctagttgacacacttgacagtgataatcaacatcaaggatctaatggactataacctcatcatcctgttgtatgccatctctttcttcagctagatttgacgttaccatcagtccatcactaacgttaacctctcctcgttgagctacaaattacacgcaaacttttgaattatctttccggataaactatttatcggttaatcgtttgtatgaaatgatacttgcatatttagcgactgaaattgatccattgaagatgaaacgtccaattttctccagggagttgattgtctgctatttcttgtttttttttcagctactagcagctagccttttatactcctaaaagatgtactttttataaaaacaaatatataaatttcttagaatactttttaaaatccattttcaactttttaatatttaattcatttattgttgccctcgaaaaagtcattacaaaattagaataatctatagctatcatataattcggaatgggcctataaggctgacgaaaatgcatgctatatatatttttaaaaaaagtaaatattttattaaagaataaaatcatatccaatctttgcacctatcaggatgtatacagccaacgtacatactgtgtgtgaggctagatatatacatgtagatcgtacatgtctaaaatatcgtgtaagatctgtaccattccaataaattgggtatcctgaaagtaccaataagttggatatcctgatcgataaagcatggaacaaaaagagaagccatttcagtggacattttcgaatcttgtccaacgcctacctaaaaattatcttttccaaaaaggaaacgtgcatttcatctgatttttcatctttgtagtgttgtatactattatgtacctatcacatattggacgaataatatcaaagtgaaaaatccagagaaccaatttagtagcgtatttttagagtcgccccttctaaactaaagatacgcgaccaaatgacaaacatgaattttaagacaagtagcttaaaatacatttcttttgcatgcttcttaatcccctaaacagtatgtttcatgtaaagatctcctatatactccctccgtcttaaaatataggggattttgtatggatgagacacttactagtactccctccatcccaaaataaatacagttttacactattcatcttcaacgtttgatcgtttgttttatttgaaaaaattttatgattactatatttattgttattagatgataaaacatgaataatactttatgtgtgactattttttaaaaaaaaattataatttttttaaataagacggacggtcaaacgttggacacggatttccacggttgcacttattttgggacggaggtagtactacaaatctagacagctccccgtctagattcctagtactagaaagtgtcacatccgttcaaaatcccttatatttggggacggatagagtatatttcttttgttggaatacttttgtaaagtagccttttcaatttcgtactatttctttcatttgtttatatacactcaaatagccatcaaaaaatcggattatccaacgatccatcaattccagctctccaaaatggggccaaaatatagtccctatatttaattttaaaaaatgagactatactagtatagaatttcaaaccatgcagccgctcaaacaagcagagaccataatggcaaaacaccaaatatgaaatgccccaaaacacccaatttaagatgaactcacgagcaaactgaccccacaggtgggccgagccgggccgggccgggcgtgagatcgcagccgcacgttcggcaggcagcccatccatccgggccgtccgtttgcgcggacgccgtaatgatggcgatgatgaattgatgatgatccactgatgatggtcccgtaataataaatcgcgatcgcacgagcgcagaagccgttccgtttgcttcttcaatgcaggtagaaccaggaggaggtgggacccacgtaaccaggacgtggggcccacgaacgggacggaacggaattggggggaggggacactgttgaccggatatgctgcgtctagctgcttggacttcgcttttttgtttcaggcggggtgaaaatttaaatgaccgttgatttgtggaaaattcatgtaacctttgtggtgatacttatgcggcttgtttggtaactcgaaggaaggggattatgggagtttacataaggaaatttatgatgagattaagataggaatttgatttttaatcacaatatcttatttggtttgggtgatggaaattgacagagagtttagttggagattaggtcattaataaaaatggatggctcagatttgcttagacaaaataaaggaggaattccctcctaattatctgcccctacccaggtactgaaaaggagggagttccttcctcaattctccatccacatcccaccaaaattcccatctcttccaaccaaacaaaacacttaatagcctcatccctctaaactcccaatccctcctaaaaactccctccaaccaaacgagccgatgtagtattttttttcatgtgttaattgtcttatttttattttttaaagttgattcgattgtgagcacggtttcatttaaaaagaaatataatccacgagcatggtggtcagttgatattgtgcagggaaaggcattataatccgaagaaaagacacgtaatcaaaactacattttaattaacttgaatatctgttaaatcattggccatatattctttacacactttatagtaaaaggactatatatttatcatctattcttattttcaattaatatagtactttttctagcgatttattatactataagtggaattgggactatatgaaaacaagatactgtgaaaatgttaaatacaatagcttctataatagttgttctagttaaatcactatttgttcttttgcatattagcaacatactgcctccttctcaaaataagctcatttttcatccactacacacatatcaatacaaaacaaaaagattagaatacctccactttgtcaaattctaatataattattcatcactttatctattcctaatataattgttccctactttcataaactctgatataatgattactctaaaagtaaatatttttttgggataaatggacgaagctaaaagtaaacttaggctgtgtttgaggaggaggagatagagaagattgggaagatacgcaaaacgaggtgagccattagcgcatgattaattgagtcttaactattttaaattttagaaatggattaatatgattttttaaagcaactttcctatagaaaaattttacaaaaaacacaccatttagtagtttgaaaagcgtgcgtgcggaaaacgagacaatcacccctatctcccctgatagaacgcaaacggaggaaatacataagaatccattccattgtagatgaaggacatcaccagatccattgaggatgaaggacatcacatgttagcacctaataaactcttcatggcaacacttactacaaccacagcttatgaggcctggccactccataagcttcttcattttatttaattgcagctgcgtttgttaacatcacttctttatcgcatcacagctttgtctcaacatgcatgcatgcatccttgtcacactcaccatgccacatgcaaaccaaatgaaaacgatgggttaagctcacagtaaaatcaaagtgctgcttgtacatacacctttaatattgtactatcggccaaaaatatatactctttgtcttaaattaaagctatttttaccacttaagttattttaatataaagctatttctctacctacttactttatttcaaccaatcataacaactcttcatttaatttcttcacgtactttatctccctaagtaattataacatatattctttcaattattttcacctagtttttatttcatgtgaaaattttcatgaatgcttacattttgggacgagagaatattagctagtattgtcttttttaagaggatttatgaaattttcataaaaacattgttccatattttttcaattaaaagggaagaaaatttagatatttccaaaaaggtatacatcagataaatttggtccatgtttcattataaaaattgatatcctactcacatatatttaatttatcacatctactatatgcactataaaaattaaccaattgtagaaaatctcaagtttataaaatagtactcttaaaaatagatccaaccgtacgatgatcatcaatggaattagataaaacatgattacatattcatcgtttctcgccgttcacacgtttagtcacaagcccggacgtgatttaaaatttctcttcactggttagttctttttttactacacttttttagtgattttttatatgttggattagagggagaaaggaaggaaaataactatgctttttaacatatactcacttcggtttcataattcttatcattttggataatgacatggttttcaaaatatatctttgactgtatttttctattgtaatatatctttgactgtatttttctattgtaatacagttatactttaactgtagtactcccttcatctactttttgatagtcatatttcatattggcacacagaccaaggataagtaattcatcatctatttaaacatgctactagtcattcctcgtaaacaagcgattcattaatatttacattttttaatacccatgtagccaatcatgtgtggaagaatggagagtcacacattaaatccgagaaagtcattaagatgataggttgttggattgaaatatgcctatcaaaaataaatttttcagatttggaaatatgactatcaaaaatagatggaggaaatactttgtaagacaagtctatatattgttctagtgactttaaactaaatattttaaaagttattaatagttaaagttataaaagtttgaccttaatctacagtagaaggccacacgcccacacaggccacatccctcctgtggctgctgttcatccgaccacacgggatcccacctcctccaccgatcccgttccgttgactccgttcccgtcccgccccgcccccactcatctccactaatccccttcgctaatcacctctgactccctctaatccaccattttaattaaaccccaataattaacaaacccctcactctcttaatccgcattaattaattgattaaaaaaatctaatcactctcgctatcccgttctaatcctaaccccacccgtgtctcctacctcatcgacggtataaagcgaggcgacgaactgactcgactcaactcaaccccccccaaaaaaaagaagaaaaaaaagaaaaagaaaaaaaagtcgtcgaaaagcgagagaaggggatcgattcgaagagagaggaggtaaagcggcggcgggagaatcttcgccggatcggcggcggtggcggaggaggaggaggaggaggaggaagagggtggtgctgatttggtgtggaggcggggaaatgcgtgatgtgtgagatctagggcgtggggaggcggatcgcggcaatggcggcgcatcggtgggcggtgtgggcggtgctgctgctgcggctgctcgtgccggcggcgcgggtgctcgccaacatggaaggtgggtggggggggaggtttgcgtttgagttgagcttttgcttgggttttggtcgatctggggtgtgttcttgctgggttggagtggattggtgtcgggagcttggggggtggctgcttgcttggcttggtttgagcagttagtacaagttgccgcggctgctggtttttgctgtgtgtgtaagttgctacgagacgtcgcttgattttggtttgatgcgtggccgctttgtacggatcctaccttttttactctccctcgcggaagaatcggagcattttctcgaatttttctccggtcgaatttggacttctctgcgttccaaattcactccgaattcccctagcctgtgaattgcttcaaaaatctgcgcaaagtcgggagctaaatttgcgctttcaaaatgtgaaacccttgtcggaaaaaagttgccatcgcgtttgatttaatttaatttaattttccatgcatttggatcatgtgttctattgaatgaagatttgaactgtgctgcgccgatgctgcacgtttcggagatttcccctttctatcgggtttctgcgtgcgcttgagagagctactgttgcattaaatcgcgttgctacacgttgcttgctagttgttcatggactaatctgctagagctgtgttaatcgattctttcccgtggttgttaggtcttgattaggacgtctaatgacgtggttttgctatttcgggccattgttagattcgagctgtcggtgcctaagttcgtgacataattgggttaccttttcgcgcgcgcgtgcgggttggtggctaggtgatttttcaagccggactttgtgtctaatcatggtacgaaatgggatggatcgtttcgattgcggattttctcgagcatggcttgtttagtcttgagatcccagttgcttaggcctgcctgggattgattaggacgttgatgcgcgtttgacgacgctagactgctaattttgggggtgggattggttgtatgtgtgtagttctagttggggattcggcaaattgtagtgggggcctgtgagctgtgggtcaaattgtattttccaggacaattggtagttgatgtgtgatcttgaagcttcaagcacctgaagcctgatggtgattgcttgtatttgaaaactttggtagtagtaggatataaagaggccaagttggtgttgtaattttcattttagttcgaccctttgatgctgatctcttacttaggtacttactttggagtgattcataagaaaatttaaaagcttattcacgacttacattctcataattgagatgttctcataattgatgatattttgagtttggctcactggttttaagtctagcgtctaagagttatctttcatgtacttatttgcccctttgtcatatactagagtaacaatttaactttttttaaaaacaaatcatactagctatggctgatgaaatggaatttttttgacatacaagtcagatagaattgtgccagatgcaatacaaacaccacatgaatcatgcatgctagttgaccttttggtttcgctccttttctgcatgatgatttggagtgttttcctttggacaaattctattttcaatctacacaacaattattagctactatttatgcacaatcctcattgattgtttggttaaattttattcacctgttgttgatacatgattctattattggcaggtgatgcattgcatagcttgaggactaatttagttgatcctaataatgttctacaaagttgggacccaactctggtcaatccgtgcacttggtttcatgttacttgcaataacgacaacagtgttatcagagtgtacgtgctaccttttgtctactatgcaatccacgcctcatacatttttattgaaattatctccatttttcagtgatcttgggaatgctgcactatcaggcactttggtcccacaacttgggcaactaaaaaacttgcaatacctgtaagttctcttcctgttgttaagtgttgtgcacatcattaaatgccattcctgctgcacatggtgcaatgttttgtcattgttctgatctttgaatttaggttaataccttgtaatgtgatatacgaattcatataataaatgttccattttgtaaataaatgcctattacctttcttatgtgagtatgtgatgaatgtctcacctatatcatcagaatatctacagtcacgtggagaaatattcctagctagtgtgttgtgctcagatcaactcaagccaatcactgagtattgtagagtattaatgttcattgttttctctttatgatgcagggagctctacagtaataacataagcggaacgatacctagtgaacttggaaacctcacaaacttggtcagtttggatttgtacttgaacaacttcactggtccaataccagattcacttggaaacctattgaagctacgattcctgtatgcttctactttactagctaaccgcttctacatatttacgtttagtagagatatacatggtcagccatctcatatttttaggacttggaaactatacttaaatacatatgttttagctggtgagtatttttgagctctcaacctaaggatcttgaattttcagaacacatattctcttagcatagtgcattggaatattggatagagatgaaatgaatctgtggtagtatcggttcatggcaatataaagcctatcgttgagaatcatgctgatgtagccaaccatatagctaaattggttttgtcgaccatttaacctgatatcaatggacagttggacacgcaatgcttacatattttggataacagcacttaacatggtaatgccattgttttaccaacatgcacttataagtgggaaaacattgccatgtgtactacaacaaaatgatttggttcgatttgttttcctggtctgaccttttcattcaacttggttgtgcattagtacattgcaattatatttccagactgctgtttatgagatgatggatagcttttgctactttctcactccttttctgatgttttagggcatctcctatgcctcttgattttcgaagtagttttctagagtctctgcattatatttattctctgtcattttctgtcaatgttactaatttggtgacttattttgtatttctgcgaggataggcgtcttaacaataacagcctttcgggttcaattcctaaatcactaactgctatcactgccctacaagttctgtaagttatccccccccctttattatacacttgtttaatcctttcttttcagtgtagtctttgttttttgttctgtggtttaattagtaaataacccatggtcaatgttttctatttaattaaagagatctttcaaacaacaatttgtctggagaagttccatcaactggttccttttcattattcacccctatcaggtaaaactagatttaataatgattgcagttcactgctcttttccaatacactgctgctatttacacttgcctgtcttttgcagttttgccaacaacccttccttgtgtggtcctgggaccacaaaaccttgccctggtgctccccccttttccccacctcctccatataatcctccaactcctgtgcagtcaccaggtgagatctgttcatattcacagctgtgcaacagccaacactatgatttttttttgttgcactgacgcgtggtacttatgctggtatggactatggaacatattgttgttgttctgacaataataacctcatgttctatagggagttcatctagtactggagcaattgctggtggagtggctgctggagcagccttgctatttgctattcctgctattggttttgcatggtatcggcgcaggaaaccccaagagcatttctttgatgtgcctggtaagcgtccaatagaacaagcgaacttggagaataatattgagccaactttgattgagattcattatttgttacagctgaggaggatccagaggtccatcttggccagcttaaaagattttcactacgagaactacaagttgcaacagataccttcagcaataaaaacattctcggaagaggtgggtttggcaaggtctataaaggaagattagcagatggttctttagtagctgttaagagactaaaggaggagagaacacctggtggggaactacagtttcaaacagaagttgagatgattagcatggctgtacatagaaatctgctgcgtttacgagggttctgtatgacacccacagaaaggttgcttgtgtatccatacatggctaatggaagcgttgcgtcacgtcttagaggtacgttgccttttttttttccaatctgacatccctgtatctttcagataattggagggttgatttgggttttatattatagaacggccaccatcggaacctccacttgattggcgaacaagaagaaggattgcgttgggttccgccagggggctgtcctatttacatgatcattgtgacccaaagattatccatcgtgatgtcaaagctgcaaatattttattagatgaagactttgaagctgtagtaggggactttggtttggccaaactaatggattacaaggatacccatgtaacaactgcagttcgtggaacaattgggcatattgcaccagaatatctttcaacaggaaaatcatctgagaaaactgatgtatttggttatgggattatgcttttggagcttataacaggacaacgtgcctttgaccttgctcgtctagccaatgatgatgatgtcatgctactggactgggtaattgactagcacaatcttcaattcaaattgcagtccatattcatgcccttttgtggcttgatgttgtgttgggagttagataaaattacttttatgtatgtccaaaatcgtatcatataaaaaatagtagttacagtaaggtcttaaaagtagtcctttttttaatcattatggcattagctaagctaagcataggattgaacatcatcgtctgagaaatacactgttatatggtaagccaatattcatgtgctgtgctttgtgcaggtaaaaggattactcaaggagaaaaggctggagatgttggttgatccagatttacagagcaactacattgatgttgaggtagaatcactaatccaggttgctcttctttgcacacaaggctcccccacagaacgccccaagatggcggaggttgtgaggatgcttgaaggtgatggccttgccgagagatgggaggagtggcagaagatagaagtagtacggcaggaggtagagcttggccctcatcggaactcagagtggattgtcgactcgacggacaaccttcatgcggttgagctatcagggccgaggtgatgacagcgcactggtagtttgctgctaattcttgtccgtcggaagagtgatttttatcagccatcctagtcgaatcgccatttgttcataccaaccaattggcccaatgtagccagctacaactatgttttgatgtatattgcttgatttgctccttgatgtgccgccttggatatcggtgacccgaaaacagcaggagcccaaggaactattgtcctgaagcttgcaagttgcaacaagatcccagtatgttaaagctcacaaggtagcagctaggagtgaggttgctgcggctgtttgctggacctgtgaaaattgtactgactggtgacatctaactattttgtaccaaatgtaaggaaaaaccatggtattattactttggcctcctctgggaaaggttcagaactttcagatgatgcagttggcctcactggtatactctatttggacatttgattatgatgtgtttactgtaaatgatacccagttctgaatcaaatgtaccttctgcatacagatgaaatctttggtagaaattgcttatttctttttattgggtcgattgtgcaatcttgtttccttcgccgtgtccatcacgaaagatgacttgaaggctagctatgtactccctccgtctcataatataagggattttgagttttcgcttgtaacgtttgaccactcgtcttatttaatttttttaaaattattatttattttatttgtgacttactttattatccacattacttaagcataacttttcgtttttttatatgttcatccatttagcacttataaatccgtttgaattcaactattttccaatttcttcacttgctccggccatgggtgcagcaactccaaatggctcgtctttttcttgagaacaccaaatggttcgtcttgttcgtatatttttatggtgcatatgttacgtagcttctcgacataaaacgtcctgttcataaacatactttttcacggttggatatctaccatgaaatccgcagaggatgttcagctcttgtcaaattcttactgcctgtttaatacaataaatctagatagttgtttattacactgtgttggtttgtttattttgaggcagagggagcatgtctcaaacgtgttggttttgcatcaattaaaacagtatttctcagtcttaaaatataagcatttctaagtataaatatgaacgactgtatatctaaattcgtagccaaaagttactatattttgggataaatgtagtatgtaagacaatgcagttctcaagctgccgaattctcacgttccaaattatggctttagtttcaaaatgacagcaaatcctctcacggatcaaggaattgagaaacatttgacttacaaaattcaaaaaagcccaacaaaaacccaaaaacccaccagccagagggtttttcactttgggtatgtttagttcccaaaaagtttttttcaaaaacatcacattgaatctttgggcgcttgcatggagtattgtatatagataaaaagaaaaattaatcacacaattatgtgggaaatcgcgagacgaatcttttgagcctaattagtccatgattagccataagtgctacagtaacccatatgtgctaatgacggcttaattaggctcaaaagatttgtctcgcggttttcgggcgagttctaaaattagttttttcattcgtgtccgatcaaacgtctgatgtgacgttcaaaaattttcttttccccaactaaacaagccctttttctccctttcacccttcccctccaggcctccacctggctcaaagccggtggcatactttcccggtgatggcagcggccggcgagctcgcaaacgacggcggagacgcaagtccggtgaccccatgcccgctagaggtagcggcggcaatgcagcttctcttcctcttcctcccccgccggtctcccctatcctccctcgattgtggcgtcgtcccgcggcagctcgcgagtgcatgcgcggcggaggtccaaaggaccggaggcggggacgaagcgagcaccgccccccgccagatccggaggcggagtgccgcgtgcggcgtcgcccgcggcggcccgccggcgggtgcgcgtccaaggggatcaggcaagctgctgcgctcggcatcggcggatcggcctcgctcgcactagtcgcactcatcgtgggactggtcggggagcaacggctttgcgccgacgagcataggcatgcggcgatccttccttcttttgcctcctattccagtgatttcttgcaaattacccccaaattgttgcagatcagatggatttccttgatttcttgtgcaggcgtgccgccgctcaacatggaaactttccaagtgaaggaaagatggagactatgaaaaacgctagctccacaaagtggtgtgctagttggtctaggttcgaaatctcaccccttttatttatttgatattagtttattctccaatattcgtgtttttttaagatggagaatattataactgaaactaataatagcaatactgaggtttaggataataattgtgcggccagaaaacactattcactgaggtttaggataacaattcactaatattcgcggtttaggataacaattgatattagtttattctctaatattcatgtttttttaagatggagaatattataactgaaaataataataacaagagtgaggtttaggataataattgtgtggccagaaaacaaggtttaggataacaattgtgtggccagaaaactctagttgacttgaccgagtggactaggtgcatcatcttccttgcaaataccatataggcatatgaacacaatgcatttcctcagatcctgaacaattacaagtagcttcctactattacgactagtaccatcaaactacttcatccgactgagagctgagctcagacataagagagtaatggcgacgatgcttgtgggtgtttctacaggagtaatgaacaccctcctgtccaagctctccaagattttggaggacaaatacacaaagctcaaaggagtacgccgtcaaatcgcattctttagaaatgagttgagcagcatgaaggctgccttggagatgcttgaaactgtagaggaacttgatcccctccagaaggaatggagggacacagtgcgtgagctggcttatgatatcgaggactgtattgatcccttcttggttcttgttgatcagaagcaagatgaacaatcaacattctttaaggggttctcctacaaactgaagaagatgaaggctcgccatgagatctctaatgagattgaagaactgaagacacgcgtgatagaggcaagcaagaggcacaagagatataattttgttggtctacaatccagccatggcacttctggtattgaccctaggctgcgagcactctacgttgaggttgatgagcttgtgggaatcaaaggaccaaaggagcatgtcatggagtggtttgccaaggggagaggtgatgtagaagtgaaggtgttgtccgttgtgggttctggaggtctgggtaagactactcttgccaaccaaatcttccgtcaattgaagtgccaatttgaatgcacaggttttgtatctgtgtcacgaagtcctgacataaagagtatttaaagacaaatgcatactgaggtagggatcactgatgacacatctgaagatgagcgacaactgatagacaaaataagggaccacctcaaagataaaaggtaaacccagtaatccacttataacaactaatgattttctgcattttgttaagcacagaaaccaaacatggaagcatacaataaacaataattagtggcataactacatgcattttctttgtttataaagtgcatactgcatatacatatgctaaaaacaagaagtctagtcttgactgctataactgtcatgagtaaattgcataaactttctaaaccatttttgtataacaacattaatgaaaaactaacttcttgatggcaaatgacaaagacgtgtgtaaatttgtactgcttgactttttttcaacaaaatccaaatttacaaataggatttcttttctcagagtgcaaaattgtactgcttgatggcaaatggcaacacatatgtgagcatttggaaaggaaggtatttttctccattcctactagaacaaaactaccacctgtggaatatctgcattccaaacaattttttttctcaaaagcgcaggactgcatttcatttcatcaagaagaaaggaaataaatacaaaaagagggggctaaactaacaccagcctacactaacaacacctaagggcaacacacaacctcaacaagcaaacacaaactaattgcccggggtaagcaaacctacagtgaaactcatggagtgcgtaagctccagcaaaactacactcatttattttatagcctgcaaactcccgcgcccccccccccccaaaaaaaaaaaacgtttggattagcactattgaaaacacaatcgttgcgatgcttccaaatctcccaagcaactaggatgatcaacgagttcaatcagttgtgcaactctagataccccttgatggctttgccccaccatgctgagaatcaagtttatgatggttgaggtgcagcaccagccagccgtagcctcaagaggagtggggcaagagaaaacacatgatacgaggatatgctgaaatagtcatcaccactttggtcgcttattgggcaggcaacaaaatgtgacaaccctcgcttagcaagtcgatcagaagtcaacatatgacgttgattgctaaccaaataaaaaacttgcaacataaaggagctcagcttttccaaatccgcttccatggagcaaacttgatagatcccaggaaataagacttgtaggctgatttacttgtgtgggaaccagaccctgtgagcttccaaatatgctggtcctgaactccatgctgcaagaccaccccatcaaccaaatcccagatcagcaaatacttagagagaacatggacagacaagccaccttttataccagccacccaccgcctatttactagtgcttgtgccacagtacgttgcttcgttgatcttttggtgattaaataaaaaagattgggaaagggcatgtagcctagtggttgcagtaatctgagtagcactccaaggtcctaagttcaaatctctataggagcgaatttcggattgggttatttgagggctaagttccctgtttgataggctaagttcataatttaaaaaggctgcatatatccagttggatgtagagatcgggtaaaaaaatacccttctctaaaaaaaaaagattgggagcctattcagttatcgttcttccttgccaccatctatcactccagtacatggtattttccccgttgccaactatagtttccacacccactctgaacacagagcgaacactgcgatgtacttgtataggtaacacgttacaaggcctagtggagtcagtttttttaagtctaagccacctcaagattatgaatgccaagccccccttaaagagaggccaacaaacacgatcccaggagacaaggcagttatcactattggccttctcctgacccttccaaaggaagcccttgcgccttttatcaatagccctggacacccatttgggaagattcattgccatgaccgaatagataagtatagctgtcaagaccacacagaccatcacaagccggccagcctggttcataagggaagctttccacactggtaggccatccgccactttgtcaaccaatggcaacaaatcatccttaatggtttgcgagttgtgacggaagggcaagataagagcaaggaaagctcttcacttcacaagaaagctcagtggagagaacttccaagtcttcctcggaacattggataggggtgcacaaactccttgtcattttggtcttaagacctgaaatacagccaaaaaaatctaggatcacccttgtaggtcagaggaacatcattgttatgtggagggatgaattggggtgctcgacgggagggcaaggttgctgcagcttcgctgccccggagcctaggtgaggccgaacagagaagaggggagactagagataggtttaacttctttcttgattaattccacatgactgtggtgcctctccttatatagagccggctcctaacaaacatcctaacaaccttatcaaataaagcctaacaaacctcctaacaaccttatctaataaagcctaataaccttatctaataatgagaggggctgagttctgcccataacaatcaccacattatctgtgcgtatagagaaatccgatgtgccatctttggaacagcatggggccgacgaagattattgtggatgcatgaaccacgataaattcagcaaattcataactaaaaaaaaacatggggatggaggctccgaagatgaagtgttatttgccccggttccctattaatcaaagctcctgtggaagaagtggagagcggtaggcatagcaagttacaataccaccttccaaaccccaagtattttagtacctcaattaggaaggaccaatcaagcgaatcaaaggcctttgatatgtcaagtttaaacaaaacatggggctctttcttactgtgtaattttcttgccacctgttggacaagcagacaattgtcctgtatacttcttcccttgatgaatgcactttgatttatggaaaccatccccggaagcaaaggtgctaggcgatgtgccaaccaacttagcaaaatttgaataagactaatggaacgataatactttacttgaatcgcatcaattttttttttggcaacaaggcaatgaaagctgttttaagaagtttgaacttagccacatgaccacactgaattgctgagaaggccaaagatcacatcattttttgataatgtcccaagtcccaacacgatgtagaaccgaaagttccaacttccgaacaattgaatgtccacaataaatccatgcattaagatacattgccacatactcccctcaataagtgtatttttagcctaacaatttgtccctaatagagtgtagttttatagtggtccactagacctctttaatactacatccttttcttctcattttagtcattgaacaaatagtactccctcctcctcgttttctccccctccttgttttctctccattttaatgaagggcatattagtcttttgacctcgtccttaatatgtctttgactagctaaaactacagttatttagggacggagggttttatgtgtgcaaaatctgaccatatatatgctttgagaagacatatccatttccctaactaggttcctcattgatatttataaaactgggacctgagctctagagtaagcatgcatactagtatataaccctgattgcagtagggtggtaagcatacttgaatgatatataactaaataaccctgttaaaatcatggaacaggtactttgttgtaattgatgatgtatgggatgttgaagcatgggaagctgtgaaacttgccttgttcaataatagatgtggtagcagaatcgtcatgacaacacgtaatgcagcagttgcatcgcattgctcacgtggtggtgtttgtgtctatcaaatggaaccccttagttttgctgactccaaaatgttgttttgccaaagagcatttcgttcccaggaattatactatccccatttggaagaagtttgtgatgagatactggcaaagtgtggtggattaccattggcaattattactgtatctagcttgttagccggcaagcatgcaaaagatgaatgggacaggatgctaactgctattggccatgcacttgctaagaatcctgatgctgctaacatgacaaagatattatctctcagttactttgatcttccccaccatctaagaacttgtttcttatatttgagtgtatttccagaagattacaagatcagcaagcaacacttgataaatagatggattgccgaaggatttgttcatgaagaacaaggatggaggacctatgaagttggcgggaactattttaatgatctcatcaatagaagtttgatcgaaccagttgatataaatgatggccaggcgaaggcatgtcaagttcatgacatcattcttgatttcatcacatgcaaggctgccgaggaaaatttcgtcacctcagtgaattctgtggagcatgggaacatttc

SEQ ID NO: 74516 - DNA, 5863 bp, Oryza sativa
ccgggactaaaaatagatctttagtcccggttggtaacatcaatcgggagtaaagcttatattgatcttttttcccggttagtgttaccaaccgagactataaatagatctttagtcccggttggtaacaaatcaaaaaattcctcagagctttcaaaccaggactaaagatgtttttagtcccggtttttaatacaaccgggactattgtgaaatctggtggaccgaccaaaaatggtttctccaccagtgtttgcttctccttttatcttaacgtaagagagatgtattccttgtaatttctatttcagtttagtggaattataatcgcagggaccttcttcttgttctctatgttaggaaaccggccggcccatgaaagctcggcacaggttatactctaatgggccatcactagagagaaggattgtacacttgaagatgaaatgatgagttggaatgttgcctctctacatatctttgtgtttccactttttcagacattatgcaacccctctagactacgcttataacataagggttgcataacacgttctcactacgacattctaccgaagaccgagagagaataactttgtgtctctactttttcagatattatgcaacccctatagactacgcttatagcataagggttgcataacacgttctcactacgatattctaccgaagaccgagagagaataagggaagaacttgtaagatccattctgcatatcgctcatctaattgtgcaaatggtaagaacttctttttcttttgcatgaatcataaatctatctcggttgtcaaaatatagccgtagcgttagcacggataaattattagttacagatgaaacatcaaattttaacggttgaaacatatatgtcttttctctaaattataatctctaaattataatcttgtgatcttattttaaaattttaattaaaacaaattcaatggtataatcgaatcgtagacctgttaattagtttatgagaaaatttgtattagatactagtaatacactttctaacctataaaaaaaaaagagaaaaatgagtatacgttgccctgcatacaacatgcagggggagagagtgcgcgtgctactgtatagaggggctgttgagttaaaaaaaaacatttcacccatcacattaaatttggatatatacatggagtattaaatgtgaaaaaacaattatacagtttgcgtataaattacaagatgaatcttttaaacctaattgtgccatgatttgataatgtggtgctatagtaaacatttactaatgacgaattaattaggcttaataaatttgtctcgtggttttatgtggaatctgttattagactatgtttaatttagttctccgtatatttgatgtgacgcaaggaatttttttttccaactaaacaggcccaccgtttagagaaaaagagagcgggtttcttttcaatcttaaaatcgggatcagcacatgggagaaaggaccgagcgagggctcgaacttttttcccccttgcgcgtcgggcgcccgaggtaaatcattttgaagaacaagttggacggattccattgtcagaccgtatcaatccccttttcatttgttaaagaaaatgttaaaaaaagaagaagagaagtatacctacccgtcccggttttcccccaaacttggctgcactgcagagctcctgttgttgggtgttcgattacagacatctggttcgctgtaggagtttattagcacgtgattaataaaatttattttagctatttttttaagaaaatagattaatataatttttaagcaacttttatataaaacttttataaaaaaacatatcgtttatcagtttaaaaaacgtgcgcgcgaaaaaagagaggggtgagttgaaaaaaagattctgttctttaggtgtaaagttttcgaaatatatggtcgtacatttgaaatattaaatgtaaaataataaaataaattacatattctgtctgtaaactacaagacgaattcattaagcataattaatctgtcattagcaaatatttactgtagcatcatattgtcaaatcatgacgtaattaagcttaaaagattcgtttcgcacatcctgagggcagcaattggttttttttcccatatttagtgccttatgcatatgtctaaatatttgatggcagcaattggttttttttttcatatttagtgccttatgcatatgtccaaacatttaatatgatgtttttggccaaatttttttaatctaaacaaggccatagctcatagctgccctctccctgacttctgaatctcttttagagagagagagagagagagatgagttcttattcccttggcggcatggatgctccggtgagtttctccctaggtgccatgggccctctcctcaggaagctcgattcgcttccggtggctcccgaaatccggctgcctgagccactgaaggacggaatcgagctcctcaaggaagatctagaagaaatcggtgccgccctcgtggagcagtccatggtagattccccaagccacagggcaagatactggatggatgaggtgcgtgacctctcctaccacatcgaggactgcatcgacaccatgttttcgatgcgctgcggcggcgacgacggcaagcccagatccgttcgccgccacaaggttggccgtgtgaaggttgacggtttctccaagacgcagaagccgtgcacgaggctcgccaggatcgcggagctcagggctctggtgcgggaggccagcgagcgccacgaaaggtaccagcttggtgacggccgcgcctcgagctcgagctcgagctctcaccgcgtgttcactgcgcacggccaggttcctgcgccgtgcagaaatctggttggcatggacgaaccgaagacgaagctcaccaatatgctcaccgacgaagcagagctgcatatgaaagtggtatgcattcttggatcagccggtattggtaagaccacgcttgctgaacaagtataccgtaaacttagatggcaattcgattgccatgcttttgtgcgggcatcacgaaaacctgacatgaggaggcttcttggggccatcctctctcaagttcagctgcgtatacggatatctgataccagcacggtgcagagccttattgataatctctgggagtatctacagaaaaagaggtaattaattaacgctatattcactgctttttaatactagttcagctactgagcatcaccaatagactctcaaaattctattcccaaaaatctgttattgggcgttctaaactgattttggggtgttgaatgtattcctccttccaacaaattggcttaattaactgcctaaaattaaggacttggcccatgtaaaaactattaacagaaatcatgctccccatcatccatcatccagcgtgatcacatctgcatgatcggccacgcctccctccgcgatcactcccgccatgattttgggagtcaaccctctcccctagaagagtagagcaagacatacgggaatgggagctgcaaaattttggtagacctttcggatattgttggagcaagatttttacaaaaaaaattgtaaattttggtattgggaatgattttgggagactcttgtgaggctatctccaacccttcatgtcattagcatgaggggactcagtgtccatagcattaagtatattgtcacatcggaaaaaatctgaggtggcaagagagttaatgaggagagagatgaaaagatgaagaaaccatctcttcacaacaaccaagaatgaaaacaagtgataggttcataaaaggagagagaagaaagatgattggatatatagtgtctatatgacatagcaagtatggaaactactttgatagtttctaggttggggatggcctgatgctgcacattgaacaattgctgttccctccgtcacattgaataaggcgcgcatgcattttaaaattgaactctctaaatatctgatcaataatattttgttataaattaacttttatttgacaaaaataatatcattggattgacatttaaatttactttgatataattgtgattttgttgttacaaatatcatagtattttagatattcaaaatcaaagatttgttttaaaaaccataccaagtttgactgcgccggataaagggggtaatttagaaaataaataaataaataaatatattatcctgataaacttcctttcctttttgagagagacctgatacactttgttcttttcccagagaatataatttaattatactttgcaggtattttattgtaattgatgaattatatgaaacagcaacatgggatatcattaccagtgcttttccagaggataataattgcagtaggataatgactacggctggaattgaaggtgtagctctcgaatgctgcagttatcattctgtcaatattttcaagatgatacctcttggccttgatgattctgcaaaattattctttaatagagtttttggatcagagcaacaatgtccttatgaattgaatgaagtttcatataggattacagcaaaatgtggtggattgccactagcagtcattattatagccggtcttttagcaagcctgccgtgcaaaacagagctgtggtacaatatagatggatgtttatgttccagtgtgactacagatattgatttggatgagatactgaaggaaatcataagtcttggctacgacaatcttccacattatttgaagacatgtctgttgtatcttagtttatattcggagggtttcataatttggacggctgacttactgaagcaatggatatctgaaggtttcatcgctgtaatagatggagaagacatagaggaagtcgctgagagctatttctataaccttgttaacaggggaatgatccaaagtgtgaaaactaagtacaataatcaggtgttgtgtactgtgcaccacactgtatttgatcttattattcacaagtccaaagaagagaaatttatctccgcaatagattactctcaaactatgccaggaaattctttagaggctcgtcgattgtcattccactttagcaataccagatatgcaactgaagttgcaggtattacactgtcacaagttcgttcgtttgcctttcttggacttctgaagtgtatgccttctattatggaatttaagcttcttcgggttctaattcttgaattttggggagataaccatggatgcatgagttttaacgttgcaagaatttgtagattgtttcagcttagatatttgaagatctcaagccaaataataatagaattaccagcccagatccgggggctaaaatacttggaaacacttgaaatagatgcaagagtaactgcgattccatctgatattattcatctccgaagtttgttgcatctatattttcaagatgggatcgttctacctgatggcattggctgcatcagatctttgcgtacacttaagtattttgatcttggaagtaactctgaagagaatatacggagtcttggtcagctgacgaacttacgggatcttcatctcacttgttctgcaccaaaatctaatcagcaggcaaagagaaacctcgtaattctagcctcttatactgggaaactcggtaacctcaaatctgtcaaattttctcctggtgattcaggcatggatatttcctttttgttttatggaattggtatttcggttgatcgttccagaacagcgtcctctcttcctttctctgttaggacattagagttgccatccatttgcatatttgctagacttcctgactggattggtcaactc

SEQ ID NO: 74517 - DNA, 7911 bp, Oryza sativa
tttatggaattggtatttcggttgatcgttccagaacagcgtcctctcttcctttctctgttaggacattagagttgccatccatttgcatatttgctagacttcctgactggattggtcaactccgtaaactccacacattgaatcttgctgttagagaactgatagaaaatgatattgatagtcttgcaggactgcctgacctcattgttctctcaatgcatatcatgaaagctcctatggaaaggattgtcttcaacagaaaagcatttccagttctcaagtatttcaagtttatatgtggcacactgcgcatggcttttcaggcaggagccatggccaatcttcacaggctcaagctaggtttcaatgcccataaaggggagaagtatgacaatattcttgtaggcattgagcacctattaaacctcaagaagattgctgttcgaattggaggagctgctgaagccaaggagtctgacaggatggctgcagaggctgcgttgaaagaagccattagaaagcatctaatgtttcttgatgatctcgacatagcaagggtagaatgtgttaaggaagagtataagtgtattaagaaaaaacacaagatcaagattgaagattcaattagcgaaaaaaatggggactcaaaaaagcagcattctgtcgaaaagaaagcagtgtggggcaaaactatgaagaatattgctgatagtgggtatgttctttcctattatttcagcctctacattttccaatatatattgtttagaaataaatgattactacaacaataaccttatagtaaaacgctaaaacacagttgtatcaaaaggaatctttacaaaggtacatctatgctctttgaaaaggataagatgggatgctctatactaattggagcctctactagaagctttcacattaaccttagaaggcaaaagactggaaattcccacattaacaaaaaagaaaactaaaagcattaatctttgaaagatcaaatggtatgcgccaatgtatcaaatctaaggttgatatcttccaccacagaatatgtgcatttatcaaatttggaatcaataaatacctagttatacttggtttggacactcgagtatagtattttgatgaataataattgaaacattcagcattaacaaatattgagttttactcggtctagagtctcactagcttattttttatgattttattttataattccgaaattcagaattgataaatactgtgttgtactaggtttgaagtttttgttgaataatagtttcaaaattcaaaaacaataaatatgctcaatttagagcgtagagtaattttctcatgacctaataattctgcagtttagatttaatcatagtatctcatgatttgataattcaaaaatcgaaattaatacatactcagttgatgcttgtacattcacacgggttaatttctaccggtgtccaagcggtgtagcaagatcaaatagtatgggttagactcaatttacactttgtagtcaaagttgtgtgaccttgtaagcaatctagacaaatggcaaatctatggctatctaaaatttaaaacaaatcagacatgctatttacgggaagctgttttgatccctcaagagaatgtccctcgcttgtaaaaaaaaaccatctagaattctcaaaaaaaattcacaacattcatactatgtatgtatgtatgtatgcatgcatgcatgcatgcacacacacacacatgtatgtacatataacacatatacatatacatatacatattcatacataacgcacacacacaaattaacttaaatttttgaaaattttcaacttatgagtatatactaaggtacaagaatttgattcgtacctatatctagcaacaaaacaactcaaattcaactttattttacaatccattattacatacctaactaattatatgtttgggtggtatatacctagaagcaaaatctaacaaaaaaatgttcaaatttagttcaaacttgttagtaaagaagttaatgtccatacctgatctacattgccttgctctcatcatcgtcagcgttgtggcctttctcacaggcaacctctcctcgctcgagatccataaaaacaagagagaaaaaaatggattggttagttcgtgtgtgtatctatatataggtctatagtaaaaaaattactgggtgatgcgttgtgggatgggcgatgctggtagtctgcgggggtgggtttacacacacaacactccactaggtccaaactcaatttataacatttaggtataaaaaataaatatattcataccggaatttgtctttttgtttctcaatatataggtcgaatttgaagttgttctctcgtggaatgttagatgtcactgtactccacattgttaattaaatttttataactattttaattgaatttaaaagcaaaaaagtatatgaggggatatcctttcgtgggattagaattcattcctgctattaactagacctgtattgcagcgtgtttcctgaagattatactatgtcaagggagcaacgggtcgcagaaggcttcgtagtgggcattgaaaagtgcagggcagaggatgcggccgagcgaataatcaggaatgtgcctgtggactatgatgggcttggccaggtgagcacatccaagatacaggaccacttgcctgaacttgctcctcgtgctgtgcaaaacgagaagttcggctcttcaaatgatcttagcataatgatacaaatcaacaagtatgctcgtctgccatcttatgagtggagggacactgatatatccaaactgaatttccggcttctccgcgccccgatgttacttgaagctgtaacggcccgttgtcacttgttggacttaatcctcattggttcaaacaacattactgttcttgaccttggacgtcccacaatcaccaaactgccggcatctatagaatgtctacctaatttacggtacttgaggttgcagggcacgcaactgaagtcgctgtcggaggttattgtgaagatccccccatcagggggttggacatcaagaataccaagacagaggagctaccacaaggcattttgaggatgaagaagttgagtcacctgagtatgggggagaagcagaaaaatattcaagtattcatggaaaaaatgcagactctggctgagaccgtccaagacagcgatgacttgtccgacgaaacagagggaatagccgacgacgaaggcgagttctctacaagggccaacgcgtcaacaccgaaggtggatgaggacgaggtggaccggagggccaataacttcatcgccaggttcaggaagcagatcacgatcaggaattcaggattcgccaaaaaggagagcagcatcgacgaacgactgtggatacgagatctcgatgagtgccaactctccaagagaggtggacgattttaagaagaagttcgacgagatcattgccaggaacaggcacacatggaagccaatcgagtcaccgcgttctgtcaagcacggcaagtatttcgttcgctgcccgccgtcgctaatcaccagcgctgtcttttcctttttctttctttctatttttctagtatggtactccctccgtttcaggatattgtcaggaaacccctaatcaatcgccttgtgaacactggatgaactcacgcgaaagtggaagaacacgtagaacacaatagtgtagacgaacagacaacaaaaacagagtttttggtgctgcctgaattgcttgcagcttttcggggttttttctctccttttattgtacagaactgaaacatgcaaagctacgccaaaatactcggatctctacccacgactcgcggcttgatcgcgtccatccccacgtccgctcatcgtgcgcatacgcccgcaggcttaggcacgccgcgagctattctcgcttgactcctacacgcacggcttccacacgttggggctcatacactgacaatgcacaaaacagaatccaaagcttagataactagctaaaaacaagcatgcaagatttatcctcgaacaattctccccctaaaccttgcatggctgtaaaacctcaacaagaccgatcttggaccaaagctccatgaatcgatctcgcccaagggcctttgttaagatgtatgcaagctgctcgtcagtattgatgtattattcgatcttaaccctgccttcctcgacgcactcccgaatgaaatgatacctagtgtccatatgtttgctgcgatcgtgaaacacagggtccatatgtggtctaacccctggtttgataggtagccgatgttcaacaattgatcagctgagtcttggcatctcataatactcccaagcgaagcaatctctgaattcctttaacagctctatcaacttggttctaaattccgaagataaattcttactaataaatgtcggccttggtcgatcacccggacctatgtcaatctcttccaaatcatcggctgacatgaaactctgtccttgcttgtcatcgagatcatctactgtgtcctcggtgtagacgtttgaaccctccacgacgccctcaaaataatagcttgggctctccatctttaattggctgtatatcagaatcggacacttttagaaaatctccatcccaaacttttccagataagcaatcgagaccatccatctcccaaagagctaaatcggcactggcaatattaactgacctgtcggctggcacattttcaatctcgtcgccttaccactgaatcaagcattgatgcatggttgaaggaatacaacaaatagcatgaatccgatcccttccaagcaacaagctgtaggaacccttcccatcgatgacaaaaaatgttgtagggatagttttgctgtcgactgtcagttccacattcaaaattcctttggtttctgatggattaccaccaaaatctttgagcaccatgtttgtctagatgagatcctcagcatttctgcccagcttcctaaatatagcataaggcatcaaattcactgcagccctaccatcgaccatcatcttggacatcggcttcccattgacatagccatttatatacaatggtttaagatgccgattctttgccccttccggcttctcgaagactgcttgttctggtgacaaaattaacttagccgattcttcttcaactttgtcaacatcggcttgtttgaccccaaattcagcaggcaacgtgaaaaccatgttagatgcggtcacaacaccttttcctttagccaatctctttgcttcatcggctgtggcttcatcggctgcaggaacttgattcttaacacgccactcctgctttggcttctccttctttagccgatgattgatttcttgctcaacctcctgaaagcgctccctattcctcaacctttgaacccttctcttctgattctttgtaaaaataccagaaggacaccattgagtcttcccgtctttattgtcttcttggtcacaaccttggttcaccgggcccaacctttgatgaacaggaactcttgcttgccttagccgattgcttctattatacgatcggcttgaattctctataacattactgcacccaggacagtcttcaatagatggcagcctcataccttcattccagcaaaatctaaagaactcacagtcccaataaggatcaaaaccgccatcgtcttctccataatgcctcccctgctgttcgtcatattttttctgatacttattgatgattttagccgaattcacctgaaaacctcctgctcttcctccatcggctgtttggccagctgtgtgtaccatattaacaggaaaaggactgccatcaaccttcatcagcctcttggaatcatcaattttgattttgcctccctcaatagctgcatggatctgctgcctgaagactttgcaatcattggtagaatgagacccagaattatgccacttgcaataccttctcttgcccaattcttgagccgatgggattgtatgaccagcaggaagttgaatctgtttctcccgaagtagcaaatcaaaaatcttatcagccttggtaatatcaaagtcatacctctcctcttttccagaactctttacccattggcagggtataacctttttgcttctaacccactcggctactgctatttcagaatcatcatcatcatcatccaatccatatatgtaaggaaaaacatgattaacctttttaaaattcttcctggcctctgcaaacctttgttcatgcagggttaccttctatgcaagatgtgacaaactatcaaagtcttgagatgagaacttctccctgatcggagctatcataccctgaaaagccagatcggctaactgggcatcagtcaaggccaagctgtagcatttattcctcatctctctgaatctctaaatgtactcctgcacaggctcatcatgcctttgcttaattgctgtcaaatctgatagtttcatctcatgaatcccactgtagaaataactatgaaaatgcttctccaaatcggcccaactgttgattgacccacatggcaaagaagaaaaccaagtgaaagccaatccagacaaagacaatggaaaacctcaaggcatccacagccgatgcttcaccacactgagctaaaaatcggctaacgtgttcataggttgaaacactatcttgtcctgagaattttgaaaaatctggaactttgaatcagttaggcagaggaactctctcaaaccactcggggtaaggatgccgatacaaatttccagcatctttcggcttaagcccaaattgttcccttattacatccgcaatcatatcggctcatggtcgttgctgaggcactccttgtgcttgttgtggcacgggctcgaattgattgtattgaggaacaaactgggttgagctggtcctccttgctgatattgaacttgtggcgatggaggctgatactgataattcaaattgcccccctggtaattctgaaagtttggttgtatattacgcaccaaattttctggaaaaacttgaggtaccaccgtttgatctggttgcacattatgaaccaaatgctctgggacaacttgatttgcagcgtgttgccttagctgattgtcaggtgttacaaacccagctgatgtattcattaaaccttgccgctgaatcggttgaacaacttgttgcctccgtggggtttgctgaattggccgcaccacctgctgcgttggcggtgtctgttgaatcggctgttgctggactgcgtcaacagtaggttgagggggtaagaacatggctgcaccttcatcttgagttagccgactcacattctgttcactatgctgtggttgctctctcaccaacaaccgaggattaattaattgacccggtgtcgatgatggtgcagcaggtgcaggggccgatactggtgctaccggttgagccgatggtgcattgggaggaatcggctggacagctgactgattattagtaattaagggccgataatttgggaaaacacctcctggtaaataaaccggtcctatagcctgatactcagctatcgagccatcaaccatcgacttcaccatgtttgacaatgtgttgactaataccccagattaattaatcaaagcatgttgcacatcataatcaatccgatcttggaagttgttaaactgtagctgtgccgtgttgccatcttggttaggattttcaccttgaaatccctgagaaccatcaccttgaattccttgagaaccaacaccttgaaccccttgagagccatcaccttaaaccccttgaaaaccatccgcagtacctttatcacctgattgagttgcaccatctggaacctgctgtatt

SEQ ID NO: 74518 - DNA, 27870 bp, Oryza sativa
gttggagagagagggaggcggcggcggctctcaccctagagatgcggcggcggcggaggtggcagaggcggcggaggcggcgacgacgacgcccgcgagacaacggcgagatacgacggcggcgtcggcgcggggatgccctaggcagtggcggcgaaggagaagccgagagagatcgatcggggaaaaaacttctaagtgttggtggagaagacgagggcgcgcatcgggaatatatatatacccctaaatctttagtcccggttgatgagaacaagaacaactgggagtaaagatcttatcaatcgggactaaagataagatctttactcccggttgttctcaacaaccgggagtaaagatatcattactcccggttgttctcatcaaccgggactaaagataatttccctctattttcaaattctttttaaacccggttagggttaagaaccaggactactgataaacgcactgaatattgatttccattacatatgtgtttctaaaatagaaaataatgcactaaaattatttaaagtcgaaaaattaatgacaattacttcgaaaaattattgttgtctgtagtaaattaagtggataaaacgtaataagcaaatatatgatttaaaattaataaaaattctaataatcatatataattagcatatgaatgatattaaattaattgttaaaaactctaattaacatatgtaaatgccacatgtatgatttaaaacttttaaaaatcctaattatcgcatataactagcatatgcatgatttaaaattgttaaaaactctaagtaacatatgtaaatgccacatgcatgatttaaaacttttaaaaattctaattatcgcatataactagcatatgcatgatttaaaattgttaaaaactctaagtaacatatgtaaatgccacatgcatcatttaaaacttttaaaaattctaattattgcatataactagcatatacatgatttaaaactgttaaaacctctaataatcgtacgtaattaacatatgccatacaacaattgatttatatggataatcaatacatccaaaatagtttacatcgtgtatacaataattacggcaatacatcggcggtgacggttgaccgcacgtactatctcctcactattgttccctccttgtgatcgctacgtgagtaaggggtgtcttcatttgataggaggatgctagggtcaatcatcaccgtggaagggggttgcccatccaactaatcgtaatcctcgtcagtcttgtcctcaactccgacgatttttcttttgcctgggtgaaccacgtgacgcttcggctcgtcatgccctctacccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgccggttgttccatcgtgtcccatggcatcgatacgaactgcgctgttttggttcatgctcttcatgtcttgggctctcgtgtagaatgtgtacccattgatctcatatccctggaatgtcgcgatcgacccagatggtcccctcgccaggaaggccagttgttggttgatcgtctcgttacccatgagatgttgtcgtagccacgcggggaaagtatcaatgtgatgccgtgtaatccatgcatcggacttaccgatgtttctagcgtgaactagagccaagtgctcctcgatgtaaggagctaccaatgaagattgttgcagaaccgtgaaatgggctttacggaataaattgttgtctaccgtcattattgctttccttccgagagttccctttccccgtagtctcccttcatggcgtgattcaggtaccctgattgggcgaaggttttcaataaattttacgcaaaattcgatgacctcctctgttccataccccttggcgatgcttgcctctggacgagcacggttacgaacatacttcttcagaacacgccatgtacctctcgaaagaaaacatgttgtgtaggtacacatgcccgagaatactgttctctttgacaaggtgacaaagcatatgcttcattatattgaaaaatgaaggtggaaatatcaactcaaaactgacaagacattgcaccacatcattctgaagggcttctaatctatccgggtcgataaccttctgcaaaattgcgttcatgaaagcacatagctttgttattgttgcccggacattgtctggaaggataccccttattacaactggtagcagttgtgtcatcaacacgtgacagtcatgagactttaggtttatgaacttcttctccttcgtgcttattattcggttgatattcgtggagtatccagacagtacctttatgctctccaagcattcaaacatactttccttctctgccttgctaagagtgtagctggctggactcaagtaatggcttcctttctcctttggttccgggtgaaggtcgccgagttgttccatatgctttagatcattacatgcttccaatgtatctttcaactttccatatacacctaggaagccaagaaggtttacgcaaaggttcttagtgaggtgcatcacgtcaattgcgtggcagacgtccaagaattcccaatagggtaactcccaaaatatagagttctttttccacatcgctgcgtgaccaccttcgctctctataggctggcttccaggcccctttcagaacactactttaaggtctttaaccatagcaaacactgttttcccgctgcgatatttaggcttcgtacggtggtccgccttatgttcaaagtgcttgcctttcttccgtaccgggtggtttgcagcaaggaatcgacgatgacccatgtacacaaccttcctacagtgcttacgatacgtactttctgtttcatccatacagtgagtgcaagccttgtaccccttgttggactgaccggaaaggttgctaagtgcaggccaatcgttaatggttacgaacagcagcgctcgtaggttaaactcctcctgtttgttctcgtcccacacggggacaccttcctttttccataacagtttaagatcttcgaccagtggtcctaggtacacatcgatgtcgttaccaagttgcttggggccttgaataataattggtatcattatgtacttcctcttcatacatagccaggagggaggttgtagatacacatcgtaacgggccaagtgtgtcacgaccggaaataacccaacgggcgttccttacgtgcgtgtattattccttgtcctaggaggcaaggtacaccaaaagttgatacaattcagagtttaacaagcggaagcgtaaataattaatttattacatgggcggcgaaggcccagcacacaagaagacaaacgaaaaacagcggaagactagggcgacgaccataggcgcttgacggcaggcacgagctagacaccaaagccttcatcatccaggaactcctcttctgggtttgggaaaaattgagcaagactgagtacaaccaccatactcaacaagacacacccacaagtgcagaataaatgcaagggagtacaagggggttataatatgaggggttagggtttgcagtaaacagcattaaaagacacttagttgctcaaagcttattttgtaaatacgatcctagagctatacaagattattaatcaaggccatgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctaggcttgcccataaccgagggcgcggctattcgaataggttatactctgatcagaggtgtacatctttacccacaagacacatcttcctcacgtgtaaccacatgccacataccaccacggtatacggacggaagatgtgacatagtttccaacccatcctagccatagacaagagtaccgacccaaccccacctacggccggaacctccgggacaggtaggcaggactgagcccctagcagcaggacaccagccctgtgccatgacatctcgactaccaggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaagcccgaagaccggtccttatatggccgaggcgctactatcaaaaccatgcaccccgagcccagcctaaaaccattttgaggattttgaatagagggggaggtgtgaatccaattccacaataatccaaccattccatagtgtccaggtgatatgaatactcccaaagtctagagttgtaaaaccacctaatgttgcctaattaaccagcgaagcatctacctaaattcatactagtggtaccacgcatagggtacccactagttggaggttttgtttagtctagggtgaacaaggtaataataataatagcaataataataaggtcataacaaaggtaaataggcatggctaaataaaacagtgataacgcgggaatttaaataaagcgataatgcattaatttaaatcaaaataattttataaactgggattcaatatgttcaaggatgatgtgacttgccttgctcgctttcccaaacgtcggcttcaacctccacgaagagcggatcttccgaagctgcagcgtctacacgaccaatggaaaataaaaaggcttttactctaataaacttcatataacaagtaggaacaaagcacaaaaatgggttcttgacttcttaaggaaaaattagagacttgaacggtccaattccgagttcaaatggccaagttatggccatttgaggtttatatgctctttaaatgaatatttacgaatttcttcatttaaattttaatttaaaaatggattattgcgtcagccgagggggaggggggcgcggaccgggtccacgggagtggggcccacgtggcagcctcacggtccacggtggaccgggcgcacccgggctcgcaccggccggcgccgtgggccccacgcgtcagccgcacccgagggcgcgggcggctgacggccgggccccacgcggcagccgctcggcgcgcccgaaggcggccacgtcggcgtggccggcgggaggcggcgcgcctgcgcccctatggtcgccggcggcagccataggcgcggcggagcggcgtccgagagaggggagggaaagggggaaacgaggcggcggtccacggctcactctaggtcgacggcgacgacgaaaaaggcgaccggagcggaggaaggcagcggcgcggctcgggcggacggggacggcggcgctctggcggtcggcgagctcgacaagggggtggacggtgacggcggcggtgcggcgaagccggagaaggcgacgctgggcgggaaacggtcccggcgagcggagagagccggccgaaggtcgtcggcgacggaggagagagagggcgacggcgcgagctcgattccggcgaggagaaggtgcggcaaaagggtggaaacgggcgaaggaggtgcggggagggtttaaatggggttggaagggggagagggcggccggggaaggaaggaaaccggccgggaggtccgaccgccatcaatggcgccggcgagatttgcgggagcaaatccagccgtttgaatgcgagagagagagagaggggaaaatggggggaaacggggaggggatcacggggagtaattcccccctattgatttcacgcggggacgacgggaggcggcgggattcacggcggcggcggcgctaggcgcgggcgaggcggcgggagcggcgggaggaaggagatgacgggtgggccccacccgtcagcgagggtggcgggcgggcccacccgtcagcggcgcgcgcgtggggagaggccggatgggccgcggggagagaagggagagggggagggaaatgggccgagccgacccaagagagggaagggggatttttagggtttttctttttataaaacatttttaactttgtttatttcttaacaattattatttgtgctctgaaaattccactaaaatttatttacacattttaggcttttaggaaatatacaaaaaatcctccaagcctttattgacttttaactttgcacattttaatttttaaaggctttcacaaggattttaattattctaggcataatttagaggatgtattttagggttgttttggggcgcgacaaagtgctatggctgctgctcatctctccaaaaggattcatgccatccgtacttaaaccaaaccgtatgtttcatgcgtccttttcaaagtctttaaattttttgccgatgtttcgccactgcgaaccatcggcggggtgtctcagcatcccgtcctgttgacgctcttcagcgtgccatcgcatcgttctagcattccccttattcctgaacaaatgccttagccgtggtattatagggaaataccacatcaccttatcaggaattctcttctttgttagctgcccgtcaacttctcctggatcgtctcgtctaatcttgtatcgtagtgctttgcaaacagggcatgcttctaggttctcgtactcctcaccgcgatataggatacaatcattcggacatgcatggatcttctaaacttccagtcctagagggcagactatcttcttagcctcgtacgttgtctcaggcaatttgtttccctccggaagaatgttcttgacgagtttcaataaatcaccaaatgccttgtcactaacaccattttttgccttccattgcaagaactccagagtggtatccaactttttgtgcccctgctcgcaacctgggtacaacgacgttctgtagtcctctaacatcttgtccaatttatgggcccccttttcactttcgcagtcctccttggcgtcctgcaacatctgaccaagatcatccgcaacgtcgttaccatcagcatccctttcctcctcgcccatttgatttccttcaaatccagcgtcctgactaaagtccggaatattatcgtcttccacttcatcttcttccatttcaaccccttcctctccgtgggatgtccaacagttatagcttggcatgaaccccgactcaaacaaatggaaatgaatagtcctggatgcagaatactccttctgattcttacacttattgcatggacaacaaataaaacccttatgcctgttagcttcggccactctcaaaaaataatgcacgccgtcaataaactctttggaccgccggtcagcgtacatccattgccgatccatctacatgaaaagaaaaaaaatcatacataaataattattcgtacaataatgacagtcatacaataattataaaataattacaaactctttcaacagtcatacaataatgacatatcattattcatacaaaaattataaaatattacaccaaataattcttatttactatttctaaagttttaaactaatattaatgtgttgtacttcttttaattttcattttagtttgttttctattatttaagattaactttcactatattttccttctcaactattttataaaaccttctttagcaaataaactaaatttctatatattctttcttcccccacacaaattttctctctcatcaacttacaactaaattttggagacaaaaaagtgtgcaaaacatagctccaaatgtaatatgacaaaaaaaaacattggaggatgaagttactaaccttttaggcacctccgatttgtatataatcaccaaaataaattcactagaaattttggcatgacctcccctcttttttgaagaaattttgaagcttgctcgggcagctggagcaggaagaagacatatatataggggtgggactttagtcccggttggtgttatgaaccggggctaaagatccccgtgatctttagtcccggttggtaacactaaccgggactaaagttacgatctttagtcccggttggtaatccgggggaggcctggcaggccctgacagcatttgaaccgagactaaagatcatctttagtccgggactaaaaattaaatatgtccgttaccctttttaaccgggactaaaatcatctttagccccggtttttattgcaaccgaaactattgtggaattcggccgaccgacgaaagatggtttctccaccagtgtagaacagcctcctgtatccatgcaccatctagaccatcagtacactgaatagaaaaaagttaaaaattagttaaaaaagacaaatctagacaggaaatccggtcccgttcacagggtccagatgaaatgaaaggtatggacttacaatttggcagaagatggagtgattaataaaaacacacacacacaattttgcaacggacgaagagaagacatgtcatgatctgacggtatctcgatgtagtaagaaaagatcagagcagccaggcagaaggaagaattcttagaatgaattaaccacatgagcttgcattttttagataaaggattatcaaacccggcctctacacctttgtggggtatacacagccaaaatccgaacacgagtacataagactctccctaataaaagggtacaaaatgcatcaactgacctctcccattacataagagatgacagcacaaacaaaggttttaagaacaacaaacgaagaaaagactaggcttccaatcttcttctaaggttccagccatacacggagaagaattccaccacatgcttctccaacactttgcaatagttcttaactatttcttcatcggttcccttaagaagcaaagaccaagtccttgcccaatgtgttcccatgaaaatgatctgcaagaaagatgtaggattggagccattaaagaccacatcattcctatataatcaaattgcccaaagaaatacagctatgcccacacacaatattctcttgagcctaggttcaacacaattcagccaattcccaaacatttgagacatgctacacggttgcctaatcccaaatgtaaaaaggagcgcactccaaatatatctagccattgagcaatcaaagaaaaggtgttgtattgtttccttagagttacaaaaacagcaacttaggctacccttccaccttctctttgctagattatccttagtgagaattaccccttccttgaggtaccacaataaaattttgattttaagtggaattttgagcttccaaatgaaattcttcctaggaaccagcccttcatacatgaggaacttgtacatagattttactgtgaaaatgccttctttattgtttttccaaaagaagcgatctttctgatctgtcaatacagtgttaacaactttcgacactagctcataccaggcttccaagtttcttcccactattgatcttctgaaagacagatttaacggtattccactcattaccttggccaccaccttatttttatttctaactagattgtagaggttaggatactccttctcaaaggattgaactcctatccaacaatcctcccaaaatcttacttgtgagccatcttgtaataagaaggaaccgaacctttgaaaagactctttggctaatatgagactagcccaaaaatgtaagtcccctggtcttttttggacttgcaaaatggttttctttgtcaaatattttttcctaagcaaaatttggtcttgcatagaccagatataatataaatatggctgtatgagaaaacatcaaacaccacttcccatatttcctaattcctgtcattaacaaacgaatcacattacaacataacatgtataatttctaggtacatcaataatattagtaatataatcatctaaaaatattgatacaatgcaagcagtagaaatctgaagtgccgaatcagcgtggaaataattttgttgaataaccatccttgatttttatttgtgacgaacaaccaccttactgtattatagctctcttcctagtactatttcaattagtgtatatgaaaaaaaaaacaaatattcaattagtattcatacattgacagtagatcatgcccacattgttgtttgtgatgacattcttccttttgaagagaactgctcagtcaatgtacaggatgcaagtaaataattaaggagttagttaatgtcagcgttgattaaaaaaagatgtgaaggtgaacttttatcaatcatggaaaaaattgacctataaacagtggcaaaattatgaatagtgtatctggcatgtactaacatttagttttgtatggggcctatgggctagtagattaaatgagaagagtgcaaataccgtgttgtggcatgtacagaagtgaccatgatccctagccttcacacattacaataaccatccttcacatatgcgctgcaaactcaattcgtcaaacaaatacacgctgctaacatactgcatctggcaggcggtgttgttttccatcacctcgttgtcttcccctgttaaaaaaccctgacaaattaggaagaaaaaacaaaatagatgatggactgatagtctgatacagggagatcagactcatagtccctcataaatcaggaatcacaattttagatcatggactaagacgtacaggcagatcaggcttataggccaagtttgtagagctcatcgataaggtcgtgctggcgttgacattgaagtcagccaggctattgcaactgcaagccctcgacaacatcaccgatcctgtcctgtgaccgagatcctctccatcggcagcggccgaggctgcgtgtcagcctatgcagccaacccgatgggtgatggccggcgtacctcgttaaaaccttctgatcctgcagcaggaggttgagtgtaacgccccgattttcgttggggattaaaaatcaattagtaatgcattttctaggaattatattaaaatttaaagtaatttaatcaagggaaattataaaggaaattaaaattttctttaaaaatcattggccggaaatattttgaaatattctctgtgcctaaatatactctccggatttttctgtaaattttctaagaaataattttaatagcacaaagttcatttaaccaattaaataaaaagaaaaacaattaaaatccccctctttcctttcgggcctcctttcggcccaagttctcccttcttttgggccggcccagctcctccccctccctctcccgcaagtcctctttgcatccctccatcggcctcctcccccttctctcgccgacaagtgggaccgcgggcccactcgtcagcttctccccttacctccatccggccggctgcaaccgccatggctgccggtttcgccccacgatgccgcgcttcccgcgctccacctcacctcgcgagcacgtggactcgatccccacctcctcctcccccatttcccccactcctccccgcaaaatcagcgccgaaccgccgccaaccttcccacgtcggcgccccacatcgccggtcggttcccgcctttctcggtcccgatttccacctcccggacctataaaaagcatccccggggccccctctcccattttccccaaatccccgggctcgccgcgccccctatcgctctccccacgccgagccatgcgcagccgcccgccggagctctctagccgcacctcgccgccgccctagtcaccgtcgcgccacgccacttgcgccgtcggcaacgccgtgccaagctctacctcggcatcccctccgtttccccaaaataccacctaaagcacctctccaccgtgctccctctctccaccgcctcccatcgcattcagccgtgcaccatcgtcgctcccgtccaccccgcactgcgccgtcgcttttcccgccaccgcagccatcgtgagcaccccgtccaccgctccatttccccaatccactgccgaaaccctaccgccaccacatacaaataaatcataatattaaacatataactatataagctaacattatcacctcacataaatattgcctagatatgtatacgacaatactagacatgaatatatcaaatatacgaaacatagttaaaacataccgacgattttgttctagacgaggcgcggcactcactgcccatacgacgtgcggtacaaaatattgatgacaacacacatcgatggaacataggaaaatgagccacagtggatgaacaatgagcagtcgtgcggagcacttccaaatcttatccgccctctctggctaggtgcaggatgttaaaggcaactgttgcatatagctgctctcccggatgcccgtgcatggtggcgggcgtgatggagtaaacaatgagcaatggggcaatacaaaagagaaggcaattgttttcatgtaagttgcatatagacggcggtttggtatttatagagatactgcaacgtgtgatcaagaggcttgtatgatatccacgccacgcagcagaccatgcagtgagtttaacaaacaaacatcggataattcgttaaatacaataaagcagagctatagaaaaaagcggcgtatgcgcgaccatttggagccccatgcctgagcccggcctgacgaggggtacgagcatgcacatttctctaattcttaccacattgttcaagtgactagacgtctactatactagaactaataaggtggtactataaattataaataataagatggcactataaatattttctatcaggtaggcttttaagatatttctacagattattctttctgtagactatctaataatctactaatttaggtcttccagcagggaagacattatgtttgttttccttcaataccagcatagaatggctccagcatagaatggctccttccataggatcttcgaaagaaatttaagcatcaatattttgttttaattgtaccctaaagatctagatcctctagaaatccttcactttttcttttttttttccaaacgagccctaaagcataacattacctggggccattagaactatagaggtctctacagtattatttcaagtaataatataaaggcaaattttgttacatgacactgctattgtgttgttttagccgtaggacaccgcccgaacttacttttgggggaaagaaactaaataaaagtggtaatttgccaatgtacaccgcaccgattagaataataatttccgattgaagaggagagagaaatcgcgtgaaagttctaaaatgcccttgggcccacatgtcatatctctctcccatccctctctatcccgtccatggcctacggttgcccacggccacacttccatggcgcgtgccgcgtgccgcgctgccacaccaccaccgctctctcatctctctctatctgtcggaaagctcgcggactcgcggtgtccgccgttgccatcgcggcgtcggcgtcgtcctctgccgccacgacgatttgacggcgctgcacacgctcagcctccacctcaatgcgctcactggtgcgctcctgggagaccttgcctccgccacggcgctctgcaacgtgttcctcaacgggaacaggctctccagcgagttcctgcagcgcgcgcgacagctgcgggttgaacagctccgccgcgcgcatcacgtgcggcgcgcaccccagcggccccgtccccatcaccagcacccgcctcgcccccatgtcgtacagcctcttccaatgccatgccatgccaacggacgaacacatcagagacgaattgatcgagaggaagaagacgaagtgtatacggaccttgttgtggcaaaaccctcacacacgcgatcacttggataaacacaggaaaaacaaaagtgtagacgcgcgtgaaagcaaaacgaacagagatgaacacaagaacacaggtttttggtgccgcgcaacgtcttgcagcttttctggtttttttatctcatttattctccaacgattacatgcataacaaactaacagcttcacctattcagccgctatgaccacttcctccgcgccatcccacgaagtgctgatcaacgctgcattcttggcgagtcacgcacacacgcactctcggccatgacgcgaactctgcgcgcctctggctcatgcaacatgtaaaagagaaactaactcgtgacagaatccaatgacctgccacggatgcacaaacaaatgaataactaaccagctaaatgtgacaggcttagtctaacaaatcacccccctaagccttgtcaccttcacgttctcgacacccagcttccgccttaactccaggaatttgacacgcccaagtggcttggtgggtaaatcagctagctgaccatctgtgccaatgtgatcaatctgaaccttttcttcctcaacacactgacgaataaaatggaatttggtgtcaatatgtttgcttctgtcatgatgaacaggatttttcgtaagcgctatggccgacttgttgtccaccaacaacttgaacttcttcgctgcacctccaatcaagtcattaagcaagcgagatagccacagaccttgacacgcagctgacgcggctgcgatgtactcagcctcacacgatgagagcgccacgactttctgcttctgtgacgtccaagtaaccaagcttgctccaaggaagaaagctgcacctgacatgcttctccgatcatcgagatcactagcgatatcgctgtcactgtagcccatcaagccattatcagactggtcttgtttgcgatagcagcaaccaaatccaatagttccactcagatatcttaaaatatgcttcacggcagccatatgctgtgatgttggagcttccatatatctgctgactatgccaactgagtaagcaagatcaggcctagtatttaccaagtaacggagacttcccactatgcttctgtactcggttggattcacagctgcactgccatctttcttgctcaacttcagtcggttctccataggtgttgcacaagcattgcagccgatcatcccagacatctctaggatcttctttgcatagctactttgacacatggtgattattcctctagactgttgtacctcgatccccaagtaataactcaggagaccaagatcactcatactgaacaatttccccatttgagccttgaactcctcaatatcagtatctttggaccctgtaacgattaaatcatccacatatactccaactagcagtagatcatcaccagtctttcgcttgtacacaccatgctccatgggacatcgatcaaaaccaagtgacaccagggtggcgtccaacttggaatgctaggctcgcggtgcttgccgcagcccatacaatgccttgcgcagcctgagtactgcaccgccctgcttgtcgtcaataaatccgggaggctactgcacatagacttcttcctcaagatcaccattcaagaacgctgatttgacgtccatgtgatgaactgaccaaccgtcatgtgcagccaaagcaagtagcagccgcaccatctccaagcgtgccaccggagcaaacacttcatcaaagtccaccccctggcgctgcgcataccctttcgccactagtcgtgccttgtacttgacgatgttaccagcagggtctcgttttactttaaaaacccacttaagcccaatggctcgatgcccttctggaagccttgcaaactcccaggtttcatttccacggatggagctcatctcgtcctccattgcacgccgccaattgggttcggccagcgcacgttccacgctgtctggctcctcggcagccacgaggcaaaacccgctgaagtcgttgacgtccgacatcaccgtgtcatcgaccggcagcgtcgtctgttgaagattttccagcgaacggtaacggagtggcatcccttccgagtcacacgaacctcccatcggcggactgacaaactccacaccagtcgaggtggtcggcatggatggcgtggccggcggcggccgctccggtgtagccggcgactgctgccccggtgcgtcggacacctcttgggtgcctccgttggatcccaagctgtctcccatgtccctgggagtatacacaacagtgaacgtgccagaccagtcaggatcttgtctgccagtattggtttcccagttccacttcttctcctcctcaaacaccacatcacgtgacacatacaacttctttgcaaccggatcataaacccgatatgccttggcattgtcttcatagccgatgaacacgcctgggatggagcgatcggatagcttcgacaccccaggcccaacctttttcacaagagcagcacatccaaaagtacgcagataatgtaccttgggtttccgacgatacaacgcctcatagggcgtcatgccgtcgagagcgcgcgtgggcgcacggttcaggacgtgcaccgccgtcttgacagcctccgcccagaaatgtgccggcacgcccttgctcttcaacatgcttcgagccatctccaccaccgtcctattccgccgctcaaccaccccgttttgctggggtgtatacggcgccgtggtgtcccgacgaatgcccagctcgacacaatagctggtaaactcattggagttgaattctcctccacgatcagtgcggaaagctttgagcttcacgtcaagctcgttctcagctgctgccttgattttcttgaaacacttgaacgcttcatctttgctcctgagcatctcgacccacatgtaccgagaataatcatcaacgatcaaaagaaaatagcgtttaccagtagttgttgtcggcgtgattggtccacacaagtcgccgtgaactaattcgaaccctcgctccgcgcggaatgcagacgcgcgcgggaacggagccctgtggtgcttgccaagggagcacccctgacagaactgctcgacgtggttcaccagtggcatgccttcaaccatatgcttcagactcatatcacgcaatgagcggaaattgagatgtccaaaccgctcgtgccaccgccatgcttcatcatctgccttcgtcagcaggcacacaggcgtggccagtttcagggacagggtatacatcctgtttttgcgtggcacccacgcaagcagctgacgctctgcgtcgaacagcgttagtgcggcgttttcaaggacacctctgcatcctccttcctcaagctgcccgaggctgattatgttgctacgcaggcgagggatgtagtacacctccgtcagggcacggtgctcaccatttttgcactggaacgtgacggcgcccatgccctggatctcgaccacggagttgtcgccgaagcggacagtcccagtcaccttctcgtcaagcgatgcaaacatcgctcggttcccaatcatgtggttgctagcgccagtatcaaaataccagacatcatcaggcatctccttcggaatcacgcgttcctcgttgaggaacaccgtctggtgcacttcggtgaaaagcagcgccggctgttcattctcaacctgcaccaggtttgcctcctcccgccactcgcggcgaggcttgcgacattccttggaatagtgcccaagtttatcacaattgaagcactttaccttggacctatcccacgttctggtcgacgatgatccaccgccgcttttgttgtcgtggccgcggtcaccacgcccaccgctgcacggcttgtcatgacggcttttctcaccgccgccaccgctcttcgacccgctcgaggacccatcgtggtccttcagtttcatgcgggccaagcactcctcctcggtgagatagagacgatttccgcgtggcgcatcatcgtcgtcgtccacgttatcatccctttcggcggtcgacaacctcccgacaagctcctcgattggcattgtcttcagatcaaggaattgttcaagtgcgactgccacctgcttgtacctttttggaacaacacgtaggaattttttgatcatatgctcatcatcaagcacgccacccatgtcacggatgtccgtgaccaccgatgttagcctcaagctgaactcctccgcagtttctcctaccttgaagcgcattgcttcgtattgctgacggaacgcctgttccttcgcctcacgaacacgatcaacacccactcgcatgagtttgatggcatcccaagcggcctttgcggagtccttctttgctaacggtcgtagcatctcctttgagacagcttgcaaaatggctgctagtgcgacccgatcttccttgaactcagcatagcccggatcaactgctccccaaacaccttgtgccaggaggctgaccctcatcaacattgcccattcggcatagttggttctcgtcagcaccggatagcgcacggctacgctaggatccctcggtgctggttgttggacgatggggacttcagcaccatcagtgccagtgcctgaaccaccgccctgcttgctgccactgccgctgccgccgccgccgccggcgccacgccgccccggaggagtgtagcggccactgtcgctgtcggaagacatgttaaactcaggctctgataccacttgttgtggcaaaaccctcacacacgcgatcacttggataaacacaggaaaaacaaaagtgtagacgcgcgtgaaagcaaaacgaacagagatgaacacaagaacacaggtttttggtgccgcgcaacgtcttgcagcttttctggtttttttatctcatttattctccaacgattacatgcataacaaactaacagcttcacctattcagccgctatgaccacttcctccgcgccatcccacgaagtgctgatcaacgctgcattctcggcgagtcacacacacacgcactctcggccatgacgcgaactctgcgcgcctctggctcatgcaacatgtaaaagagaaactaactcgtgacagaatccaatgacctgccacggatgcacaaacaaatgaataactaaccagctaaatgtgacaggcttagtctaacagacctggaggattttcttgtactcggagatgaggaagcggacgtagtcggggagggcgaactgctgggagcgaagggagaaagggacgaggtagtagttggtcatgaagtcgttgccgccgagggtgatgagcacgagcacgccgttcacgatccgccgtgccctcgccgtgccgaccagcgcgcgtagcctctcctgtggtactccgcaaagaactgcagctgcctgctcatcctcacgatgttcacctgcaagaacaccgccatgaacgccatgaacgcatctcaccgaccgcgatcgatcagtgatcagtcagtggcactcacgaactggatgccggtgtcgttgaggatgccgacgctagcggaggcgaagttggcgccgacgaggagcttggcgccacgaaggtccgggctgaggtaagggagggtcggctcggcgccgaggtgctcgttgatgatgtccgggatgttgaggccattggagaacacctcctcgtggcgcggtggctctggtggtcggtgcccaagttcaagtccgcacagccaccaagcctgccgctctcgccgccaccagtgtcgccgtcgtcctacttcgccatcccactggggctcagccccaccgagctgctcgactcccccgtccttggtgaggcatggcgtcatcggtgaggcatcggctatggaagcgtgggaggggatagagagaagagagatgttagaaatatatgacatgtggactcaagggtattttagaactttcacgtgatttctgtctactcttcaaccaggaattattattctaatcggcgcggtgtccattgataaattaccacgtttatggagtgtcttctcccaaaagtatattcgggcggtgtcctacggctaaaaccacacaatagcagtgtgctgtcgcaaaatttgtctaatataaaatccctccttcgacgttttggtcattttaataataaaagtagtgtctattccctctattctaaggcgcctataatattaggaaaaaaagcaacatttgcatcatttttataataattaaactaactaactaactaactatatatatatatatatatatatatatatatatatatatatatatatatatctagtggcatgcatatgatatcatcgtattcgcattcgaaagcacattcgtatggtgttaattttgcagttgttgataatgtattacttcctctatcctaaaatgtagatattttttaggttgacacggatattaaaaaagtatgtgagaatgattggaggaagtgtattattgattaatgtgtcatgggtaggtgaaggagaatggttgtgattggttgagaggaggaggtaggtgaaaaaatagttttattttgggataaggtattgtgctagaaatacgctatattttaagacggaggtaatagggaaaattttgggactatctaaaaatattatagcaagttatttaattgaaaactttcaaacatatactctctatatatatagtatatttaaggagctcgacagtgtcattcctaatcaagcaaatacaagatccaatctcctcatctcctcctgacgttgttccttgtcgtgaactcgtgatcaccacggacgcttggtgtccaagccacccaaaccatgcccagctatctcacccatcaaaaggcctggacgaaaagctcgtggcttgttagctcgcttgactcgcgccaagctcagctcggctcgtttcatttttctaacgagccgagctggccttttaactcgttagagataacgagccagctcgaactggctcgcgagctgctcgcgagccttaatgagctgaggtagctagcccatgctgttgtggacttgtggcccatatgtgcttgaagggccatatatgcatcaaaaccctagctctactcctcatccccaatcccacacgagtcgccgccagccctcaacaccggtcgctcgcgcggctctcccccaggccccagcgcccgacgccgccgcccgcgccgctcttctcaagatggccatattggcggttttgcacggggaagagcggctccatccttatcaattgccctctccctctccatacaatagcatggataaatttaagtgcattttggttgacgtactgacgtgtttttatctatttgtccctcaacagtgagcaatgtgttgtaggaatgcaacatgacgtattgttttttccttttattataaccttccaagctattataatcatttttctactactcccctatcccaaaatataagacataaccattatttttttaatgtttatactaaaatataagacaactatttttcttatgtttcataataaaaaaaacacgcatgtatgcatgcaatgcaattaagtagcacacccgtctcccttaaattttgtttgtttaatcctcaactgtaatatctctagtatcattggctgctttcattgtatttattgaggtaatctagataataattttttcttgtttttttttacatttgtggagtaatttatttctgttattaatatggaacctcgcatcacgcggttcgttaaaaaaaaaaaggaaaggcgaccgaagacaaggactcgtgcgaagtgaaaagtgctcacctcactgctcaacggtccaatcccaccgttcctttgggggttcaccggcgggcggcggcgacctgcgtcgtgcgtcagtatgtgtcgcgggcctctgccttgctattcgccactccggtgaactccgcgcccctcccgtctgctccggcctcttccgtagcgcgccggccgccgcccccactccttcggatccggatggcattgcagccatttaccgacgacctcctcgccgagatccttctccgcctcccgtcggcggcctccctccaacgcgccgcgctagcctccaagtgctggctcgccgtcgcctccggccccgacttcctccggcgattccgcgcccgccacacctagtcgcctctcctcggcctgttcgtctcccacgggagctccggcctccccgtgttccaccccgccgcgaccgtccgctccgaccccgacctcggcgccgcggtactcgggggcgacttctcgctcatccgcgtcggggacggcgaggatccccgctggcaactccgggactgccgcaacggccgcctgctcctctgcggaggtagatccgtcgccgtctacgacccggtgtcccgccggcgcgtctccatccgccgcccacaggacgaccccttctcggacgcctacattgccgactgcttgctgcacgggcgcggcgacaacggcgcggcgtcgttccgcgtggtgtccgtgcagcgccatggccggaggatgcgcgccgcggagtacaactccggtactcgagagtggagcttccacccgtgggtggaaaacatgaggcggcctcgccggggccaggcgatgcatgcggcggggattatcttctggaaatgcgaggacaattttgtgatattgcttgacacgctcacgatggaattctccatgctcagtctccctgtaagcttgttccagccttccaagtacgccataggggagatggaggatggcgtgtgctgccttgtatgccttgatggcaccatggacaacgtccacatgcaagtgtggctgctcatggaggaggacggtggtggcaggaggtgggaattggagaaggaaatgccggttagtgaagtgcttgacaggcattccctggtgcgacaagtccgaacagtggctagtggattggttcttgtttcctgggatgaccgctatcctcaatttgccattgacctgaagaatatgaaggtcatggctgagtttaggtgcagcggcgagacttatcttttccaaacgccatggccacccgctttgttggtcgatagcggtaagtctttcacacatcacttaggtacttccaaatatatgagtggattgcttctttagactacgagttggaacttactgtggataacttgctatgagaagtgagttgatcttaattgattgctagtgtagttttggtcactgtgttggtagagggcgagcattccaatcacttcaacagcaacttttggatttaattcttaaagaattaaactgaattataactctttggtttcatgcttcctgaactgaactgacagaactacaaattggctaattttatctgtttaatccgaactattagttatgaagaacatgtacatgttttttgtaaagtcatgtttagactttagatggagacctgccaatggccgcatttcatggtaggcatactgggttcaattaggcatctattgttttggaaagtaatttagatgtctcataaaaatgctacccacacagctgtttagacatctcataagatttatgtggtcattttttagtggctaacaaaaagtaggcatcacactaacgaaaaattgacgttattgttttgttgcatttcagttggtttggcctaagtcaaggtcaaggttgattcattttcatcattttgctaaacaaaaaatatccactcgatgctgatccaatgcaccttaaaccacagtgaccttttcttgaggtgtcagacaagatgcagcttgcttgaatgtcctcctcccttgttcttatatactacctccgtcccatataaattgcaattctagtttgtttagtactccctccgtactcataaaggaagttgtttaggacaatgtttaagtcaaaccttgggaatataaatcatgaataactctcaagttgttgagtttgaaaatgtaaaaattatatgaatagatttgtcttgaaaaatacttttataaaagtatacatatatcacttttcaataaatatttttatagaaacaagaaatcaaagttgtgttttggagaccgtgtcgctgtcctaaatgacttcctttacgagtacggagggagtatatattaaggtttgagaagaaatactatgatgccccttattaaatggtgtataggtaagagtggaagggtagtggagggtaaaatagaaaaagattaaatgagaagtgattaatgagacctattagtactctattgtgacaattattttgggacaaattcaaatcctagaaatacaattattatgggacagatgtagtagttttcagcaatgttcttgtgattcccatggtgttaaagcactagagaaacttattacatggtagtaatgttagtgccaagttcagtacggtatacagtggcagtaggaggggaaggctggatgtatgactgagagtcaagtagttaagaatggaatagtatgctgttttcctgtattatattgatgctcaaccgtacaaaaatcattgtttagcttatttgtataccctacagaggttcaaccagcggatttggctattcctttacaatctgcagacctcaacaaaaatttctattcctgcccaagagcagaatatgtggagccgcttcagatgatcgctactcagaacatgatgaaacatgttaatcttgctgcagagagaactgatgttgtgaattcagaggtaaagatcagcttcagagtttcctttgtgaaatttgtgttgttctgataatctgtaactagtaactacatatgcatgcagggcccattggatttggtattggaaccacatggcccactggacgcacaacaagctatggctgctgaagcggagaccttggtggtaacagcagacctgaaattagtcaggtctactgaagcacaaaaccagtcagtagctgaaaaacctgaggtatttagcaattgctgcctgatttgtttctctgtcaaaattgttactcaaagcattacaactctgcatattttcacaatgatcgaatcagatcatgaaggggcctgaagtcccagtttcgaaaaggagcatgtcacgtttggaaaaaagaagaggggaaagatatgagagtgctctccacaaggcaatggagaggaaagctcgttacatgggtggtgtggaacagcttagtacttctcttggaagaaactacagaagatcagagaagccaattgttgtggactctagttacgagagatactaccagtgtcgtcaacgtcgagagaagccaattgttgtggactctcgttacggtaaatactaccagcgtcgtcaacgacgaccagccgcaggagttcagggaaggtgaggcagggcgcagctaaacaagtttggagggaagtagggttgaaggagatttgtattcagtggtaggaagtttatttgtattcagaaattactaaccattaacaccattcattcgcctgagcactggtatatgctttcgataactcataacagatacatttttgtaattcatatttacttgaaatttgttttttttaaacacaaatgactttattaagcaagaacagagttaagggataaaccccagtacacaaccaaagatagaaattgaaagcaaaagtgacaaccctgaaaagagagggtgaaccgaactatggaagcagccttccagatgaaaccgaacagcagaaaaaggagcaagccgacagggagctgcagtgagccatgactactgcaaagccacgacgtcttaaaattgtgtcgactgctgccatgggcctcatgagaagtgcacaccgcttgacaaaccgttaatccccttcagttacctccacgggaatggcaccagattgaggttgattgctgagccgaagatattggtgtaagcatcaccggactcaacaaagaatccccacgaggtttgtcattgaatctgaggaactttaacaacagccctgtcaatcgaaattgcgcagaaggtccgagctcaacccgaatgacaaaccaatcgtggtttctgctgctagggaacagtagagagggccaaatcgtaatttgttagacagtctaggagagtatgagtatcattttgttgaaccatgtcatgaacgcaaatcatgaatagcctgagaaaaagaaccttatcacggtttctactcggcgggtaatttgcaatcaaaaattatggattaaaaatgaaggacaacaagataccaccagtgattgtaatcgggtttccttaaaaaaatgattgtaatcgaattaagcaaagcaacaagtagctatgggcccagagcaatgtagcaactagcaaccatctcacaaatggcaatgtgttttcaggaaacaactaaacattatctaactcatccatgcctcttgcaaaatacatgtttgatggatccattggtttagggatctctaataattttagaacgttttcttagggtacttaaggaaccatagcactagagatggctcccctttacatcttcctagatgcaccatcgagcgtcaaaaataggagccttcaaataactgtttttctaggtaaaatgtttttcgtagggcaaacaaaaatcacttctcagactcaatggtgagcgaactcttttgttggattgatagtccgttccaatgagaacttttccgctagcgtcatcgtagcttcgaagtgcctgatagtttttggtgctcgaagcaagcaaaagggagtacaaagtagcttgaagcctgcattcattgtcacatgctgattttctttccgaactatgttacacccaatcctataccatgccagattaagaaagccactagtagccaattctttccaagacatgatctcttaatgatttttactactaattgaagggaccgtctgttggtcgccagaaaaaaattgaatccgtcagtcaatttgtgtgagcattcgatctgcatccaacgggcgtgtgacaaagaaacaaagggagttagtgggcccgtagcactccttttgcggtcccattttggggtctgattttttattctccgtattgggcttttgtctttttctaggcaatgtgcaatgggcctgtatgatgttttattagtggaaaaaaaaatcaactttaactcccttaaagtaggctgaatctaactcgtatcccttaaccagaaaaccgggtagaacgaccctgagaaactggtataatttgactccttcgatggttttggagggcggtttcgctgacgtggcgctttaacccgatccaactggttgactctgtatgtgggacccacatgtcagtgtcacattttcttctcccttttttttttctctttttctcctctttctagcccggcagtgtgaggcggccggcaagtcggcagcggggctgtcgctgacggcatggcgttcaagcacgatgttctacgcagtaacagtgatgcaggggtggtcgcgacgagcccaccaccaccgagtccaccgccgaagcacgtctccggcctagagtagcatggctatggccgctgccgtcatggagcttgacatcgaggcacccatggcgtctaagagcatggtgcaagaggcgggaggacggaggcaccagcgcgtggagttgggtggtctcctcgagttcgaactcgtcctcatgtccccgttgtcaccgagctggtgaagaggagagcatgccaccaccgccctccctcgaggcccaccgccggagctacgatagtgctgttgcatgccattgtcagcgagt

SEQ ID NO: 74519 - DNA, 88371 bp, Oryza sativa
taatgcatctttaattaaaatgaagggtgggctgtgtcaagtgtcaacaataggatgaacaggcatatcggaaagaaaaaaaaattaaaaagtcattaaggccctatttgattcagcttaggattattataaactggattattaggagtaaactgaaacaaacaagtagataattatgatttataagccagattagtataatctaataatctcctctggaggagcattttccaaattattggtggctaaagacccactacccttagatgcctccaataatctagagaaacaaatagctcacagcttattctatgtcagcttattataatccagcttatagtaatctgatttaataatatagattacaataatcttaagttaaaacaaacagggcctaaataagatgcttaccagctctgctgacgtccgcaatactgcagccaatgcggatctctcactaactaactcccggatcttcctaaaagatgcaactacagacattggcactggaaaacagaagacatgtcaatgccatcagaaaatatgagccaacaaatatcatgtgtaggaaagcatgtgctaaattcatgtacaccacttaatgatatgatgcaactcaaaagtatcaactgttgtttggtgaacagtagttatatcaagcaagtatatgcagattccaatagtggtacaacaaaaggtgcaaatatattagaatgcttcaacataatattcgcccatttctaaatgtgccagtagtctttttacagcagaacattgtcaaacatcaatgctggtgcaacagtcatgcataactgcagtaatatcaatgtgcatcaattcatacggaagaatgcattcccaggttaaagatatctatatcagtagaatacaattaaaaatagcctaattagcaatacgtagtgcagtagttcacaggaattttatcatcatatattgcatgacaaatttgaaattatcgctggcaccaaacatttaaagaaaaatatagacatgaaggtggacagcgatttttgtcgtaggtttgttaaggtataagtgagaataaccctaaaacattatggtggttctcatttcaaaaggaaaataggaaggtggaaagcacaatcaggcggtctatttgaaattgaacagttgactcaccaaatccctctggatctctaatcatgaatttcatcaaatgttctgttgtagccagattgacatcactgaagtaaaattccacctgtcaaggttttaaaatacaatcaaaccaagggtgtaccacttatataggtgcaaatcaagcatcccataacagcttgattgcactaataaacaacaaaaaaaggaattaatataagacgaagttaatatcatactttcaatgatcagagaaaaggtaaactaataagaaagtaaaaagatgcagaaggtaaacaatacaaaagaagagaattgatttctctctccatttctccccttcagaaagatgcaaagagaaacaatcataaaatagatggagagctgcactatttctatttcctaagttattatcctcaaaaaagaaaacagtataactcctcatggtactatgcatgcagcaattacgagcttcagcaagacgacatgatatggttttgtcgtttttacaccgtgtcgctaataaatcatactgaggcccatcatgtttgccaaacatcacaaacatgcatatcttgttattccatatttgctcgttggcaggcatgagacatgtcactcgacccaaaccccacacacacgtaaatgcagcagaccgcgccatgtggaaagacaacatgcacccttcccgccatccccaccctatctgatttgtatagactataaaccctatagtgttctccaagaaaagaagtgcagaattacagtgcattttctaaaaatagcaatctctaacagacattccctgttttactcgtcctagattccaccttagccccttactagtgcacacaggacaatcaaggtgccagtgatctgtgaagtaatattttttatcctcatagtttcagaaatacaagaataagcaaaataataggcaataaacagttttaaggaacaaatatctatagacatcatccctctagtgcatacatctgtaactaaagatcaaacttgcagacaaatcaacagaagtgtaaagtcacactaattccatcgtttcacttgcaatcactgggttaagctacacttcctacatgcctatttctactccatagacgacccaatctaacccttgcgttgatcaaaagatcaagctttatcggttgaaacttgagattccacaccaaaccaatcctcataatcagcaccaaacagcatggcaaaaggcagtaaacacatcatccatcaggtgggtgggggggagcgctacctgcttgacgacccgacgagccacatcctccgggatccctccttctcccaccgccccggccgccgcggcgtccccctcatcctccccgtagtgttgccagtgctggtggtgctggtggtggtggtgcggctggtagtgctgctggtggtggtggtaggccccacccccgcccccgcggtgctggcggcgagggttggcgtggtggtggtggtggtgggcgccggatcgaggggtgaactccggggcggcggcgttgaggcgggcggcggagggggcgggggcggaggcggatgaggcggatgaggaggaggtggtggagtccggggcgtcgtcctgcgccatggatggatggagagagagaggagcggccgcgagcgaagcgtgagaggagagagagagagagagaagaagggtttgcttggggggactctggagagaagaggagaagacggcaaaagggaagagagacaagaggagacgagtcgggtggtgacgtgtactctacccggagagcgagttgggcttcggcccaaaagcccaacatatcccagcctgttactgctgtaccagtactccccccccccctcacggtggtgtttgaatctcctatatatgaagataaaaattaaatgtttcacgccaagtgaggtaataataacgtgtaactaattgagttttaatgattacaaacttaaaaaatagattaatctgatattttacaacaattttcatatagaaagttttcgcacgaaacacaccgtttagcagtttgaaaaacgtgccacaagtatctaaattttcatccacgagtatctctatctcttctctactctctactgttaacaaattgaagatgtttttgccggtattttgatatgtcatctgtgtatgagttggttctaagttcgttcgcttttagaaatatacaatatacgtatttgagtcggtttttaagtttgttttagaaatgcatatccgtataagaaatctttttacaaaaactcgcatgctaacttgagatgaacaaactcctaactacagctcatgattttctaaaagtatatatatccaagtgaattctcacagtaaatttcaccttaactaaatcatataacaacagccttcactcgttgcaacgcacgatcattttttctagcaagctaatagtaatcggttgggggccatcacatcctaaaacacgtcagggagaacaaggattcctaacacccccggttgtgtctgttccccgcaatgtaccgatgtatggatgtagtttctctgaatgactcgtatacttcagacttcagagacgcaaccagtcacttggtcacacattgctgtgacctggtatgatgttttttttttctaaatatttcaatcctgcagaaagagacaataagaaaccttgtgaagttttggtatattgcagcaagcaatgcccttgctcatttcagtggctaattgtgaatgatttctctcagaatttttcactcttcttttgttgccagtattttcagtcccttgcaacaaagactgaccgccacagaaaaagttcagaacataaacttcacttgtttttatcagagggaacaacaacattctcaagagaacactaccaaaaaaaaatgaattcagaaaattcagacattctcttctcagcagaaggcacgatgtacaattacaaaaaggatagtggagcagcgtagagaactaattatccaagtcgccgatccttgaaggtgattgcgcagcggagagcgatcgaggagaacctagggccttgggggttcggagttttcttctccgacccctcccacaaacaaaaacaaactgttgaatcaaaacatatgtccaagatccaacatttctcgatccttctttattgccggcactcgaccgacctcaccgccgttgtcctctacgacgtacggcgacatggccatgatcagctgctgaaattctaaagtactccctccgtacttaaaaatcgaatctaagactggatgtgatatattctagtacaacgactctggacaaatatatgttgagaggaaggaatcttttacaacctgcatttaaatcccttgcactaagggcctgtttagatctcattctaaaattttacaccatgtcacatcgaacgtttgaacacatgtataaagtattaaatacatgctaaaaaaataactagtttcacatattgcgactacttcgcgagatgaatcttttaagtctaattgctccatgatttaacaatgtggtgctacaataaatatgtgttaatgacagactaattagacaataaattcgtctcacggtttactgacggatattgtaattagtttttttgttagtgcccgaacaccccatacgacactctatataatatccgatgtgacagaccaaaactttgcactcctgaatctaaacacccctaagaggaaagccctgaactgaagtttttatttgcctgctttcagtttctctcaacgaagaagcaaactggtgttgggatcatattcatagggaatgaaatgatctctctgttaaggagaatcgagattatatatatgtggtacaacatcatcataaaatgcaggcatcccatgcactgaagggtgaagactgatcggccactgaaaataattccgaatgcgaccttcattctatcataaaatggaaagaaacataatcaccatagatgaaatttgaggcctcgtttttcagaagaaagtacgcaggcatccacggcggcgatggtgcccaaagcagaggagttttcttctccgtacccccatcaggtcgttgtattgacgaggccgccggcaaggcaatcctgcctgggcttaagtcggttcatgggccgtggcccgtatgtaccacaggtccaggtcgcaacatttgtctcggatcctagccgcacgtcttaatccaacggttcgtgaggccctgagggagttcggagaagaaaactccgaacccctccgtagtccgtacccttcgtctcggttgtgaccgtcgtcaagatcggtgaccgtacggccgatctccgacgaaccttaaacccttacaccggcttgttttctcgattttgcttgctctctgtttgttcttggctgttttctcttaggagaattcctccagtgcgaaaacggcaatttggagaaagaggcgatcgtttcttcaatcctgagtcgttatgatgtttttaatgatgatttcggtgcctaatattgctgctgcaacgtttctgaagatattggtgcttagctcgttcttgagtattgcccaattggcatgtctgcatacagcacatggctatatgacgattagttttgcctttttatcagctatgcattaattcatagatgatgggttgctgatggccatgcctcgttgtttttgcagtttgaacgagccagaatgcctgattgtctctgcacatttgcaaatggcaaattttgttctttcaggcatggttgtagattccagtgaaccctcaactgtttatgacaacgtcgaaatcaggatggtaaaagaaaggaaatacgaagtattttctagctcatcgagcaacaacatgcagcagacatgtccaaggtatgtgacagagcatagtatttttcttttcctagtacagtctacaaatcgtattgttgccctcactattgacctttttttagcaacaacaaaacaattttagcaggtgttcattcgctgacacgagaccacagctccaggtaaacaccaggaacaaattcagcagccagtgtgaggtttcttcagttaacttcctttgttttggcagttcagttaacttgctttgcattgcagtaaggtgccttcagttaatatagctggcaccttgctctgaacaaagacttccatgtcaattccattcttcttgttgcctcgggtaaaaaaaaacagcactctcgtgtacatggattccatcatcatgtaactattatcctatagtgcatacattttcttatattcactgttgagtagatctggatctgagtcaactgtttgagaccatgagcgagattggcttgtagacgccttcctgatcttcctctcatccatcctatgagcaatgatacagtagcacatggaaccaagagttgtaagcatgatcactgcaccgattgccattgtgcaccaagctagccaccagtcgtcgcgcccgacaacaacataggttagtgctatgaaggccaccgagataaagaggcatgccagccacatcagcttgttcatcacaaagaccatccttctcttggctttctgctcaacaacaattagcgaggtctggacgacgacgacagcaagtgagatgaagagagccaaggcatcaaagaccaaaaatactaggaaggccgggttgcttgctacatatgcctgccccaaggacatgcctggaggtgcctgagtgatatcttccacaaaattgccaggaacggtgaaaatggcagcaaaggcgacggtggcaataagcactgcaaccacagtattggagttgatggcattgtttagaccaccaatgtggagtttttcgagtctcttcttgattttctggacttgcatcttggtctgtttagtttgcttgatctgggactggacatcatgtctgatatcactaactgtttgcttaagttgctttgccggattgggtggatgtacttgctcttttgcagttactccaccagcctctctcaagatgttaacaagttcttcattgttgagttgctcagcaatggcaagagcggtgtgccctgatctgttaactgcatttacttcaattccctcaactgatagtagagtctgcactatctgtaaggaattacacatatatcagtcaaagcaaaccttcttgtttctatatgtttgaaatatgatatgcttctttattctttttaaaacttatgtacaggcacctgcatttgttttgaatttgttcataaagaaagcattatcaccattccaatcaaatagaggtatcctacagtaaagttatgataatctctgttctcaaaatactgacataattaaactcagtaaacaggatagcaagtgatttggcaaacaaatagtcatctaaaaagatcgacaaaaacatatagtagcaaggaggtaaaataaaacaaatgaaattcccaatataagatcacctacaacgatattggccttccgtgttgcaacatgcaatggtctgtttcccttgttgtcttccagatgaattactgagatatcaggcttcaacagctcgataacaatttcagcattttgtccttttgaagccatatgtagtgctgtttgccccttcttgtcagttcttaaaccaattcctggatccctacttaataatgatcttacaatttccacatggcccagtcttgcagctgaatgcagaactgtcttcccattatttcttgcaattctcgcaaggtttgcatcagattccagtaggaggttaacaatttcagtgtgacccagaattgcagcagtatccaaagctgtagcatttacagaatttgtagtcattgcaagagcaggaaaagcctgcaacagctccttcagaacttctgaaaaaccaagaaacaaaagaaacgtatgagccaggatttcttttttcttcgttagcaaaatacttaactaaaccatatcttgtacaaatcattgtgatcatgactatagctgtggtttgctggctactagatataactccatgactaaaatgacatgaatttcagtctttcacaagtagaaaacagaatgagatcataaggtcataaaactaataatggttgcacaaaatccaccatcgcgcgaaaggaatactaccatttttttcattgtatatattcttaaataaaccattcaatgtagacacatcgtgaaagcttctttgggtacagaatttgtcaaccctcactaaacaagaccataaatccataatgaaaaactcagcttgcctatcacctaaaaagaaggtatttgcttccttgctggacatgaggtctaaatcaaaccagatgtgagatatgcactagtctcagacatttatgtaaaaaaaagagagaagaaggtaaccacaacgattcatgttagcaatgcacgttgtgaagaaaagaaatgaacaaaagcaaaagcacttgtatatttccataagtcaaatcagacaagttcagcataggatttttcaaagccctacacaatgacacatgcaaattagattaagtcaatgcaaaatcctaatgccataaacctctaatcatcagctcattgacttggcactggcaggctgagatcgaagtcagtcatcactaataacagaaatcaggttcagaaaatgaacaaaaaaaaagaacaaacaaaaaagaagaagaagaagaaagaactgacctagatggccttgcttcgccgcaatatggaacgcgtcgaagctgttgttcgccttgacgccggccgtctgcacgtcggagaccttgaggatctcgcgcaccacgtcggtgtgccccctctcggcggcgacgtacagcggcgtctcgccgtcgtggttggcctgcgcggcgcgctccgccgccacctccgggtcgaactcggcgatgatccgctgcgcgccggcggcgttcccggacctcgcggcgaggtggagcggcgtgtcgccgcgcttcccggggctgtccctgtgcctccggaagttgtccgtggacatcatcttgaagctcttctgcttctccatccccctgaagctcttgagcttctccagcgcgcccaatcggaagctcgtctgcctctccatctccaaatcagaacagattcttcaaaaccgcggaatccaaggtaaatttctgttgcttttggttggtgtggagagatcaaaagcgctcagagattgcaacttgtggagaaagcgctgtgattgatattgcaatctaagaaaagaattcctcactttccagaaatctcctggctttgattcacaagaacattagcagcaagattcgcgcatccccttgggaaaaaaaaactggaatggggggtctgtgaaaatctgcccaccaatcaaaatcattgggccatgaacagagtgcctgataggtgatactccaactgaggaaaaaaaatcagcattttgaccacatgttagaacttagaacacagttgattataacatctcgaagaagcgaaaatggagaagtgaactccaaaccaacaaactaaaaaggacaagaagaagaagaacatgacacttacaaattctatccaccccttagaacgattggaaggcaagaagaaccaatggagccaaagaaaagaaacaaaagaaaccaagtgattgactctagaccttccaatcagccaaagaaaaagaagagaaccaagaaagggtcctagtgggaatcttggacctctcctagctttgatttcttcttcttctttggccctcttctctctctatctccctagagagctcactttcaggctaaactcccctctgcctggcttctcagcacaactgccagaagacaaatatgctgccgcctagcagcagcccaagttggtagagtttggtccctggttttattttttttcctatcttttcttttgtgggggagaaataaattaatgggtcataaataattgtacaacttgccagtccattgttgctattttcactggactgctcatcgttttgttcagtggtagctctatcattaattggtacgggttgattgctttcgtccagcaaatccaggttcgacctcttaacctgctcatattccatctggattaaacgaaatgaagggttggaaaaaatgtggcttctcctatcttaataccattaaatggctagtttcttctagctatcccaacatttgagttctatctttaattcaatcggggggcaataaattacagtactaggtgagagaattattatttttgcatattgttcataagtttttttattgtgcatcttgtagtatttcgctaactactcattttgttgtgtggtgactctatgattaattcaatcaagggcattagatggcacctactaagtgagaaaaaggcaaggatttttttatggtttatattgtccgttacctaaaaaatttgtacctctctgtaaatagttatatttttatgaataaattatggaataatcaacattatatttttataaataccattcgattaagtgcaaaatgatacaagggcacacatgccacgacaaacatgataaacatagtattaattgcagcacattccactgaaaaaggcaagttttcttaaaggcataaaaaagtcaagttacaacgtatactccatccgccaaaaaaaaaaactcaatctagaagcatcccctcctaatataatgaatctaggcaatctagatttgttgtatgtgaccctcttagattgagttttttgggactaggagagtcagactctctccgtcaaaaaatataagagattttaggtgaatatgacacatcatagtaatatgatatatcacatttatctgaaatcccttatattttaaaatgaaagaaatattagcaactaatattaactagtaaacaaaatatagttatcaattaaattgtgcctataagtagacattttcacctaaaatgttaaagaaatattttgcttttctaatgaaagatgcatttctcatgctatatgctttagaacaattttactctgctttatctcttagtgtctgtttttacaatttgtcggcactctcaccatagtggagttagttagtctctcctttatatctctttactttcacaatagtttctctttttttatggtccaatggggcgccaaggcggccatcaaaaaaatcactggttagagtgaaagcaaattaaagcagataaacattttttgctttcctaaaataattcagatcgccatacattacacgtggatggtgtcgacgttttgatttctgccttatccaggacccacctgtctggtatatgtggcactgtcttgtttgatctacgtgtatctgttgccatgtgtgggctcctgcagccgaaagcctccaaaagcataatcacttgagagtagggatgaacatggccatcatcttctcctcttttggatgaaagaatacaaacttgcatgtggctagcatatccctttggcattaaatgataaatatcagaaaataaacataacttttcttctagaaatgactattatctctgatattttgcaataaagttgtgtaaattacggagtaaaagggcctgttcactttgatgaaaaaaaacttaccaatgctaaaattttggcatagttgtcaaaattttggtaacttgataaaattttggcaggatttcttatatagttatcaaaatttgacagcaaactaaatgtagccatttttttagtaactttattaaaactcggtaaagttgaaaatagcatgaagaggcccaaaatctatgtagtttgatgtggtgtgtttgtataagcaacatacaagttaatggtgcagtggacatcatgggagggacttctcttgtcttgtagtaagttcaacaattgatctgccttagagtacattttctcttccctgatttcaacattgttttactaagagcaagtttaattgtgtagctgactattgattccaaaaggatacacatcagcaaagagtaagtgaagagctagaaggatttgtacaatagctggatattgatactgtatttggacaactatcaaaattatattttagctgaattggcaacttactcaccagcaagatgaaggcttgttggtcagccataggttgagcactagtggaccccatggcatgcatgggagcttgtattagcactggcgacaaaataagcgcctacatttctctcttttccatctcaacacaaatataacttatttgttgctatagtttgtttacatagaattattgtgcctgctctaaggctcctatcatttttggtgaaaaattcccacgtgcgaaattaagcctttgttgagcaaacaaattaagaatgcccggtttggttagaggcagaaataagcatgcatatgtacgcaaaagaaatatctggatttgaacagagtaaatcccttttttccagcagtttactcaacatggatatcttaatttgcagccgacgattgcggatcttgcaaattaaggccgctataaatgcaagaaaataaatagatattgcaatgtaatactaaatggcacatgaacaataatcctgatcgaattgaaggtagagaatatatgctgggcagtgtgatcgatcctgtcccatgcgtgcaaagagaggaattcataatttacaattatgcagaatggttagataaacatctggcgatgatcgatgggggtagcatcatgtggtgatgtccccggccttgtgtgcagagcacctaacccggccatccatccctagtccatccagtaataatccatggtgcgctagagacgaattagattagcacctaatgccacactgcaattgtttaatataatcaggcacataggccgcagctaacacccccatcagcacgacaatgacagtattatgatagtatgatatagtggaaaaaaggccacgagcagctagttaatcagttgcacacgtgggtcctgacgagaattaatgtttgtttagaggcaagttgcgtgatatagtagcacacatctataggattaattaagattgagctatctagtgatgaaacgttgttagagctaagctatagcatgacttggaaaaagaaaaccacacttgttcttttagctacaccttgtgtgtatcgatcagtgagctatctagtgaagatgaaggcagccggccggtgttggcgctcatcgatcgaccgactgttatattagcattccaattttgcaagtgtaactgtgtaagatgtgtagtaatataacaaacagttcaccaccggtgaccacccatgggcagatcgatcgcgcaaaaaaaattacacgtcaatatattaattagaagaaaagagtttttgtcacgtaacataatcggccgaaccaacttatatatgcgaggggaagggagcaaagaaaaaaaaaactgaagcttaaaaaactacggtggctaaacacaaatttcaaatagcaggaagatggacagatcaatctgtctcgatcgttcatgcatggacagacaatttaatgtacacagtagctagcttttgtgtgattgtcgcgtacgtccctgggcgccggccaagcttgacccccggccctcttccagttccaggacgacggagacacggagtcaattcagcacgactctcacacgcactgcatatatataccactgtggctagctgcatgcacggtggttgcgccgttgctccactccagtagtactactacgagagctagttgcacttgcaacatcgatcggttggtgatcacttggttggtcgttgggtcctgtacctaggtgtgttcgctggagctagttccaaagcatacacagttcgcacggagtagtctattagagcacccacaatggtaaagtaaggtgctatctataaaacatgtacatctcagcaatagactagattaatagtaaatcacctcaacagtatgtctacatggttatctatagctctctcatgcattgcctcgtttttctctatagactatctctatgttagtagatagctttgctctctctcttcatttaatatcttccaagtaggaaaatatgctgacatggatctcttatagagagcttatagataaccattgtgggtgcccttagcacgcgattaattaagtatttgctaactttttttctcaaaaatggatcaatatgatttttttaagcaactttcgtatagaaactttttttaaaaaatacaccgtttagtagtttgaaaaacgtgcgcacggaaaaaaaaaaagagtggttgggaaaaggggcgtccgaacacagctaacctagctagctacatccccgttctaaaagaaattcatctctctttacaatgaatctaagcaaatatttgttctgatttattcttagaagttaaaaaatagaacgggttcagatttattcttagaagttaattttttagaacggataaagtatattaattactaactgatctgtatgcccaccgtagctgagccatacttgaaaagaagctaatgacgtactgctctctgacatacctacagaggtcgttgtgtgagactcatgtgttagtcatttaaaagcagatgatgctccctccgtgtcataataattttattttttgacttatcctatttgtcctaaaaataagtttatttttttaagtaattattgtattggagccaggaaaagcagagaataattatattagaataaataaaacgaaaaataattgtattaggtttgataaagtatgtgaattcttttttttttggaatatgtgggaagaggaaaataattgaatttattatggcacaaaggaatcaataaattatgtttcccgcaatcatctattttgcgaacgtgcaaaagtattacacgtccattagtccatatattagaacaagaaaagtttaaatacacatcacaatcagccagagtgcccgtgcctccctaaataaaaactgaaaaatggggttttcagttcccctccccaccagtcatcaatctccttgggttttttcagtttctagcaggttaaaatagcggctagccgagcgccgggcgagcgagtgcgagctaccggccggcggccggcggcggcggatcgatcgattgagcgcatcggcgcaggccggttgattttgcagcaagcagattcgcatatacggctcgttgcaggttgcgctttctactgtcaaatcctacagttagctagccaaaccgcaaacggagtgcgacgcaacacgcactgatcagatcagtacgcttttgcccggttgatttgagagtaattgtacgcaactctcgattgatcgtcagctgatgcagtgactgatgcatgatgggtgctaaattacgatatatatcacgttggaaattaaaaagagagagagaaagaagacgatcgatcgtgctcgctcttggatgcttgatggtatttcgtgcccccagtcaactgacaatgtttgatttcctactcttataaaaaggccgtttattttaggtctgtacaattgctcttgctcccagtctcacttcagcttcagcttcagcctgtttaagcagcccggccagcaagtcaaatccatagagtcaacctcgtgggtaaccaatcaacaaccaaacggcctaaattaagttaattacctgacgcataaccatcaaattataatatactcatatagggagtagttaattaatctttgcaagctgaagtagttaattaatctttgcgagctgaagaacaacgactccttaaagaaaacttgaaagcgagcgacttcaggactgaacaaaacaattcagtcaatggcgtggactggaccatccggtcgttaatccatagtagtacgagttctaaacacaattctcctcctccatcgtatgcctaactaatctctaaggacacgtcacatcatcagcatctacactagctagctagctaagctagcggccaattattacaccatggaattccactgcttcttcccaattctaccctgggttcggaagcttcttcggcgccgagcgtacaagcagtttagcacgcaaagcacatgggaattgaagagatgggggcaatggtatatgtatgttaggcatgacacacagataaacagtgtttaacgtacttaattaactaactatttaccactcaacgttgtcggtctctattaagtaacttcggacaattacagtttctttcagaataaaagctcctcaacaatttagttttcattcaaatcctggaaaactatagctgtagaattaagaaaataactagtacaagctagaagcttgttttcctagcttttccagatttttactagcaccaggtacttctcaaaatttttagcttcccaaccgataatgtatcctgattccttgaactaatgcacaaccatatagcacttgccactactgcagggatgcgtatctaccgttaaaaaaactgataataccaaaatcatttttgatagtgcaaagattaataacacatgttaaatttaagagcaaatttctgaaaatataagataagtacaaagagcattaccaaagcatcgtaacattgaactacttgtttgggcccttgacctttgtgacgctttgggcttagggcgtacccgtgcgtgctttgggctttaggccgaaagccttgtggcccaaacaggaacagaatcatagctacctctaacctaataataatgtccttcactccttcatcttcatacattcagttctttcatatatgtgtgtaatgtaataatcacaacttcacaagtacctcaagtttcgtatctgctgtaaccagttagctatatatggatgggttgcatgaagttttatgctaatagtagaaagctatatactatacagtagtacatgccaagatgggcctagttctgacgatgaactttttttttttttttgaaaggaaagctctgatgatgaacataattaacgtttattcagaatcagtggagtcaaattcaggaggctaaagtctcgttgttagtgaatgttatttttatttgttagagcaggtttaatagtggagctagtaagcaccggcgccaatttatatccacgtcatttagagtatcttcacagaatcatttttttatgtgtgtgtgtgaggaccgccaggtttactcccattggaccatactggaataatgacatgcagccgtgtaaaaatcaacagagattagaagtttaatagtatagtcaactactaactccaattcatctatagccaatctaatagctcattcgtacaatagttacatactacactattaatacccggtcccacctgttatacacacactatgtcttggagtccgtactacagctggctataaatttgtagcccgctactcttctctctcatcatttatctttttaaaatatatttgtagctggcttatagcactaccctaggtgcttgcgcttggccggctctcatgcaagcgccggctaccttctctctccaggactctctttcttccatgtagatgtaggttggctattagccggttattatacccgctcttaagctggaagactggaataagacgcataccaaaccatatcactccaggtgacagatggctttggtcacggaggttcatagccagtgctgcttattactcagtctacagtgtaattttgtctagtttcccctcatcgatcttgtattcattcagcttggactattggacattagtttccagaaatgcagagtatatttagttagtcttagacatgactgtcactgtcttttgggatgagcattttttagagtttgttaaccatttagttggtgcacacactactagcaaagtatttcaactagtcgcggttagtcgtatactagccgtaaagtcagtcaaatcactcgactagagggccacgactcgaccaaaaagcaagttgtgcaattagtcttggttattcataaagtcggtcatagattagtcgtgattagttatagcaaatcataatttcaccatgctaattgtcttgttgtgtttagtactttagttttatgtcttgaacttattatcttgctggctactccattgtccatagtttgtaatactatatatagtgcttagtatagtataatggtagtagagactagaactgggacttgggccgtgctttctcaggccagcccacggcacgatggcccagcacgaggaaaagcacgacacggctatgggccaggccggcccgtagttgggccgtgcctgggccaaagttgaggcacgcgctgggcggcatggtacggctattgggccgtgcctgggccggcccagcacgaaaaaaggcccgaaggctggcccagcatgaaaaaggcccgaaggctggcccaacacgaaaaaggcccgaaggccagcccgagctctagccaagccgagcgcccgaggagtcaagagcgcgtgcaattcgggacttccgcgaggagatcaggaggcaggagcgccgagccgctgagcgcatgcatgcgtggtcagacttcagccgacgcattcatatatgggcttcgaccgcgaggagtcgcgttcagccggcggccgcgctgaatactgatcagtaactgatgagccgtgctttcaatctttcagaattcagagagccgtgcatgcatggaaagcatgattttcttggctaattaattctgggatcacttaccattggcgattagtatcgtgtatatccactattagtcaatgaaatttttgttcatggtttttaaactttttaaatggctaatgaaccgcgtccttgttcactgcaacggtgcatgcatggaattatggaaagcatgtaacgcagcaggcgacggcggctcagcggcggcggcggcggctctcggtgtcgacggctggcgcgggcagcgcagcagggagcaggcggtggcggcgcgacgtggccgtgcggaccccggcaaaaaccctaggcacggcacggctcctcctcaggtaatcctaggccgtgcttgggctgacacggcccgaagaggcccgacatgtctttgggccatgcttgggccttatcttctccaccttggcctggcacgacccggcacggcccgttctagcacgaagcacaacgggccgggccgtgctagcccagcatggcccaagtcctagctctagtagagactatataacacatctcatgttttcgtatgagcaagttgtggatttagttcattaacaaggagaagtaatacaacattgatatcatgtgtcagctgcactaatgaccaatgtccctggctccctatgaagttgtatctctcacgtcaacacttaagctacattagaaatacttcctccatcccataatataacatgtgcacgtatttcaatattcaacctttaaatcatttgaccaacacttaatataatatgaaatgaattttatttgttaaaaattatatcattagattgtgatttaaatttactttcatataatcttgttgctacaaactttattgtatatgagaaattataagctaaaaattagttttggagaccgtgccaactttgaccatgctttatattatgggatagagggagtatataagaacaatttatgatacttgatccttcgtgaactgcaagatcttctgtaagatcttcgtgaactcattttgaggatatcgtactattaattatgtataaagttgtgtgttagttttttttttgggaaggggggcatgtgccccttgccatacaattaggtagtagacattaagattaggcaatctaaaacaattaatttccttggttttaattagtagattactaagtggtaatagttattgatatgcatgtggtcatatggtaatttggtttacacgacatcttggtcgttttcatccattaaaagaatgttcctcctatatacccggaaatcttagtatattacgagcacctcgtgtgacacgtctataaccacacactgatatgaaatctgaaacatcaatatgtctcaatgagttcatgactaatcatatcttgatttatgttagtagatatctcattgttcataactagaagatttagatttaatatggtgtttggacttataagagttttatgaatgtaattagcatatgtgaagattgaaaatagacaattaggaacattagaacaccctacaagtgcatctggcccctaagtgggttttgagtgattaacgaaatgtaattagagatctgattgtttcatgaagtaaaagtgcattgttatagtcccgaaaagtttttgagatgaaaaaaacctccaccggcatttaaatttttgcaacttttaagatgtggcaattaaggatttgtcactcacaatttatgacatgtgggccctcgtgtgtatatgacatgtggctccagtgacaaatccttaattgccacttgtaagagtggcaaattgttaaatatctcacgcaattgtggatctctatgatgtgaaaaacagagtcataggattatcatactattaagagaggttcttaatcttagccaaagttcgtatcatgtgctcaattccaatcctttgatatttatcgagagacattaggcaccgcactcacaagggaaaatgagtgattttcttaagtttcgtcggagcgtgtctggtcaaaatgtttggaatctatgttcaaaacatgccgtctcacacttctatgtttttcctaccctgcgtttcaaaaagaccttactatgtgaggttgatacttgagctgataacgaatgattcatatataatgtcaatcactttatattgcaatgtagattgggttgaatgcatgtggtacacaatgacattgtagctctagagcttaagcatcaatgctatgcttgcaaattaaaccaaacatcagtaaacagaatcagaaacctgaacacaagcaaaccaaatcatgaaatcatgatcactgcgccgtacttggcgacgaacgcggcaatgttggcgtcggagctgccagttaagtgtaatacaagctatgtaatgttgatgagtccaaccaacctttccacaactgaatcttgcaagggagtctggtaactggcatttcccaagatgacagacaaaactatcatttattcattttgacaaacgatttcaaattcgacactcagatgacacggaaaattcaggaattctcagctgttaaagctagctcagagtattatgtaccagtagcacaatatgtactacctccggccccaaatatatatttgtccagattcatagctaaatcttgttatattttgggacaaagggagtatcattcgggaacatgcaaggaaaaaagggtaacagagggtgcagacacacacaaaatttttcagttgtttgatggtttgctcgtttaatattcatcaatgaaatttgatgtacaaggggtgtgtcactgataagtgatcttattagcataacgtgtttaactctaacatgagtaattctcagtaatctgtctatgaaatccaaatggttcagagaaggaaccattgcaaaacaaatcataaaaaacacatgtaagtttgacaccatcttgtatatccagcaaggaaataagactattctcatcctgaactctgctggtctcagttttgacctttgccaacaactcaggaaaatgggaaacgttgagcacagtagcaggtacctcaagagcacaattactgattatactgcatgaccttgctggaattgacggtttctgcaccatgttctgagacacagatgatgcatttacccaaaggtataccgtgtttctaccatgtaaatgaaggcaaaacataggtgggataggagccatgcttgcggcacaatgaatcgatggcgtcctctccagcgatttctccaatctcattgagtccaagttcagttgcatgaatccctccagtaatgaatgcagaagcgactctagatgcgtttgcacctttgatgtcgtggtgcagtgaatcacctactgtgatacattcatgaggattaacccctgccagggacattgctgatgtatagatcacctgagaaagcaatatcagattagcacttaggcaaccgaactagatatgttaccgatagatgttaaaattcatgaaggataatcacagaaaaaaaactgaaagttattcaagagaaaaataattacacatggttacaactataggttatcaaacttgtggctcatcataacacatgactgacatttcaacatgttgaagtagctgaaccattcagtaatatatataaaaaaatacatgtcctataccttatcaggcttccccatccatttcacctcaccaccaagactctcgtatttggctgccagagtgcctaaaaggacagattggccatttatgttatattacaacaaatggttgacatagtgaaaagcagtatagctgtagttacagtatgactaaactgatccatgcatcaggggaaaatgattgttattaggtatctgctaaattatcagaatatcatgaaatatgaaacaaagtaacataccaggcatgactcgcagatctcgtgcttcaacagtaacataatcagggttagctactaccattggcagtcgcttttctaggcatagcattagaacctgctcaagctcctcaagacttttgggaagtggatcccctgaaggtagacccagggcctcagtaccatgggctaatataaactctgcctcttcgacattgctcacgacttgcaaaccaaggccctaataggagaaagtaaactgatttcataaagtccattttgaatgcaaatactatcaataataattgtaaaatattttttatctcttgtttgtcattgtcaatattaattcttcaaatatgttaatctgccttactattggattgcaagtttgcaattgcaacatagcccgaacaaattctaatgctaaattgctaatactgcttgaaagagagaaataggaagagagatgtaacaggaacaacaaacctccagagaaattgcgcctcgattgccccatgtcagatggacgcactttcttccaagagctgcaaaccaaggatcatctctcctatagattatttcgaaattcagtgtaagctacaccaagttacctcatataaacatatcactgtaaggagtaatctccaactaagcgaaataaagaactctacttagtatcagaaacattgtttgcttagtgtaatatggtaaggtaactttaattctgatcataatatgcattgcaccccacattcctcaagggggctccactgaaacctatgtcagcagaagatatcaacagcaagaagctcacttctgaaggtactgatgtgtgagttccccgctagtaatggccctgaggaaacaggatgggtcaaaaccaaggctctctagcttctccatggttacagacgacctcctcgacgaattgctaatgattaccatcttcgcccctttctcagcgagcttctccactgcaacagccaaaatgaacctaaatcagtgcattgcatcaacgaaggggaaaatataaactgaacaatatacagtctgtataccaacatacacgcgagaacggcaccagggtaaggcttcttcccatcgtgaagaacaccaaactgatcgaggaaccacgcctgcaagccagccaaatgcagatataaacaaacgagcagcagtggtagtggcaaatgctacgcgcagaggaataaatttctagtcgaaatttccccccgttccctatccataactgaatcgaccgcgtgattcagttccagaactgggaatcccacgaataatcaatggcctactgattgagcaaaagcagcagtaattccgcgcaaagctgcttaattaatggtggtgggggctattaccttgaagcggccggactccgccagtgcccggatcccggccagcctctcgaacgccggcgccgatgccgcggaggccatccacccccaccgccgccgccgccgccgcccgaagcccagcagggaggagggagggaaggggagagaggagagtgggtagaagtccgaaatgggtgaggttcgttgcctttggtgacctgtgggagacacgtagtactgtattacatactgttaattcagaggtttaaaatttaagcaaattttacattgagccacatgtttctctgggaaaaatagagtacgcaatgaaccattttcattagaatgtatccaaaaccttcacatctcgaaccgcttggtcagacacataatcatccacaagtttcagtaaggtgaaacattttcgtcgcaaattcacaatactagaactttaggcgcgcttcgcggcgccctaccatttgttattggtaaaaagtaccacgagtcagaatatatatgtacttatattggtaaatgttgagtacgaaaggacttcattctagcacaggctgtgacataacttgaattccgatgttacatgatgatttgaaatagaccctgaatactataagataaaaaatacctgataatttcagaaaccacaattatttatcatacccaaaagagcaagaaaaggtataataatgtataaaaaacggtttaatcattcatcctcttttaaaagaggttaattcagttccattacggggcatgaatcacaagttgtaatgtgaaggactgtgtttgcaatcacttaagaaaataaatattcttcaatcgcacatggggactctcagaatttgtatgcaccaggtttctggttttcgttgcttgcaaaattaagttgctagcaatcctggaagctgagtagacactttactggtgtgcacgcgcgcacgtttaatgtgacatggagattattacaggcagcacactgtggaaatggcagagttaggtataatggtaaatccctttttccagaattatcagctaaaatccactgctagatgctccctcaatcataccagcttacaaagaacgtctttcggactaatctctgcttgaatatctggtatttggtacataggcctaagaaaaaaaaatcagagagaattgtccatgttctgatttgtgattctgacttctgcagttactaaacataatccaacaaaaaagaaaatattttctatgttctgtaatttgagtcttaattcagattagattgacctgaaatctaaagaggtcatgaatcttcagattttgcatttgattctctgagattatatcaaacagctagatgacaccttaaaaaacacaatgaagcagaatcatccaaaccctgtcctgaccacctccttaaaatatgtaatggagcagagcgacccacagtggtttcatgaagtgaacatctaagcttttggttgttggaactatatacaaacacaaccaaataaaaagatatgcagtacaaatcagaaatactgtagcattcttgataaaaaaaaaggtagactatcatttgcaagggaataatggtatatgaaaaagcaaagctaacgagggaactggaggcaggaaagggaagatacacgccaagcatacataagtgagtgtagaaaggaactggttgtggcttaactcaccaaaagtgaccatgggaaacaaactgcaaatggaccctgggcaaggcaacaacacatggttccaatatcaccagatatggaatcgctaaacagtggtggtgccgcacggccgacggagcttcaagctaaccaacacctacaatattggcaaacttgagcaccttctatggcagcaaccaatcctttttatacagataagacaaaatcaattatcatatttgatattcatatttataattagattgcattctttttctcttttttgaaaaaagattccacttatctagtgaccaacacttcaaagtatcacctagagtagaaggcaaactgaagagaaaaacattgattttaacaatctttcaccttcttgtacatagaaacacaactgtgatgtacattaatcaacgttttcattagccgatgaggacggtaattttaacagagctaggatgatgcaaaataaatggctcagcaaaaaagagtaagttgtgtttcctaggcaagaagttttttggatttaaatcaacagcaactatgaaattgtaagtcccttaaatataattgcatgaaagcacataaaccatttcttgcatacttaattaaactcctactctgaaacattgatatggtgctctgcaatagttctttcaatcttgcaactaatgtcaagcaactttgttatggccttcttgttccatgattcaggtggccttgtaatgctagtatatgaccttcccatcgagaaaatacttagttaatgaggaagaatatccaaagtaagaccaatttcagaatatcaattagacatctaaatgaggccatatgataaagtgcgtgcagtaaaagaggatttctttttttgtcatattaacaaatgatctgtacaggtgctacagcctctaatcctcccatgaatagtttagcttaattagtttattctactgtgcacccatggtaaatttttagaaaggctaactatcacgtcaacagtgaacattagaacagtcattgacagttgcaataacatggagtatgtgcatgaggataactaaggataatggatttaggactaaggttctatgaaccatcatatgatgttcatgtgaacaaatgcacgtaagttcctattatgctgcatcgaaaaaggcaagaagcaacagaagaacttggaaatctggaaaaagcaaagaaaataaaggcaaaggcaacagaagaagatcacctgttcaaaaatatgaaatgtcatcccaattgccttgtggaggtagcaacaaatagacactcaacatttagttatgaaatcaatggcatcttgcttcacagcgtcctatcgtttattgagagcaatataaaccagaagtatatattgtactaatataaattgaagagtaccatatcaaactttatatgcccacgatcatatctatgactgtacataacaatgctattcaaacctgaagaaaaatcagacattcatgataaggctcatagtatcctctagaatcagatcaagtccaaagatagtcattcagatcaatcgataatttttttgattaatttcaattgtaagtggtcagctcaaagtgtcacagcatttacatcattcaatattaagttctggaggtcttcattccaacacagattgtcacaacacctgaattctgacatttgtgtcacttttaggaatagtggttgaattcttcaagatagaaatcactgaagagttagttcagaaattatgaaaacttatcatgcttaacagagaaagacatatcaatgtatataatcaaagatgattttagtgagattcagtttctttaaaaaaaactaatttagttccatcatatgcaaaactaaatttatatgttgcatctcgtgtagctgaaagcatgaataccaagatagaagcatccgcttatgtgaatgaagataaaggaatttatagaacaaccttcgctaagaataattcccaagaaactaaatgatttctagatttggcaatagaacggtcagttgatcatccaaaatactcctcaaagaactaaatgtagcatccaaaactcttctttcactcaaaagaaaaggataatacatctattgaaatataatgtgagaagtaatcagttaaactaccgtagatgtgggtgtcctaaagagtatgtggccacaaaatctgacatcatgttcataaatttctaaagattgggtataaaatgatacatcttaaactgcaatgcaactgcttagcatagtataagatgagaaagcatagccacaaggttgctagatagccaaatctactacacatattaggaagaaacatgccccctatagttttgacatacctgagcaccatatatggtagcaactaaccctttttacatgaataagacaaaaggagtcatcagatttgatatttataataggatgcacttattactctctaaaaaaaggttccacttatctacatgcataacaatacctttgtagagaataaattatatccgatgaagagctatagaaatacaatgcatatttaagctgaaaggagcatagaggacacatacacattaacaacgtacaacacccactaaacctctttgattacatcaagccactgaattatcagttataatctccctcaatcatacaagcttacaaagaatgtttttcagactaatatctgcttgaatatctggtattcggtgcacaatcccaagccaaaaataaaacacagagaaattttcttgttctgatttgtgattcggacttctgcagtcgatctacacatgcggctgttcttcgttcgcgtcattgtgaagcaatcaagcagaagcagtagcatcatattgtccacatcgtcgtcgctgatctggagggcatggccgacccgatctccaccagcaccccaacgtcgttggtaggccgcgccgcccgctggtcgtcggcctcacctggtgcgaggtcgccccgatgccgccggtgccatctccatcaagctccgccggcgtcgtcaaggtcgtcgcggcgtcgtcggcgcggcacagggtacgggggaacccgtccctgccggctcctcctctgcggccgccaccgcctggggagctcgtgcccgccgcagccgcctacgcctgcaggccgccggttcaccgtcgatgcatcctccgccatccacgctgccgcccggatctggatgtcgtcgtcgttgcggtcaatcccatctcgccgagctccggcctcgccgtcgtcaccatctccacccggccggatgacgccggcacctgcctcgccgtctcctgtgccgctgcggggggactcgcctccaccgccgacttgtgcgggtcgccgctgcccggattcctcgctacccctcctgggactccacgatgggcgcccgccggtctccgccgcgttgctcccggcggcgccccgataccgccgccgccggggggacggattccgccctcaccgagcacgagctccctccaccgcctcccgccgtccgccgcctcccgccatccgccttgctacgccggcgccctccgtcggcccgatgcccctggctcctctcataatctcccaaatcaagcgtcggggccagaagatcgatccccacgccatcaatctccatcacagcatcctcggagctagcgcagcaccatccaatcccctgcttgacctcacagagagaggaagagaagggagcaaaggtggggggagcgccaggagcccaggagatggaggaaggcgggggagagcgcgagggatgtcatctgcggtgaggagaagcgggtgagggggagggaagacgatgcagcaccggcggcgccgcaaaggcagggaaagagcaatcgagagaagggtggggtacaatggcggctagggtttcggacaagcgaggggatggaggatggggatgttttcttttgcaagaaaaccctcttactttcttgttttagagcgcgccccctatattcggaatttcttctctttcacatataataataccagtacatagaggaccactacgtaagaatacaaaatacagagaagtacgaccaggcagttaggaatgattatcaaagaaagcgagggtttttttgcaaaattgccagctccagcgcagggtgacgtggatatcaccggaagcgaacacgccagccaaaaaagccccggagcgctgtggtggctccatttcgcggtcccctttaatctctccgatactgtaaccttcacatctcaagtcacttggtcagagaatagaagttctcagcagctagtttcggcacaacacttgaaagctaagaacaagaaggcaggtttgaaaacagattatgctatttcataatctgatcccaaacattcaggtacgctttcagaaataaaggtacaatcggctaggctattacaaagctaacaaggtaatggattcatcccttgcacacaaatggcgatttggggcatgttctgcattaatttaacttatcaattaattcgttgattttatcttcacggtctcccaaatcaccaccaatccaccatccttgtagggtttcttcttcatctgtaacctccttcttgacacttgagcttgaagggcatgaggaagtttgaagcttgtctgaagtgtggaccgactgttgcgatttcatgctcatcttccaaacatatgatgccatgttctcctagagcctgttttcagtgaagtacagatggtgatgttacagtgtacattaccaaaccatgagaaacagctagaagtatcttctttactccaccaaaaaaagggaaaccaaatatccttttttttgttttcctttggagacagaaactgcatctttatgtctgggaagttacaaatgatcgagacggttatcaatgcaaaaatttaagcataacccactatgatttttatacttgtggcaggacaccaaaaattgctccaccgaacaggtgacaatgaagatgatcctaaattaagtcctggtagcattttaaatttgagctcttgaatccaacaaaaatattaattgagattagagaatcagatttcaggcattgttacacctagtgatttttatttttattaattttttttttgtaaactagacctccaaaataagtccacgcaaaaaaaaaaaaaaactgagagctatgtgttattgaaagttccaaatttccatggttaacataaatttttagaaggtgcaacaacagaaataccttcttaaatagatcactgctggtaagccaactttaattctgatcataatatctattgcaccccacattcctcaaggagaccccactgcagcttctgttagcagaagataccgacagctagaagcttagttcttgtgaagatactgatgtgtgagttccccgctagtgatggccccgagaggaaacaagacgagttgtgaaaccaaggctctctagcttctccatggttacagtcgacctccttaacgaattgctaatgataaccatcttcgcccctttcccactgcaacaaccaaaatataacttaaccagtgcatcgcatcagagaaggggaaaaaaaagtaaactgaacactagtgcaacaaccaaatataacttaatcagtgcattgagtcagatgtagaacaaaataagagaaatggatatataagttagagaatataattatatacagtgtgtaccaagatacatacatgcaaggatggcaccaggtaaggcatattcccatggtgaagaacaccaatctggtcgaggaaccacgcctgcaagccagacaaatgcagctttaatcaaacgagcagaagaagtgctagtggtaaatgctagtactacgcgctgggtgggaaatcaactttccccgtaaattttctagccgaaatttcccccaaataattccatatccacccctgaatcgaccgcgtgattcgcagttaccataactaggaaacgcacgagtaatcaatggttaggggaataatcacaagcacaagcgcaactgaatgagcaaaacgagtagtaattccgcgcaggtcggcggttgctaacttgatggataggtgagggggaaaagagagggcataccttgaagcgggcggagtcggcgagtgctcggatccccgtcagcctctcgaacaccggcgccatccaccccgccgcctcctccgccgcctgaagccctgaacaccgcggcggaggagggaagcaaggacagagcggggcgagtccgcgagaggtgagattcgttggtgacttgtgaggggcaaggcagtgaagggacgggacaaaaaactccaaactagaccagcgaatgcatcagaaagttgagaacagcagcaatggcctaatgtttgacaaatttaagtcacttctggatgaaatatttggcaaatgacgaatcagtgaatcatgccgcgtactttctgtcgttgactcagtttaacatgcggtgccaagccgaaatactctccaccctcttggaagcgtcttaccaaaaatggacagtcacgtatcatcagggatttcagggccgggagacgtcgaacgagaccctcagggaacttctctatcggtaaacagttaaaaatctccaattcctcaagagctgtgaagccattcatcccatcgggcagcatctccagcatatccatgcaatacgtagtaagcgatctgagtctgggcagatttcccaggtgcgaaggcagtgccactaaacttcggcaatgtgaaacttccaaattcacaagtgacgtcggcatcttgggtatgtccagtaaattgtcacaatgcgatacttcaaacctctctagttggggcagcggaagggcttcatccgatgatctgcacttcccctccaacttgccacatgcacgaaaagacagatgtcgaaggcaaatcaagcaacggagctcctccattggccactgcacaagatcatcacaaccatggacagtcaaatccttcacaaaagcaaagcactcccagagcccaagatgcacttttgacaaactgcacgttgcgagaacgaagactgccatcatttgcttgtgtcctgtgattatacggcggcggtttggcgcaagctgagacgttggtacaacattaacattgcaatccctgcggaagatggcatgccgcttgcagattggtggatcgcgacaagacggcgttttcagaacacgtataggacggatttcgatagtctgttcatgctaatttgttggcttatctggaaagagcgaaatacaaggatctttcaacacatcgccaagtcggttgaccggctagcggatgacatcaacgaggaaatcgcaatttggagggcagcagggattttttcccatgctagcgagtaatcccgattagaggcgggacttgccccattttttctttttctttccgggcttgagtttgcctgagaccggcgcgacatccttcatgtcgttgtaattaaaactttatttcccccaatcttaatgaaattggccggcctacctttggccgtcccggcaaaaaacaaactgcacgttgctaagaagcagttagaaccacgcagagtcaagctccgtagggcttcgaagggtctacggcttttcttgtcttccagaggcaccatcatgttcgctggtgagctaacatctaagctcacgggagaagcccaacaagggtccaaaggcatcctcatagagtcaatatcacctgctttgtaataaaggtcagacaatgatgtgagatgtgaaagtgagaaaattgagaggctgtgacaccccagagcctccagccttttgagagccgggctttccggaacacttgaaattttcatgcaactcttcaattctaggctttcaagctccgggaaaatgatcacatcattattctccccctcactgttttctgcccacctctccaagttcggtaaaacaaataatatcaactccttcaactttggaaataactgcactggggtgttcccatcaatgttcttacataatgagatcaaactagtcatataagacaaggacaaatactcaagagaggctgatagccacactgttggaatgtccttacatcttggacatcgttcaataatgagcctttttaagcaccggaacatttgagggtctctcatccacactgaggctttacttccaccataaccatataaatccaaaattttaagcttgctgtgaggtttaagagattccaacatttcttcctcattattgtctttgtctccaggcatgtaggatgacatgcagccccaaaataatcgtaatatactcagctcttgtttctgatggagattggcttctttcgcgttcgatgtactctttatttttctcaaattgtacagccccaacatattggtaaggtatctcaactgtttgagctcctcaattcccctgccagcatcggtgtccacgacaaacgttgttagtgtcaatagattgttcagtagactaaaatttgggggcatccgttttaatctatcgcatcccaacagataaaggtggttgagtttccttagatttgccatgccttcaggtaaacattctagatagctgcagccattgagcctcagtgattgtaagttatacaatgcacatattgaatctggcagtctatgtatattagacctagaaaggtcaagatatcataattgttttgtatttatgagatggctagtgataatagaagaatcgtacctacagtgacaccacagtcctctcaacgacctcagttttaacctttctaagaaaaatgacctcagttccaacacttcaagacccctgtataatggtaattccatcaacaaagtgcggagagatgttgtacctttgaatgatccactgatttgttttaattcaccttctgatatttgcacatgccaaacatcttcagatggtgctttctgttgaatcagttcttctgtagttgcacattcacttgaaacgtcttttgctaagtcatgcattaaatcatgcattttacatacaacaaagtcataatctaagcttctgaataatattgttttaacatcttgaagaaatgatctccaaaccaactcattgaaaacaaactcgcctttttgtgacaactcaattgtgccctcttcttgaataaaaccatttgctatccatagttggatcaacatgtccttctccatctcatagtccttgcagaaaattgcacagaaggtgaagcattgtttcatttcagatggcaagtgtttgtagctcaattttagtattgataagatttcgtcttttcctttgacactatcaccaatattacttcttgcgatggcttcccattccttgacttggtgtttggaactcattagaccgcccatcgtcttcagagcaagtggcagccccttgcatttatgtacaatacatttgccaatggtgaccaaatcttcttgctcttgtacgtctctaccaaacgctctcttcgagaacaattcccatgattcatcttcacttagacatgctggcttatagggttgaagggtttccattatagatgccacccgccgattgcgagttgtgatgactataatgctccctggacccccgacagaattcagaagtggccttaggtgttcattccacttgttgtcgtcctcattccatacatcatcaagaacaagtagaaaccttttcctgtcaatgactccttcaagtcgccttcgcaacaactcaattgagtcaggtaggtcacattttctatttgtagccaactcaatgatggatttcacaatagaaataggttcaaagttctccgaaacacagtgccacatcttcagttggaaatgtttctggacaatcggatcgttgtacaccatcttcgcaagcgttgtcttgcccaaaccgcccatccccacgatggggagaacctgcaaattctgttgatcatgctgatccagcatcagtttaaccaacacctccttgtcatgctctcgcccaaatatgtctgctgactcgtccagccccgagtgtgttagccgataaggaagctgtggcgcctctgtgtgctccatcaggccaaacttgttcatctcttcaaccagatcgttgatcttcttgaggacatcgcccagcttcctactcatggtaacacggaacaggagtgggctatgcggcgtgaagtagccgagtaccttgcgggtggtggagtcgccgatcttgacctcgcggcgcagagcctcgtactcgaagtcgtcgaggacgtcgtcggcctcgtaggcgacagccttgaggtccttcatccagcgcttgacggcggggttggtctcgcttagggttgtaagtggctaacccgtgaaacccacttataggctaaaataagccgcgagcccgcttattttgacctataagtaggttcgcggctgacccacttacacccttagtctcgctcttcgccttggcatcggccagcttgcactggacggccagaagctggcgctccagcttgcggcggtcgccgtcgacgccgcacacgcgcgtgacgctctggacgagcgcgttcgccgccttgccagccaccccgcgcaccaccgggaagcgattccgccatgttgcgttctcagctgcaaagcacggtggaatgaatgaagatgaaaggcaaagcatgaagcgctctgggcactctggtccgtaattcaagtgggcatgtttggcccgtatgagtataatatggagaaaatttacaacttgacttacttttgcgtccttctcaaaaaaaaaaaagactaacttttgcgtagtgcattcatgtcgtggaatccaccagtttggttggcagtttcgttgaaatctcctcggccctcgccgtcttttcttatcagcaaaaacatactttgctgaaacaaactggcacggcagtcggcaaatcctgggcttcgaatatgatcctgttgagacgaatgcatcagaattcagaatagcaaaggccaaattttgacaaagtctggatgaaatatttgctaaacatacttccaacgaacaaatcccaaacaaacatgacgaattctcccaaaaaaaaacagagcacgaaaccaaccatttccatgggaatacccaataacgagaacctttacatctcaaaccacttgggtcagatataatcagcaacaagtttcagtaaggcggaaacattttcatcacaatatgccgtagtaccttccaactcaagttacttggtcagagaggttctcaaaagctagattcagtagaatcacttcatcaaaactaagaacgagaaggcgggtaggaaaacagattctgctatttcataatctgagcatgaacactctattaagctttcagaaataaaggtacaatcggctaggctattacaaaactgacaaggtataacggatccatcccttgcacatgaattacgactgggcataggttctgcactaattcaacttctcaattaattcattgattttatcttcgcggttccctgagtcaccaccatccttgaagggtttcttcttcatctgcaacctcctctctggacacttgagcttgaagggcatgaggaaatttgaagcttctctgaagtgtgggccaactgatgcgatttcatgcacaagatcttccaaacatatgatgccatattctcccagagcctgttttcagaaaaaaagcacagatgggtatatttcagtgtacattaccaaaccatgagattgtcttcaacatcgaaaactgaaaccaaatatccttttgttttatttagagactgatgaaaatgtatcttatgtctgggaaattatacataaccgagatgataatcaacacacaaaaaaaagcataaccacagtgatttttacacttgtggaaggagacagaaatagctctaccaaagcagtgcatgcaacaatggaattgatcctaaatgaagtattgtagcatgccaaatttgaggtccagaacccaacaaaactattagccgagattaaagaatcaggtttcagacagcgctacacctagtggttttatataaactatatctccaaaataagccagcccaattcccatgctcattgcaaaatagcctgttgtagacaaatttactaatgccgtgcaacctcaagttttataaggtgtaacaaaacaataccttctcaatgagatcattgctggtaagagggaaaggttccttgtccaggaacccacggcccttcttgtaaataagatccttcacattcttcaaatttgggaacctatattacacaacaataaataaaatttcagcactgcaagctacagatggacaaatcaatatgtttttgtacaaaagaactgttaatagagaagcatgtttgagttcagttacccataagtgataaacggctccacaacaagaagcctcttcatagtagcgtcagtggccttgaggaacacgccggtgaggacctgcgtcagccgcagcttgcgcaaaatcctcctcatgtgtggatgcaagtccattgtgctgcagattacacacaaacaaaattgttaaaattgtgaaccgcaatcatcaccaatgaaaagagacaaaccttgcagaaacaaaaacaagaactcctcatcacttgtactgctgctaaaatacagtaataatactgacccagggatgcgaatcgcgaagacgagcttggagttgagggtctcggcgggggggagcttgcggaccttgaggcgggtcttcatccggacgaagtcgagctccttgttgcggaactccctgacgaagtcctcgggcctcttgatggcgcccttgccgtcgtcgcggcggcgctgcctcttggccgccttccgctcccggttcttgaccgcccagtcctcgttcaccttccgcttcttcagcaccgtctcccgcacgtacggcagctgctgcgtcccctcctccgccatcatcgtcgccgctatctctacgcaagcttcgccctggacgacggcggcggcggcggaacgacgcgagggagaagggtttcggggatcggcggtgtctgggtctcaccgtcttattatggccttttcatctcttactgggccgggctcacgaaagtttaggcccattaatgatgtgtggcccagttgtagtgggcctgttgggctttttcttgctggttggtgtggcccagttgtagtgccggtcaggttgggtcggcggcgatgacacgtacaagaacagtcgtcgtgactcaagacgacgactcactcaaaggcagcggcggcgagccacgcctccgccgctctctcctgctcttcagtcggcgggcgatcgccggcggctcttccggcgaactcgcgagtcgcccccccccacctcccctctagcctgtactaaggaaggtatgtcatgtgaggggtggtctatggtcgccgccgcgccatggccacgagcttttcgtgttgattctagaaggtgcgcttattttctgagtggaatggcgaataagtgcactcggtgatgtcctgtgatttagttgtgcttggaattttgggtgtactgaatactgatgcttatgttcttcttgctgtgtcattcaggcttgtaataatttattggattttgataatttattcgtgcaatatggttcgcggttctgttgatgtggcaatcaaggagatggaggctttatgtatcggacaaaatcaagaaaccaaagtaggtgtgctgcactagtttcatctttggcgtgaattaaattgttttgtgcactaagcaatactgctgaccatgctttgcactaccatgttccataggtgataccgtgataatagatgtgtaacttttgaaaattgggtgccagacaatgatgcgaatgccgtttagaattaacctgttattcagtgtttgcagtgttctcatttattgatattgttagtttggttatgttcatagtttaccttaatatatccttgtaagttgttaccaatggcctgtttgctaatcttttttgttagagatcagaggtaccatttccataccaggagtttgaaagctatatgtatgatttcaatactccacctaatagtaaatgacatttggtttctaggatagctgaacctctcatggcttccatcttttcattggtccttggctcattgcctttctataaatttactttctattaagttaacattattattacttctttggctgcaggaggaagtcggttttgaaacacaggaggcctcattaaaagcaagcaaagttgcagatagcaaaggagctccgtactcaccaccagaaaatgatgatgatgcagaagtggactatccgtctcaagatggagcacaaggtgacaactctgacttgcaagctcttattgctgagttcctcagctagagttgaagcttttgcaattctctttagcacttgctattaaataatctcattccaagttaaaataatctcattgcaaggaacagtaatagctgccaagaagaaaaagaagaaaagcaaagcgaagtaagtttatgttaaattaagccattactgttccttttctttttagaaccatgctttaatttatttattctgtagaaagaagaagggacctcttcagcagacagatcctccatcgatccctgttgatgaactcttcccatcaggagaatttcctgagggtgagatccaacactataaggatgagtaagtatgcatttatcctcataaaatttgtttttttttacgcaatcctcataaaatttgtatataatagcaaacctggcacactaatttcttagccattttcacctctaaaaattcctaatggcaaattcaatggactgtaataacagtgagcatatgtttgcataaattaattgtgctattgctcatcagtaacttatggaggacaactagtgaagaaaagcgggaactggaaagattgcaaaagccaatgtacaatgctgttcgtcgggcagcagaagttcatagacaggtttaaaatttattgatatctttgaatatttgcgaattcatttgaatatgctctatatgttacaactctgaaacatatgttgtggtttgctaggtccggaagtatatgagaagcattttgaagcccgggatgctaatgattgatctatgtgaaactttggaaaacatggtcaggaaacttatcaaggagaatggattggaagctggtattgcctttccaacaggatgctccttgaattggtacggtattccagtattttacatttagtacttcgtaagttccttactctgcattcccttatgaaactaacgaaaacaaaaatgcaatgcttagtgttgcagctcactggactccaaatggtggtgataaaactgtactacaatatgatgatgtgatgaagctggattttgggacacatataaatggtatgtatattgtttgttatacgcgtcagagttttttgtggctttgtccttgaaagtataaagtcacaccttttctactgccaaaaataatttggtatttcgattcttctcagggtacatagttgatagcgcattcactgttgcattcaatcccatgtttgatccattgcttcaagcatcaagagatgccacaaatgctggtgttaaggtaattctctacacttttctgtgcattttctgaagccctcaatatagcaaatcaatgggcttggaaatggccccttaagaaaacacctttgtcatgtcacttgttaagggcttgttttaacggaatccattcatagttgttcattaaactgttagtcaaattgttgtgtagcatttatacagtttttttggctagttattgcatggtgttcttcactactgatttgatggatgtataatgaatctattgttttattttctctaaattgtaatagaatctaccattgtacttcagtagtgttttggttgttcccttcattttaggaagctggaatagatgcacggctatgtgatgttggcgcagcaattcaagaagtcatggaatcatatgaggttgaaattaatggaaaagtattccaaggttagtgctagtgcatctttttcccatttcacactggtaacgtaaagtgataagttgacaacgcaaattaaattattgctatgcggcagtaaaaagtgtgcggaacctcaatggacacggcattgggccataccaaatccattttgggaaatcagttccagttgtgaaaggtggtgaacaaacaaagatggaggagggggaattttatgccattgaaacttttggatctacaggtatgtcaatctatagcttaggttgtcacattactaatagttgaaattcagttttgcatcaaatataacaagtaactactaatatgaccctccttggctaaagtgtagaagttttcaagtgttgaaattatctttttttaaataatgtatatcaatccggcctctatatgttgaagttcttgaagaattttatgcttactgtctgtcataatgtttgcaggaaagggatatgtcagggaagacttagaatgcagccattatatgaagaactttgatgttggccatgtacctttgagggcagcaaaagctaagcaactacttgtgacgataaacaacaatttcggaacacttgccttctgccggaggtatctggaccggcttggtgagaccaagtacctcatggcactgaaaaatctgtgcgatgctggcattgttgaggtatgtatagaagtccattctctactccaatattgttgtaggccttgccataaccatattcgtggttgctcatagttgtatgctttaattgttggcagccatgtcctccaatgtgtgatgtgaggggaagctatgtgtcacaatctgaacacaccattttgctccggccaacctgcaaggaagtcatatccagaggtgatgattattgattgcaatggctgtccctcttgtactggttttgtgagatcattgctcgccattttttattttgggaaacctgtatacactgttgtatgtatcatatgatatcactatcataagataaataatgtgcagtaagcaccgtttgttgctgctgctgcttaccacttggcagttggtactctttaaataatttttagtggaagcttgatactatttcgaagcatagtcttcattttgctggaaatgtgccaatctgttgtattttggtttattggtatgtaggattaccatctaattctgatatgttggcaaaaagtaatagagtttccagagaaaaatgcaatagcaaatttacaatagaagagaagaagcttgaaagaggaggcccatattaaagcccatgaacgaaagcttagcccatctaattggagcccttctatgcctaggcccacctgcagcgagtgatgggggcatctcctgaaaactcgcgcgcatttaactaagggttaccagctcaatataaagtgtgtcttccctccccgccgccgccgcctcgtcgtcgccgctgccgccgccgccgcggccgcgcgagaggaacatccgttggctctagggactcgcgtggaagatggtaactattccttctgatccttccccttctccctagcgtagccggtttctaccgccaaagtgcgggtaggtgttactcatgccagatcggtctcaagatccgggatggtgtgaaggagagctgcgtttgatcttgctttgtgcggcatgtagcttggatattacgctgctgaggagatgccgctttgtctgtggcactctgttccgttatggtgacaggaatgtgggaggagattttgagttggctgttgcttcagtttatgatgttccgtaactttcctgtaaatctgtaattggttgatatgtgccacttgttattctattgctaggttcaatttgaggaacgagtgcttggtagtttttgcttgcagtggttgcccatcgctaccgtgttccgttttctattactccctccgtttcataatgtaagactttctagcactgcctgcatttatatagatgttaatgaatctagacatatattttagattcattaacatctatatgaatatgggcagtgctagaaagtcttacaatttaaaacggaggaagtaataattttatcaggctctgaagtttagttcatcccagattactgtaatatagcaattgttaagtggtatattgactggaaatgaattccaggttgtgtaatctacacccgtttacctagtttgtaggtaggatttctgtatgctcaccaggactagttatgttttcccaatatccctgtcatggaacatttattttcttcatgctactgcttgcgtggtttccttgatgtgcatgtaaatttcaaatgtgatatgatgctagaatggagccgattaatttgttatctactgtcatcctgtgtctaaactctaaactaaacaattattatgattccgtagccaaagcagattcgtgaggtcaaggacttctttctcactgtgagaagaaggatgctcgttcagtgaacatcaagaggagcaaagatgttttcaagttcaaggtcggctgctccaagtacatgtacaccctctgcaccttcgagctgagaaggcaaacaggttgaagcaatttatcccaccaggtttgtaaaaagtggctctagttctgtttagcactatctcatttctgtttgggtatctgagtagtttgtgctggtataaatcttgcttacaattttgttcttcttattgatgggcattctttctctgcaacatgatgctttgttccaatatgtttgttgtttataatgctggtattgcttatatctgttggttgatgtcccagtgacgataaaattttgctccaaagatgattattctctggttttagcttcaagccctctgtcataccattttgacacggatggcttgtggctaaaaccattatcaagaatcatcaatgatggccaataatagctatgagatctgagggacaaccctacagtacaacatattctggtatctcaattctttgttatccttggttcctattgaactggatgtgttattggagatgtcaacacattctggtatctcagttctttgttatccttggtttctcttgaactggatgtgttattggagctgtccccaaggaagataaaaactttgtaccaaatatggatttgcaattagttttagcttcaagccatccttcctaattcatatgatgtgtgtggcttttggttaaaactaggttacgcttttaagttcatcagtgattggcaatagctatgagatccgagggatatgggttatggttttttcagacaaaaaaaaaactattagcagatcaagaaactatttgagctgtcaattctgttttttttttaaaaatagagatgtttttaatgatgtagagattttctttatataaatttctgcatctgataattttgttttcattgatccatgtctgagcgtccaagaggtataaagatacaaaggcaacatcttaatgaagtatccaaggtctttggtgctgagaatgcaaacaagttgaagcaatttctcccaccaggttcacagaaagtgtctggtaagttgatgccctagcgaagataaagttttggtccaaagatgtttggtgtctggttttagcttcaagccttctgtctgaccattttgacaattggatggcttgtggctaaaaccattatcaagaatcatcagtgatggtcaataatagctatgagatccgagggacaactgtacaatataaaatattatgatatttcacctttgttatttgggatgtccccatgaagataaattgtttggacctaagatggatttgcaattagttttagctttaagccatccttttaattcttatgatgcatgtggcttgtcaaaactagttcaatttttaagttcatcagtgatgggcagtagctatgagatttgagggacgtggactatggtcgtttcagacacaaaaggctgtcaccttttgttctctgtctcgttttgtatggtccttcactgttctgaccaagaagctatttgagctgtctgttttgttttgtgaatgcagagttttttttttcatgtaccaaagttttgcatttgatgactttgcattccttggtccaggtttgagcatccaggaggtctgaagacacaaaggcaacatctttagtgtccaagtttctgtctgttagcagttcatgcaatgtgttgaatcttttggactcctaagcaaattagacctgcctgttcttgatctgtaatctccgctttggagaaaaggtgtcttttgccacagttctgtgatgcagattttcagcttattttaacccagcagattttcagcttattttagaaataaactgctttctggataagatttctctcttacagtttacattgcactgaatgaagcttttttttttgtcaaagtaccttctgggatgaaggtgatcaaatgcgatataaaatcgtcctgtgctgctgtcacgtatcaccctgccatatattctgggatctcaatcatggttcatagacgggctacagtgcttcatctttgattctttgtttaacttgtgaatcatgcatggataatataagtagctattaaatccttgattctcactggaagaattgaagctactttggccgtgtttttagtttatttaccggactgtgaaatggattactttgctccatgttttaaaaatatattttcttaaaagtacttcacttagactgcttattttaagctatttattaaatttatttctaaaaactatttaatttattcatatatttaagtagataatccataacaataatctaaggcaaacatcggctattgagagaaatctaactttctctgttttttttcgatgggccggcgaatagctggccgatgtatattaagagtaaaaaagggaatgtacaaggtagcgcggtacgtcaatgcaccaccattatagacataaaaagaaagctaaaatctcacagaatgagttgttacagagtgacatatgaggttaacaagtcgtgcagctatccaagtctctcattcatccgccccaagtcctgcagctatgcaagtctcctgttcatcccccatggaaccgttgccacgatcccttcgaacacccttgtgtttcactctttccaaatcaaccaggttacaaggatcacccccgcatcaatgttttatcgtcaaccttagcaacagatttttgggctgtaagccaccaatcagcaaaatcagccgacggcgctcgcaaaatctgactctgtgatttcttttgtgatgaagttgtactttgggcatgaaaatctttcactatatcgaaatgcacaatttgtaacttcaaactgccatttttcattgtctttgaaaggttaccactttattttattttacaggaggtaaaacaatcctataaactttcagttagtaaagcagcccgatgagatcgacggcgatgttacagtgcgtcgccgtcgtcctgtcgatgtcggccaccggagagaccttcgagcggcggacgatcatgttgtcgcacatgatcccggcgtagtaaccggccagctggtgcctgaccacgtcgaggtacgcgccgccggagctgtaggcgtcgaccgccgcctgggcctcgccggcggcgaggtcgtacatccaccagcactcgagcagcgtcagctcgaggacctggccgtgattctccaggaacttgccgtacacggcggcggcgctggacttcacggtggcggcggcgatgtcgaccgcgatgccggcgagctggtgcacggtggtggccctggcgctccgccggtcggcgctgagcatcttcacgcactcggtgtggttggtgcgcttgcacgtgcgggcgacgaagcgggcgtcgccgacgacggcggaggggagggaggcggcgacggagacgaggacgacgacggcgaggaggacggtgacggcagcagctggtctcgccattgctgaacccaactcagtttgatcgatgaactccttgattaattactctagttcttgtgtttgttgattttgctatgagtgttctagctagtttgtgtatatataggctttgaaaagaatcccaaatataaaaaaactcattaattgaagcatttaatgtttttttcccttagagcaaggtcaatagtatagccaactactgactccaaaacatctatagtcaatctaatagtctattcatacaatagctaactataaaaatatactacatcattaatacctggtcccacctctcatacacacataatatcttggagtccgtgttacagccgactacaaatctgtagcccgctttcttctctcttctctttttttctcgatatatggttatagccagcttatagcctgctattgtacctgctcttatggaatccaaataggagtaatgcctttgagcatccaatttgaggaatttaatactatttggaagaatttagtgtatgtatctttaatgaatttattgccttcaccccctagaaattccaattttcttgaggacttcattgtattttcctcaggaacccaaatgtttgtgtgcatttatttttcgtggaatccaatcttttgctatgaaatttattgtggattttttttctttttgaacccaattatccaaacccaaaccgtgcagaatattaaaaaggtcatatagatagaaagatggtgatttaacattggaagtacacatcttagagggacgtgactatacaggtagtggtagctccatctatgttagaccctatccacatatatttcaaataaaattttctcttaaactactcattcgatcgacgatccgattacaccgttgtgttcgtaataattactccctccgttttttaatagatgatgccattgacttttttttacatgtttgaccattcgtcttattcaaaaaatttacgtaattataatttattttgttatgagttgttttatcactcatagtactttaagtgtgatttatatcttatatatttgcataaaatctttgaataagacaaatgataaaacatgtgagaaaaagtcaacggtgtcatctattaaaaaacggaggcagtaaatctttataacaagatctcacatgattatattttgataaaaaaatataaattacttttataatatatctaaattacttttagatttcactaaattacttcttggatatataaaagtaaattcaataaagcctaaaagtaatttacatatattatagaagtaacttataacaaaaaaataactttaatgcatgcctttttttttattttggacgtgactacacagctagtggtagccggtttgtattccttctagtgtctcatttcaacttgaaaaatgcaatagtatgtatcttttttaatctctttaataacttatatcttttaaatcacatattgtttttaagatatatttatagagagttacttctgaaccatgcaaaagttacttccatttaacattgaagttatttttaaaaattgttaaactttcatgtgttgatctgtgctgattaaatttaatttctagatagtcatatttttatccctacaacaaatttacttctaatgtcgtgacaaagttacttccgttttattttaagttactttttataatatatgtaaattacttttagactttattgaatttacttttatatgtctaagaagtaatttagtcaaacatatgataaaagtaacttacatatgtaataaaagtaatttacaaatataattttatttcatcgtaatataatcatgtaagatcttgttctgaagatttaattgcaatgaacacaattgtgtaattggattgtagatcggataagtaatttgagagaaaattctataaaaaaaaaatagacatgcattgtgtgcactagtaacaactggaccttttctcacgtaactatactagcaacactggaccttctctcacgtactatagcactggaccttttctcacgtatgaatgcatcgctcttttaacactaaatcgagagcgctgtcggtttagattttgcgatcttagagcttatactagttataagtaagattggagctagtagtaaagtataggtaagctctgatccaatattgagcccctgagctttactcctttgcaactatactcctgtgcaaacagttggtgatgattcataactgctgactgaaaatggacgttagatgtctatgatatgatctcgttcagaagcagaactgcagaagcataagggtttgttcggttcatgcatgatcctgccatgatgcatgccatggcatgctcagttcgttgagacacattcagaatatggatggatcaaattgtcagacaactctttttatttaggagtacattttatttccatccaactagatggtttgatatggacacaaaaaatatctgaaactctgtgttgatcgttgttattaatttatctgaaaatcaatacagggatttgatgcacaaatacttgttacaaatttcacaccaagcacaatctatccaaatacaaaaatttggctcatacatagctcattgctaacatctatcatcacttgtacgtaatgggcatccatgtacatcatcggaatttttttccccaatggtttcagaaattacggcgtaggaatgaccagttgagcctcttgatgcgaacgatgcggttgagctcctcgcgaacggagacgagcagcacgtacgcctcacgtgcgccctccacctccacgtccaccacgtgctccaccgtgccggagtcggggtcgtagtagccgccgccgccgtcgaccacccgcacctcgccgccgtcgaccaccgccacctccttctccgtcgtcaccgtgagcagcagcacggccccgtcgtcgtcgacgtactccacgcaccgcaccgcctcgcggacgccgccgccgtcgtggagcgccgccggcaccgtcctctcctccatcagcgggaacacctcgccggcgatctccaggcactcgcgcgcgtcctcctcgtcgtcgtcagggacgaggcggcggcgacaatcctcgcgcgagaagaagagcggcttcccgtcgtactccacgcagtcgcgcacgacgccgccggacgtcgcgacgcgccacctcgtcagctgcggagcgtacagggacgccatggccgcgcgccgccggtgacgccggatcacaccggagaagctaagctaagctaaggatcagcaagtgcaatgcgctctgatcgatggcgacgatgagcttgcgatcgaattgcttgagctctcatcagggccagcatctgaatttatcatgagcaccaaactcagtgtggaattcggagtcggacaccgattccgagacacagtcgatccggcactgccgctcctgtgggacccacataatgtattctcctggagcccatgggcccatgaccagttcagtgccatcttgggcttcgagtttctattctccataggaataagttcatcagaggtcccttaacttatcaacgaatccaattttcgtccttgaccctcaactatcataaccggtgcagataagatccctcggcggtttcgatggtggttttggctaacgtagcgcctacgtggttattttgactcggtcttcatccgacgtggcactgatgtggcgcttaggtggcaattcagtctagaaaaataataaaacctgtgggacccacatgtcagtttcacattcaaaaatatatttaaaaagtgggacccacgtgggccccacatgtcatcctctctgtctatcttttttttttcctttttcattctttttcttcttttaagatggcatccggaggccgatgcgagcgccgcgccggcggagagggcggccgacgggaatggagcgacggccggcaggagggagggagaggagtggcggccggcgggtgggagggagaggaacggcggcgcgcgccgcgctggcggagagggcggtcgataggagcgccacgagggaggaggcgagctcgtcggggcggccggcgggagaagaggcagcacgcgccggccgacgggagggagggagaggagcgggaggtggctccggcggctgtgggcggaagaggaaggggcggcgagaggtggccctggttgcggctgccgttgggagaggagacggcgtcgatggtgaggaggacgctcgcggcgctggagacgcggtcgctaggttggtcgaagggtgagaagggagtggcgggggaggtgacgtcggggcgcactagtcacggtcggcgagcgcggcatgcacgtggcggaccggaccgagaaaggcagcggggacgacgacgagaggagatggagcgcgaatcgggacagtagacggcggcggcgtgaccccggtgtcgaggccgatcgaggtcgagtagcgtgaccccggcgtcaaggtgcgcggcgacggcggtcgcgtccccctcacctgccaactcaggatatctggtggtggtggtggccggcgacgtcacactacccggtctaggaggagcggcggcgcgggcggtcgtcatcgccggagttgcgcggaagatggggagttcttgttgttgccggacgggcggcggccggaggcccggagcagagtagcggagcaggccaactttgccgctatggatcgccgcggccacctcctcgctggccatcccactcgaacgccatcttcgtgcgcgctcgccgcgggccactgtttttctttttatctgaccgacatgtgggccccacattttgtttttattttttatttttatattttacttccagtgccacgtcaccgccacgtaggacgaggaccaagtcaaaccggtcacgtaagcgccatatcagccaaaaccaccatcagaaccactgagggacctgctttgcaccggttttgatagttgagggacctgttgtatctggttttttctggttgaaggacgaaaatcgaattaattgacaagttaagggagcttaagtgaacttattccttctccatatattgggccagatgactaaatgggccggacacagactttctttctgctgctctccctgtggtctactggtctcgtcgcagagcagcagcatggcagttggcctgaatgcaacgcagaatgcttactgtactacttgcttattgcagcatattcattcagggtttcagaaattcagtctcagaatgcaaacagttggattctctagaaatttcaggaccaacacatgtaatcatcgatatgaagcataaatcgcattgggttaaagttcaaagtcaaggatcacaaatttgacaacaaatcacggaaactatcaccagttgttcgagcgtagccagtttgcagtgccatatatactgccatctcttgtttccatcagaacctacaagctaggaggagtaccgattaaacttgctttgtaattgcatcccaccaagatatagttatgaattcatgacgaggagcagcacaaggcttgcattgcatggctgcatcatagcttaccatactccataactgttactcctagcccatccatcatgatgcatatgccttgccatgctctcttcagacttcagatcatggattgattcatcgatcgtttcgtcagaaaccttagttccccaaaaaattttcctaaaaacatcacatcgaatttttgacacatgcatagagtattaaatatagatttaaaaaactaattacgcaattagaggaaagattgcgagacgaatcttttgagcctaattattagttcataattagccataagtgttacagtaacccgcatgtgctaatgacggattaattatgctcaaaagattcgtctcgtggtttccaggcgagttatgaaattagttttttcattcgtatccgaaaaccccttccggcatcctgtcaaacatccaatgtgacaccaaaaacatttttttctcgaactaaatatgcccttattttgatttcccatataggattacttcctagtgccattcaagcaacgatcactgttcagtaacagtacatcatgtcgcactctaaaaagcacataatttatctgaaactctgagtagatctgttgtttctttggagtaacagagattcagacaacagaatgatcaatgcagcacttacaggtaggaaaaagattggatttggggggaattgatgcatgcaagatgggagtagataatgctctgttcagaaagtcagaattccatgcccccacgcatgtgacatgtagcaataccaccatccatatccactgcctactcaagtgttcctcatcaactgccattttctccttattagataatggaataatcctatcaacagtccatggaacacagtaatttcacagtacctacctaccatgacaagtcataaatatttctaaaaacattccggtgttccaaatggcacattaaatcctgaattaatgtgcatgatggatcaatgggacagatctagtacatgattaatatttcaaaacaacaaatttatctgatctgtaaaattatactcctactcctgtttatttcgttacggttgtctgcatgcagtgtgatgcttgcctgtcatccagtgattattgcagaagcagcagcagcatcacattcacatcccacgttggcgccgacatcctgtgcagcagccacatgcgcatgccaaaaccgagaggtattaaaaaggagattaacttagcataaatccaagattaaatccgtttttgtatgcgttgagattggtgggaggctgggagaaagcacatgctcaccaaaccgtttttcagttaagccacagttgttgtgatgtgtgatgatctatatggaccatccatgcagggctaggctgcagccatccatgcatgcatgaaccaatgcaaatgcttttgataatatgcagatctgaactggttaattatttcccagaaagctactacagcctaacatctctcactctcaccatcatgggtgtcacttggttgctttgctgccagactgaaagttttaactgtccagaaactagaagcagtcgagtctgtctaattactcttgtattttggttatgtacttttgatttagatgtagaggctgggttttaatcaattttctaaaaaaatatatacagaaggtattgtacatatggatcaagtggttttacttaactcatctgaaagaatgaacgaattaagcaggtttgttcttggacagtactacagtgatgccttgcaaattgagcaaaggcaggcaaaacaagtacataaatttccccagattaatggagtgagacagctaatagtactattatggtactgttagtaccttgctgccactaattcgaggccattttttatctgactttttgtttcttcgagcacttgggttcagaaccgcatggtttttgtttttcgtttcgagaaaaagtggagctctgttccttgcttttcaagtgaacttctgcaatttccatcctgttctgcttcagaattttatttgtacatacatgaatgtgaaagatatcaaatgtgtacacatgtttgtagtcttgtagagagtatgatcaatgatatcaactagctgctgcattactagaaccacatgcagataaggtcgaactaaaccaaatcaatgataaaattttgagttattaaaactaagtactttggctggtgcaatgatatcgacggctccaatacacgacgacataatacaggcataaaaatactctggcaattagtttaccaaccggcaatgcaaattatacgacagtggttaggagatccctatcaattaatcatcggcagcgactgtattattctgacgcttgaccaaaatgggggctggcctgaacattaatcattttcaggaaaatgtacttatctgaaatctacaaaatatcaatgtgtttggttaaatttaaccctttctataacatggattagttggagtacattacaatctgaagtcaaactggagtactgcagagacagactgtcggtagtccgatttttgattctgcgtacagtcgttgaccaaattagattggaccatttcatggttactgcagtctgcaggagaaagaaaagaacacttgatctgcactcaagcttgggtgcttatcttaagtcacaaccaaccacatcttaatgacctgatgaatatgagatgagcttggtgcttttatgagaaattgacttctcccaggaggtcccaccatgtcagtttctaacccacaaattttgtacaaaaactaaataaattcttgcaaaactcctactattactacaattttcttagacaacagcacacaaaaccttactatatcaaatactctatccgatccaaaatataacaacctaatacaaaataagacacgtcgtactactacgaatctgaacaaaacccttgtctagattaatatttactagtatctttatcttaatttgatcatcccctaaatagagggcatcaagaccaaatacactaatccaacattctgaaattaatcctcatcgatcaaaggtgctccgtcgcttcatgttcaacaagttaattcacactttaaatgttgtatgggttgaactaatagaaatcaatcttgatttgttgtatgcatgtggggcattcacaatgcacatgtactctttacacaaataaaaaaagaagcaatttattaaataattattattttgaaaacatcttagatgatgattaaattgggatgaagggagtagaatatactcctatctctacttcgggtgttatattttaggttggaggaaatagagcttaagcttgtaatatgctccctctatcataaattgtttagaacacgatttttcttttgctttaaatccaagtatgccaggaaatatcgatgatcgatattttgaaagagcaatcgaatctcgttctaaaggtcggatatttatgacgtgtattagggcttttgcattgccattgtttacccaaatgttgtaagcataaaaccatgtcaagattgttttttaacttttgggtgaaaactttcacagttggagcagtaactaaaagaaaaaaaaaaggctttccctttctccaaattgtccttggaactccactttgccccattgaaaacgacgcctgacctcaacaatagcaccacccaggcacccacccactgacttcccgggccccacatgtacaatccctacaatcgagagagagagagagagagagagagagagagagagagctcgaagcttttcccaaataactttgccacagtgcctcctgcttcccccctgtgcttgcagacttgcagcgcagagctcagcgtagcgtgctctcgcctccacactccacaccacaccacagtcgcctctctcctctttcaccgagaagcgaagcgagagagagactggcaccgccgcaagaagccaaccggcgggggagggagaagcagagcaagcggcagaaagaagaatcattggttaggctctgcagaggagaggcggcactgcactggaggtgagaggctgagaacgagaggtagaagaagaatcgggagaaggatcgtcttcacgggaggagcaaggaggggataattaggctcggattgccattaggctgaggggggattcgcgaggcttgtgttgagaggcttgagaggtgtgtgctcgcgtccctctgcttcttcttcttcttctccatcttactgtattctttatgctgcttctagatttgtctcttgtatctgtgatgttgatggagttcgtcagaaatgtcccttcttttcttctcttcctcccatgatttcttcgagcagcatctttctatattctgttctgtttttcccccctctgaagtacgttttggaactatgatgattccataacaagttgctagtcgaagattgcttgttactctatcgatcaatggcagttctgcagctgctgcttaaaatgggttcttttgctcaagatttgattgtgctttctccttctgtatctctgttggtatatagttctgggacaggtccactttgattctatcatgggactcctatttgattgtgtttgaggtcctcactggatctgctcacaccttacttgtactcgtatagtatcccattcggattgaattaaatgcatttcctagaaaaaaaattgctctacttagtccttgctccttgcagcctccatttcgagtacacctctatttattcgatgcttgacttcattccaagcagtattgttgggcagctaggtgtacttgtcttctcctttctgcactcaaaatgttgtagttaatggcacctttcgtgctcattgagtttggtatgctttttatggttcagcaaaatgggagtagcaaattgttgtgctttggtttcaattccagtgacaatttccagccatattactagttagcatttactgacaaaatgcattggtttcgtgttcactgtgagccatcaaaacggtttgtgctaccgacatgttagcctggattgagtttcactgtaaagttgcaacctttattacatttggttgttggtgatttcattttcgttaggactacccaggttgtcgactattaactcattagacttttgtcactttcaagttctaataattctttgaagtcctctgtatgattactgtgatttctgaattgtgcttaacatttgcaggtaatgtgctttagagtcgacagcaatggcttcgctggtacccggggtccttctcaagctccttcagcacatgaacagcgatgttaaagttgccggcgagcaccgttcgtcccttcttcaggtggtcagcattgttccggcccttgcagggagtgatctgtttaccaaccagggtttctatctcaaggtgtccgattcctcgcacgcaacatacgtttccttaccagaagagcagcatgatctcatattgagcgacacaattcagttgggacagttcatccatgtagaccgtcttgaggcagccactccggtgccaatcttgaggggagtcaggccagttccaggtcggcatgcttgtgttggcagtccagaagatcttgtggtaacaaactccacttttctcggaagtaagaaggcacaacaatccatcaacgggtcaaaggatgccagtactttatcactagaaaaggagcagagcaaattggagaaattaaaaccttcagtgaaaaacaatggggcagaaatcaagaaaccacagttaaccaaatcaaactcttctctctcgaaacaagcattgaatagcattatagacaagaaggaagtagtcagctcaaagacaaaacctaccagtgctaggtcgacaccttcatctccgaccagcgtttattctctaccggcatcatttgagagattctcgaatgacataaagcagagaacaaaatcaaaaggagcagataagtcatcaccttctaggctttccttgttagagaaagctgcttctgttttgaaggctactacagcagggaggaagtcctctgcaggtaacttgcttagtaacaccatgtcaagtattgaatcgggaccaaaggccctgagaagaagctgggaagggaatgcagaagcaaagagcaaaggaaattcagattcaaaggcagccaaaactgagaagaagtctgagaatagaagcacatcggtacgtgcggttgttgtcaacgcttatcagttatatttgtctacaaatgtggcgtgatttactttattgagtatccttcatgtagtacttaagctattgccttaagcccttaacacattgtagcctttcagtaacatttgaattcatgtttgatcctttattgcccatcttttttttttccaaagttactaatctttgctggctcttttgttatcagactccaagacgcaaaccactagtagaagagaagccattgcataaggatgacagtaagattcagactcctccaaggaagagctcagcaagtgccccttcagatgattctgagaaaatagtgaataagccttcttctcctttgaggaggacgtctggagtttcaagcaacacaaatattacaaatctagtgaagattgcttcaaacagcaaaaagttgacagatgctagcgcttcatggacatcacttcctccttcacttgctaaattagggaaggtatgaatatgctcattcacatgttcgcataggttggctcattgatgtgttcactatggctgtttgctacaataggtctagcattgcaaaaccttttgcaattttgagggtgctaatttaatttttgtctttgcacaaatatatacttaacaaaagaaacgatggacaagccctgttttactatgtgaaatgatggctccagttcccctgggcatcaacaaagcaattttactataccattttagtcatactgtccagaggattgaaggatgaaagaattggagatcatttttctctgtagctgttgaatgcttcattaatgtcatattgaatatttaattgcatccaacttttcacaggagcttctgaagtacagggatgcagcacaaatggctgctgttgaagctatgcaggaagcttctgctgcagagaacttgcttcgatgtttaaggtaattttttcactgacatatcctttgtgatgttgcaactacaaaatctataatcagcaccatttcaaggtattgccaactcctgatatttcaatgatattgaattgtttctcttgagctattccttgacttcttagtctgatactgatactacctaagtactaaccattagtatttatttccaaattgtgttttgtatgcatagccgtatgcatgtgcatcatcgctgtagttattttgagaaattttgttaactttaaggtgaaaattcttcaagtcaactgcttgcgccacactatgctcattaacttgtttccagcctaaatatgtccttatggtgtgcgtaatatgtgcagctgatatgatctgccttggattttcttttttgtacttagttcaaatttgaacccaaagccaaagatttgaatccaagccctccctatccaaacagggccttgaggattttgttgcctgtcctagcatgttgtatgcttacaacaagcaattttatggataagtttcaagtcccacatggcatctaattattaacatggttgataatcgatggctctcttgatgtttatatcacatgggttctaaaataatcgatgaccaatcggcgtcaggtcgaaatacctcagctatagctgtcaagcaagttgcaatgatattaccaaccaccaattagctccctctccttttgatccatacaaaggcttgattatgtctgcacatgcttggaatttagatttcggattgagcttgtgttcctgagtgctctacggacagattgaacaagttcctggagtccatgctagcaatgcatggaacagccagctgttcttgtctgaataaagctaggctgtatagtgtttatcttctcaaacagtctgaactgctgattcctgtatcttgacaagcattgccagacaagaactcctaacaattcagtacttgtcactgcaatgtactatgaaataaagtagtttgcactttctgctcacacactggtgcttgcagtgctctgacagttctgtgcctagtcacaactcacaaatagtagtactatggtaatgtcaaatgtgaccttttaatctgatcaaaatgtgtgttttactgatggtcccatcactgttactgaataatgcatggctgattgtacagcacaaaagttcagatttctgcaacctttttaccatgcactgttgtagaatttgtgtactcctccctctgtttcaggttataagacgttttgacttttggtcaaagtcaaactattttaagtttgtagaaaaaagtagtaacatcttcgacccaagacaaatttataatgaaaatatattcaattattgatttcggattgagtttaaagcgtcgtatgacctgaaacggagggagtagttaggaatggtgcatttgttgccgaaacaacaactaagaaatgtcctgtcactgttgtgttgatctgaatgcttatcaaatgagcttttatctgatcaaaatgtgtgagttttactgatggatcattgttactgaatgctgcatacggttacttctacagcgcagaagttcagatttctgcaacatttttaccttgcttgtgtcgttactcgttacgttcgttgcagtaataacagctaagaacttacctttcactgttgtgttgatctggatgcagctcgtacgcggaggtgagctcgacggcggaggagcagaacccgcagccggcggtggagcaattcctggctctccatgcagccatgtcccgcgccaccgtcgtcaccgactcgctgaccaaggccacggcgacctcgacggcgacttcaccggaccgatcaacacccagtgaagccgcagccgtcgacgaggagtcccttgccgtcgcggtggagcgccggcgccgggcagcgtcctgggtgggcgccgggctcgccaccgacctctccgcgttctccctttacaacctcaagccgccacccgccattgctgcctccccgctggccgtcgtgctcgtcgacgagtcggcgagaccggcggcggcgacgaaggcgtcgccgcccgcgaagtcgcggctgttcccgcccaaggtcaaggggagggtgggacccgtcgctgcggcagtggcggcggcgcctgtccctccgccggagtgggagaggggaggcggcgcggaggagaggggcgagctggcgaggcggctgggggaggaggcgagggggtggttcctggcgttcgtcgagcggttcctcgacgccgacgtggccgccgccgccgcgccgtgggatcgcgaccgcgccgccaggatgctcccgcagctgaagcgcgtcaacgactggctcagcgagatagcgaagcccacggaaccgccgccgccgcaatccgacgccgacggcgaggaggccggcggcggcgcccccgccgttgcgaatggaggcggcaacaccgtgccggaggagacgatagagcggctgcggaagaagatctacgagtacctcctcaccaacgtcgactcggccgcctccgtgctgggcggcgccggcgcggcagcgaacgggaagagggtctgagcgacatgggccgtcagatcttgcacgaatctcgaggccagcatggggaggcttaactggcctcgcaaatggggtgagttgtggcccgctttcgagttctatctagaatttctgcattctctaaaagagcattctaaaatctaaatttgatgcggaaaatgaaaaagagaaggtaatttgtaatgataatgatgtatacagtaatacaattgattgtttcgattgttgaaatgaaaaaagaaaatgaaagagtaaattacactcgtaatacagggacaacaacttagcacgcaacccttgtcaattccttagattgtcttcctttcttcactttcccaactcatctctttcatttttcctacgccttttcaaattactaaacgtgtttttttttaaaaaaattatatacgaaagttgtcttaaaaatcatatcaattctttttttaaaaaatagctaatccttaatttattatgtgttaatgcatacattgttttacgtatggataggagggattcccaactcctttcgtttattagaacaaacttttcaactaataaacagatttgctagaaaacttacgcaagttttttttcccatctacacatgttgcgcgtaagattttagtgatagcttgtgtagtagttataacgtaattactgtcgaaacaagattttggcaataataaaagggggtgactatcaagctaagaaagtggatgggtttagagacaaggaattttatacaggtttaggccttcttattcaagaagtaataccctactcttgtccggggatgattccgccgagtgtattattgattgtatgattgggagaaaaaaaatcgtcccgagaggaacctggacccctccttatataggggaagggatccgtattataaagtacagtccatatcctaacggaacatgagattacagataaaatacaatcgtaaccgactaggatcccgagtattttcttaacatacaagtttagaatctaacccgagtcctcataaagatattctatctatatttggtaccatatatccagctggaatgtaaccgccatgtagatatggggtaaccataatcttcacagtagcccccgagaccttcgcagttgaccaaaatagtcttctcgaaacaaaaaacaataatccgagtgcttcaattcaacttgctccggcttgccgagtgctaaaagactgcgaagggcgaaaataaaacatggtgcatcgagtagatgcacctaattaggtgtagcccccgactatgtgattagttgaaaaactaaacatatagtcaagaaccgggtgactttatatcgaagcatgcatggtactcaataaaatacccagccgactacttctcacttgaatatatcaaggataaaaaatatgaaaagggccgaatgataaacactcaaaaggtccaaaaatagatatatttggtaggaatccgagtaagaaactcttaaaatgatccaccaaatatgataaaggtcatggtaattaagaagttcattagcctaggctataacccttaccataatcaaaataagcatataacatgataggagaatgactactaataaaccagtcatctcaaattaacccaatagcttttgtagcctaaaaaagcttacaaaaatggtataacacctttctgtcgggcaccttttcatgtgcatcataataattccaaagaattattgaatcgcgttaaaaaggattttaacagcatcgggccgcgtcattgtgagcacatattgccaaagcaaaaggcacctaagtccctagggatcacaatgggccacgctgaaaacataattgggctgaagtactgtacaggcccaagcccattagtactcccgataccctaaagacaccgaagtccaaacgtcgtttcgtcttccctgccgagactctcgccattccccactccgtgctacagtacagaaccgcaccgacgaagctagggttcatcaatctgctccaacccaccctcaaaaacttcacgaaatttctccccgcgtccaccgctccgattccccattcctctccagccatatctcggaccaaattaaaccatccagttcacattcatggcggaagaaagagaaagcttcgaaagtcagtgggcgccctccgatgtgacagaagataacctgaaggagatggtggcgcatggcgttctcccagcgaaggagattatcgggtggcgaccggcgttcggcgaagcattcccgacccccgacacacacgaaatcgtggtattcgctcatttcttctatggcggattttctcttccaacctctagattcttccgggggattctgaacttctacgggattagcttgcatcacttgaatccaaactccatagtgcatattgccaattttatccatgcctgcgaagcttttctgggcattaggcctcatttcgccttgttccgccgcatcttcttcctcaagccccagccaaacaaaagcaaaccatgcgttgttgggggagctggtttccaactcagaggaaccttgagccaaaaatatttctccatgcccttcaaaacctcaaacaaaggctggcatgcaaactggttctatgttcagaatcctgagcccgcactccccgagtactgctgtcttcctccggtttaccaggacacatggaactcattgcctatgggagatgaagctgctcaggcaatggaattgatggaacgcatgctaaaactgaaagaacaaggtttgcagggagaacagatcactcagcacttcatcaaaagtcgattagctccaatcaaagagaggtcccgcacaacttttgagtttgatggcaagcatgatccaaatcaggaagatccagattctcttgactttaaggtcatgaaagaaagaatgtacaagatcttctcaaacgctattgttgtcagctattcacatctgctgcccgttgtgccattcaacgcattcaaccctcctccaccggtatgcactcaaacatttcaaccttcctcaaaagtatgcttttaccctctgttaagctaattgaaagtttgaaatatcatgcccaggaatttgctttgatgaaatcggatcctccaattgctcaacgccgatcacctcgccagcagactggtcaggcgagtggaggaccaaaaattcgatctgacgctcgaccaagtgcttccgatccactgttgaaataatactaacagcataactcaaactcgtaggaagccgtctgacatagatccttccgaaaaggaccccgagccgactgacatagaggcaaacctttcaaaagaaaccgggccagctgcagaagatcgtccgagtgacaaacaaccggcaaccgacaatgtagaagccagcaacgagcccccgactgggaaccagtcggccgaaactgaagtcggtgctaaccaggagcccccgactagaaaccagtcggatgcagggtcaagccaaaagattcccgaagttgaagctcaaacgaacagtccgctcgggaaggatgctgacaatgaatcagaaaccagatctcctgtgaaggcaccaaagtccactcgtccccgaccgggaatcatcacaggtagacatgccatctgaaattattttgatccaacagactttatttggctgcttcatcttcgttcatggatacactagggccaataattggtgatgaagaagagatcctccggatacaagcagctgaggattcacaccctccgattctggtcaagtggtgggatgacaacatgcagcctcaagggatcgtgataaataagcaaaaagaggacgaagagttatgcctactgaagaaggcacttggtcaggcaacccgcattgtaaatgtaagccctctggtacctgatctcaaccatcttgtttgccatttaattcatgcgctaattaaactgtcttgcagaggatttatcttaggaacgaagccaaaacggtaaccttagagaggttagtccctcatctcgggaccctcgaagccaccaggaatcgactgcacgaagcgaaacaacttgccaggaagaatgaacatgatctgagggatcggatcgctgatctccaggaatcaaattttgaactgagtggctcatcaaaaggtacgcacaaactctgctcaactgactcatactgttatctttgcaatcttgattaaccgtaatcaatgtagtgcaagctgccaagatatctcagttggaaaagcagattcaaattctggaaaatgacaaggcagaactggcaaaacaaagagacctggctttaaaggaagttgaaggtatcaacaatcaatacctcaaaagccattatcctccatatgctgacttattaatgtgaatctgttgatgcagaccgcaagatcaaatctcaagctcaattcgacgtcctggttggcaagatcaaaaaacttgagggagcccgggatgaggttgctaacgctgctgccccaattgttcaaccgatgttcttcaataacaacggcccgagtgcacttgatgcttctgaaattttcgacaagctgagagttgctccggatacatatttcaagaacatcaaagaagctggaagtatgggagcaagtctggcgttggcgatgaccaaatccctttatccaagagttgatattgatgccattgatggctttgcagacgggatgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgctatgcttaatatcttaacttagttcctgatttcttaaaagtttttgtcgaaccttgttgagcctaaaacccgcaaaagttgttaaaaaactttcagtcctcattgactaagccaagaaatcaaacagggcaatgatacatcaagtaagcaaattgaattgataaaaatcacactccattattattatagtagccccctgactgaaaacttcaagaaaaaacttgaagttagcagtcaaagaggaaagatacaaacgaaatgcctaagcgtaaaattgacgaaggtgttcaatattccaagaattgttgatgagagtaccgtcttcgcgcttgagtcgataagaacccggccgagtgacttcagcaattatgaacggtccttcccataagggagataatttatgccgatcctgtgttgtttgaattttccgtagaaccaggtcaccgactaaaaaggctcgcgatcgaacattccgattatgataacggcgcaacgcttgcaaatatcgagtcgactgaattaaagctgcttctcgggcttcttctagtcggttgatgttgtctactcggccctcttcatagccctcctcattgaagttccgaaatcgtagtgattcaaattccacttcactcggcaacattgcttctgcgccataaaccaaaaagaacggcgactggccggtagcccgactaggagtagtgcgtaaagaccaaagtacggacggcagctgatctacccacttgccagcataggggcgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaacgctccgccaatgaattgagtgccattatcagtgatgatccgattgggtaccccaaaccgatgcacaatgttgatgaaaaaatctctagctttatctgctgtgatcgtaatgaccggtttagcctcaatccacttggagaatttgtcgatagtcacaaagagatgcgtgtaaccgccgactgcccttttaaatgggccgaccatgtcaagcccccagaccgcaaacggccaggacaacgggatggtttgcaattcttgggctggcaaatgagtttgtctggcaaaaaattgacaaccttcgcatgtccacacaatcttgtccgcatcggacacagctgtaggccagaaaaaaccttgccggtaagctttgccgacaatggtccgtgcagcagcatgattaccacaaataccagaatgtatatccttcaacaattgtctcccttcctccaaagatacacagcgctgcagtattcctgatggacttttcttgtacagtttagcttcatgaataatgtaaagtctgctgcgcctggaaatccgctcggcttcatttttgtcttgagggagttcttgtttggtcaaaaattttatgaggggttctctccagtcggcttcaatcatgcttacgccttgagtatccatggcttcaattgcttcttttctgggcacggttggttcataaagatgctcaacgaacacatcagaaggggctgcttcccgttttgaactaaaattggccaatctatcggctgccttattgttatgtcgaaggacatgggtgagctcgaatccatcgaatttatcttccaacttgcgtacctcttgtcggtaagcggtcatattatcatctagacatgaccactctttcatgacttgattaacaaccaactgagagtctccacggacgattaatcggcgaatgcctaaagagattgcaatccttaatccatggagtagcgcctcgtattccgccacgttatgggacgcagaaaagtgtatccacaatacgtagctcaatctttctccagtcggggaaatcaagacgaccccagctccagtgcctgtgagcctctttgacccatcaaaatgcatagtccaatattccatcttttcctctggcatgtcttcttggcactcggtccactcggcaatgaaatcagctaaagcttgtgacttgatcgaagttcgtggcttgaacgatatgtccaaatacatcaactctaaggcccacttcgcgatccgtccatttgcttcgcgattgtgaagtatatccccgagtggaaacgatgtgactaccgtgaccgggtgactttgaaagtagtgagataatttcctgacggtaattagggcaccatatagtaacttttgaacctgaggatatcttgtcttggagtcggctaaaacctcgctaacgaaataaattggacgttagactttttgaacatggccttcctcttcacgctcgacaaccaggaccgcactcataacctgggaggtcgccgacacatataatagtagcggctcttgcggatgtggcgaggccaaaactggtggagtggtgaggagtttcttgaagtcttcaaaggctttctgtgcttcgggcccccactggaaattgtcagtcttcttcagcagcttgaagaaaggcatcccccgctcgccgagtcgtgaaacgaaccggctgagcgccgccatgcaaccagtcagcttttggacgtctttttgggagcttggcggtttcatgttgaggatggcgttgattttctccgggttggcatgtatgcctctttgagataccataaatccgagcaatttccccgacggtactccgaagatgcacttttccgggttcagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggtcgctcctacattcttcaatccaaagggcatggtgatgtagcagtaggccccaaagggcgtaataaacgaggtcttcaagcagtcggattcttttagttggatctgatgatatcccgagtaacagtccaggaagctaagtaactcgcagccggccgttgagtcaaccacctggtcaatgcgaggtaacccaaaagggtctttgggacaagatttgttgaggtcggtataatcgacacacatgcgccattgccccgtctttttccgaactaggactgggttagccagccagtcgggatgaaggacttccttaatgaagcctgctgctaacagcttggttaattcctccttgatcgcatccttcctgtcctgttcaaaacggcggagtcgttgcttgatgggtttggcgtcttccttaacatgtaaagagtgctcaatcacctctctagggataccaggcatatcggatggtttccacgcaaaaatatctttattattctgaagaaaggtgatgagcgcgctttcctatttacaatctaactcagcgcctattacatcagtcttatcaggatcggagggatctaggggaatctttttcgtcttggcatcactttcttcggtcttcgtcagcttggttgcaggcacttctcgctcgcttgccgtggtcgcagccagtcggatctcttcgcgggcgagagcagtctcgtgggtttgggccatctcgcaactttctttgtcgcatgtgacggcctgcttgatgtcgctccgtagtgatatgactcctcgaggaccaggcatcttcatcatcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaactggaagagtgatctggccgagtggtgtagctgacaatcctgggataacaccgtggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtactagggggtatcgccccgggtggaccactcggtcgggatgatccgagcggtcgaacttaattgctatctctgaccaccgaagatattggggcatgttaggctgaaccgcatttatctcccgttctgtcagcttttgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctctgcgaactgtttgtagacgaagcaatctttggccacgtggttggagttgggatgatgcggacattgggagttcattatcttgtcgaaggtgttgacgcggggacgttgtcgggaagatagagaggtggtcgccacaggttcttcgggcttacgcttgcgatccttgtggttgttacttccactccctcctacagtcggcgtgtccttctttggcttccaagtggtgcccgactgtttggacgtggtgatagcatcttcggctttggcatactcgttggctttttcgaacatctgcttaaccgtcctgggaggtttacgtccgaacttgccgactaggtcctcgtggcgaatgcctttagtgaaggcggtgatgatgacgtcgtcggtgatgtcggagatcttgttgcgttgttcggagaagcgtcggatgtaatctcgaagggattctccagacttctgaacgacgttgtagagatcaaactgtgtgccgaggcgttcgaaggtgccctagaagttagcgatgaagtaatcacgaagttccgcccatgatccgatcgtgccacggggtagtccgtggagccaggatcgggcggagtccgctagggccacaggtagatagtttgctcattgttatgtcgaaggacattttaattatactatcattatatctgaaagttttttttactaaaaatacttgcggcagatttttaagatattctcactaataaaattgtgccatccctctcactacacacagagcgggcaacgagacgcacatgcagttgctagctatcaacggtaccgagatagagtattattaggtactactccacagagtgttagtttagtgatattatacctcctaaatcccgattagcactagaaatacctcgacctcataataccttttgaagaaccgaaaatttcccttttcctactgtttctgattttacactaagcacattatgttcattcggcaacccttgtcggttccttagaacaactacatgacagaactaataaaattttgttttttttttaaactaggaagcagagctcccccaatttcattaagaaaaatgagagctacaaaagtctttacatgctacttaaagcagtctaataataaaattttgtactcaacacataacatacttgcccacaatctacagccgaaaagaattaatggtccctctagatcgatatactgtatggtaaatcatttgcttcatcatccttcttgtaaaagatgtggaaaaccagaagaggatgtatatatatatatattcctatgcatgctttcactcatcatcaagacctggtatgtacaataagttgacgtcgaacataactgggctgcttggagccactcttggccttccaggagctgaagtaaggcccttcggaaatgctagctgttcagatcaagaaaaacacgaaaaatcaaattatcaccctcctttcaaatctctgtgctaagaggggaaaaatgatgccatagcaatggctgcaattgtctggccccaaatttaccacatctttcattttctcttgcataatatttgttgacattggggagtttaggctacttaccgggccaggtatgtataatcgccgtagtcctccaaccttcattgacaatatcccttcatcaagtccctttatcacctaatgtttaccaccacaaatggatgaaagaaaattgaattgtttttaaagcattttagttagaaggcgcataatgtgttttccagagggtagtttggttactgatagtgtaccaaacattttcttgcaaaattacatatggtgaattcatgttttattaataatacgaactatacatttttcacgtagcattatgtatgttacattagtgtatttcatgtgcaatttacacattagacataccaagagttttaatttgaaaaccaaaaaccagacgttaaccgacatgttccaaaaacttgttagcagcttgttaccctcaattactagtttaataaaatattttggattcaatctttttccagataaaagtggtaagcggtcggttaccctttctcaaagggaccagttggtattttgttctgaaactaatattcaaaacctttgttcgtactctttaacatttaagttttaaatattaattcaaattgttctgggctggtataccgatagccagtcgatggcttaggatcggtaagtaccagtaaccagccgagattttgattcattgtacaaacacgatcaaatatataaactgtatatgactgtaaattgtatatttacagtcatctacagttcatatatttgatcagtttgtaattttattactcacatttcagtggtaatatttcagaacacaggctaccaagtaccaacaggaatatgtagggaaaaaaaataaatacctgtcctgaaccaacacggaatatgtagggctgccccttttccagagaactgtatacaacacagacacacaagaaaatttcagcttgcagcttgcaagtgtacttgaacagcatcaacttaatctcgcctatataaaagatggttagtttggcatcaaaagctcagttcgcacctgtcaaatatctgtccattcggtaccatggcaacataatttgcagcaacctaaatggtaatcaaagagagaaaaaaagaaacagattaagaacatgatcatgaacatctgcactgtgagaaatcaagtgagcacctggaagccaatgggtggacttgggccttcacccactttgatatccttgtactgaagaccagactctgtagtcaccatgggcaccttgggaatgcatcatgatgagttagttgctgagattagcattgattagatgattaacatttactaatctcatcgctaaacatgatcatgtatgtaatcatgcatagctcaagcagggttgaaaacttgaaatgttcctaaccagaaaacagatcgatcaccctggcaagaaagaaatttcaggtaaattttttttaaaaaaaatcgatcagagtaagtacattttcgaggtccttctcgcaggcggcgtcgcagagcttgggcttctcctcgggaggcagcccggcggcgagggcatcatcgaacgcggccaggccgagcgccagcgccgacgatacccccacggcgactccaagaacgctcctcctccgggaccgggtggcgctggtacagaccacgccgccgtcatccactccgcgctgctgcggcggcggcgccgttcccgcctcaccggcggcctcgcacctgcagcagcagcagaagcatcgccgcgccgctgaactcagcgccctgctgcccctgaacgccctgccgtcgggaagccacggtttggaggaagggagcgggcggcgggccgaggggaggaggagcggcgaggcggtggcggtggaggaggacgaagcggttgcagccatggtggaagaagaaggaagaggagaggaagacgaaggaattaagcaggtacggatcaggagacgtgggagaggaggagaatggatagcgcaacgacgcatcgcatcgcatactgggctttgcgcgcggtccgcctccaccactcgctgcgtcgggtcaaactgaaatctttcgggtgctgctggtccacgtgtcactcacagagggtttcgatctccatctcgcctgcaactgcaaaccacctcgctggctgcctcggcagcatttttcaccgtagtccacgaggtgtaaaataagaacgtattatgggatcccccatctctatcataagacagtcacaaaattaatttggagagaaacttcagctcgatcaggtcaagcggagattgtggtgcgtcatgctacctgtgaataatctcaagttctgaactctaaacaagtggttatcacaagttagaagaaatacagtaagaattctgaagattaatttgcctgtattcattggtgtcacggtgactctggtattggaacatttctttgcagtaggtagtagcaccatgccaagccatcagattatttttcataagagtgaaatgcacatacagtccttaaactggtacggatatatcatttaggtccctaaactctcaaaatgaatttttggatcccaaacttgtaatgagtgtcatataagtccaaacgggctccaactcgctccgtgagatgacgtggcatgccacggtaacgcttacgtgccagtggatccacatgtcagtcatataaaaaaataaataagagaggagagagagagagagaagaaaatgatgtttttaattttgaaaaaaacaaatgaaaaaagagaggagaaaaaaatatgtcatgtggttgacatatggggtccactgacacgtaggcgtcaccatgtcatgccacgtcagcacacggagcgggttggaacacttttggatctatatgacatccgagacaagttgagggataaaaaattcattttgagagttcagggacctagttaacacacccacgtaagtttaaagactgccgtgcactttactcttttcataattatactttcgataataacatgtgtaaactgtcagacagaaaacacatgatcagagagtaaaaacacaactgcatacattgcaaatttgcgattatgcagctcaatcgctggttcgtaatccctactaccaccgtagggtttattcttctgacataaaacataaaaacatggccagattgcagggcttggccgaattattgtacaaacatcatcatcctggtagtaatatatatagttgatgcgatcaaacaagctattcgagtcaccagacgttctaataaatactccctaaatatttgacaccgttgattttttttaaacatgtttgaccgtttgtcttattaaaaacttttgtgaaatatataaaactatatgtatacataaaagtatatttaacaaagaatcaaatgataggaaaagaattaataattacttaaattttttaaataagatgaacggtcaaacatatttaaaaaagtcaacgacgtcaaatattcaaggagggagggagtagtagtgtaaggtttttccaagtgatagaaagtgatgatgggactcctgacagcgtggtgccaatgatactctgctgatattgagcttcctctcacattatctaattaaactgagcttcctctcaagtacagcaaccaaccagttgcatatgttgtcagtgaactgaaaataggctctcctggaagctgcactgaatatgaaggtggttgaaacggtgcagaatccaaacgcaaatcccagcagagtaaacatgtatgtcagcgtgtcaaaaatctcatgatgtttgtgtttgtcgctgtccttgtggcagcttcttgtaagtggagccccacagagatcttcatttcccaaaaaagagtctccttcaaaagtcataagttggtttccatatggtatctttcctgagaggtggttgtaggatagattcaggaagctcaaaaataacagtgacttcatgctctgaggaattgggcctgatagatcattccatgagagatcaagtgattctaaccaggccagatttccgattgtttcaggaatacttccctcaatgtgattccttgatagatttaaggacgctagtctgtaaagatttcctatttcactgggtatctccccggttaaatggttctctgaaagatcaatactggtaaggaggaatgatatcacgaaagtaagtctgtaacctctgaaggttgcctgtaaagtatctttgtacacagaaaagtaagcgcccccaacgccataaaccatgaattggaaaaaaggcgatgagtcccattctagatttcgtgagagaaaggacgttagttttcccagagaacgtggtatagagccagagagtttgttgttactaagatccagatattgaagggcatgaagttgggataattcttcaggtatttcaccggaaaactgatttgaccctaaaatcagaagtagtagagtttgtaggccattgcctatccatgttggtatgtatcctgacaaattattctctccaacgtcaaggactaacaatcttttacatgactgcaatgaggtgggcaacaatccagataagctgttcttgctgagatgcaatgctgtaagggaacttagagagcccatagtggatggtatttcaccccaaaaattattgctggagaagtctatgacatacatactggaattcatacgccaacaatttggaagttcccctgaaagattgttattggatatgtcaatcagttccattgatattatgtcacatagatatgccgggattactccactgagagaattatgagagagcgacaggtattgcaattctttgtctccaaagctttgtggtaatgatccagacaagttgttgtgggatagatccagcactcgaacactatttggcatatcaggaatgtatccctcaagttgattatgcctaatgttcagagttatcagcatttttgatcgcaccaaacttgcaggcaactcaccagttatgttgttcatcgagacatttaagctagccattggcgaagagaagttccagatccaatctggcaatgcacccctgatgcctgcactgccaagatcaatcatcttgattctagtttgtgattgcagccaggttggaaactgtggtccaaccaggcaaccatgcagtcctagctttgtgagctgaaagggtggaaaccagctatgcttgactacaaccttgaaagaatttgatgctaaaactaaagcatccaatcttgataaattggtaaagtggagttctgataattcaccaataagtttgttgaaggaaatatccaagtatgtcaagttcgatagcctgctaatgctagttggtaatactccagataatgaattctcactgagatcaagaacttctagacttgccatgtgctcgcaccaaccagatagctgtccagttaatttgttatcagcaaggttaaggatctgcaacttcttcatgcagggaaacatgctccttgctgcttctgagagatttcctgacaaaatgtttctagaaagatctatgtgaactaagttgcataatctgctcattgaacgtggtattgctccattcagcttgttgttccctagtccaataaactgtagtgctgctagtttccctagctcatcaggaatcctgcctgaaagttcacaactagacaggtccaaatctgaaagggaagatagattccaaatccaatctggtaaggaagaattcagttcattattcttgagatcaattactttaagggcagtgaagttgatctgagaaacagaattaaggtccgtagctggaaggcttgcatcattcaagcgaagcacttccagcaaatgaagcatattcacagcctgcagccaatccacagaagcagcaaggtacaaccaactaaggtcgagatacctcagggaagttagcttcgaaacccactggaaatcgtccgcagtgatcacatgagaaccagatgagctcagatcaagaaagctgagccttgacaagttgccaagctgaggagggacagtcccaccaaaaccagcatgcgagagatcaagatacctcaacatcttgaaacagccgatgaattctgggatgggcaccccaccgaagtcactttgactcaggttgaggtacaccaatcttgtcagaccagacaacgatggattgatctgaccattgagagtgtactcgccgaggtccagcttgatgacatggccagtcttcttgctgcagctgacaccactccagctgcaacagttctcgccatgccatgagtgtagccgcccatcaggatccttgatactggtgttgaaggcaaccaaagcatccctctctgtggagatgcacgcagctatctccctgaaattgatggttaagcacaacagagccaaagccataagcaatccattcatagtattttccatgttggtggataaaactgtcagtactcagtagctggtggtagaatagagaagataggtcgagttgcacctaattggataaatggaagtgctgagatgaagacttgaccagttgacctgatgacctctggtcttcgctgctagtctagtctttctgcatttttagtcatctgaaaaacttgctttcctgtgtattaattgcattttgcagtaactggcctttttggcttgacggccagggaggaactgcaattaccgatcgagaaaagggtgtacacaagggatatgtttgctgagattaaagcagtaccacctgtacactctgggaggttacaaacttacaattactgcactctaatattttttttgattgaaaatactatcaggccttgcctatatattaaaggacaaagagcattctttactgcactcaatattataattcactcaagaaaaaccaatgttgtggtcagcctacccaggttcaattcaagtcgtaggattggctaggatgatgtagagctcatgtttagttttcagataaaaaaggcaagttcttactcaatttgcttttatacttggattcacaaattgatctcctcttcccgggaaaatctacatcttgctcattcatatttattggcctgaaatttctggtagatctaagcacggcattctcagcctgactaacatctcagaaaatgcaaatgttactgaaacataaaccaaccccctcctgctaagagcctaaggcactagggtagtgaagtgaactaaactacgaaaggattggcactaacgaatttatagcgggatgtacagtaatccggaaacagtaaatcgtagagaggaagaagcctgtgcggccataaacctgaaacccgaactcccaaacccctagttgcgtacctcgcagcggagaccactccacgctccgccgccggagacgtcagccggcaagccgccacggcgaacaggcagcacggtgttggagaccagtttgccgccgtatccgctccacgggtagctcggcgaggatgagggcagagcctactgtcggaagcggcgcttcggttgagggatcttcaggtgagggtacctgcggcggtgaccggtggagctacgcctggagcggcggccgccggcggcacatgctcgccctattctattcgagaatttttttcggttttagattttttttaaaaaaatatttacagaaataatctatcggctaaaaaaattacaaaaatagaccctgccgcccacctctggggcggcaagctgacgtggcaaacgggggaggaacgggcggtgacggagggagggtttttttgcaggaaaacccttgccgccctctggtggggcggcaaggggcccgaatacaaaaaagccagtcggggctggctattttgcaggcggccccttgccgccctctggccggacggcaggcctcgctgcctataaaaggcctgctgcccagcccccagccctcattcttctctccttaattccagtgaaaaaaaaagaagagaggggaggagaagagaagaaggggcgaagccctgccggattcagacgccgatttcaggtaatattcatagatcctatatgtgactattgagttaaatagtgtgtgttctttaaaaatttgtttgaataaatgcattatttttttgggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccagctgagaggagtgtaccttctataaaaggatggttaatgaggggcttgagagttgatccacagacaagtgacataacaatcaatgttatagtaagtcggacaactaagggtttttattgggaactaatgccagttcaaaactctcgagtgtggagatggtatttggaaaatgcattgcaacgcaagtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgatgttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacatcaggatacacctcagttgttggacccggcgatagatcaccgacaccagtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgctgtgcggtgaggtagcccctaccctacaggacgtatcgtacttgttggggctaccgctcgcgggagacgctgttgggccagggaccacggctatggactggaaggatgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgactgcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgctgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcaaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcttgagtttgttatggagttcgaccgccttctgccgactgacgtcgtgtgggagccctacagtgccgcggctacccaggctcgtgcgctgttgggtctgtccacactctgcaccagggaccaggcgtactggatgactacggttccgatggtcttcgacatctgcgttgagcttcacgcccctttccgcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccaagttgcgagcactagagacctctatgccaggcaccgcgaccaggacttcgctcgtgctgtgagtaccctgcatcgcaccattcctttatgttttcatgtctttctcttcgtcaaattttacgaatatttacgtacaaattaaccatgcaggtcgacgacatcaaccgggtcgtcgttgatggttcaacgacgatccaacgtttaggcgcggggattccggtacccgtagaggagcacctgacgacgtacacgcggatggtggagtcgatgcgctcgcttctccgagtgctcacctgtcgtgccgacgacgttgctcgggcagacgcagctgtatagcggccacccgtacagactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtcacaggcagccggcacgtcgagtcagggtccaccactggaccatgttgggacctcatcggaccgcttgctgccttccaccgtgctcttcgacatcactgacttcgacttcgcttcaggctcgtcagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcagcgcggggcagggccagtagagcagtcttctctttgtttacttgcttcactttccagtactgtatgcttgtgtaatgactacgttgttgttatatgtgcacgatacctttcggtgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcaaggaaggcgcttttttaggtgccctaactatgaccgtgaggtattttattatctgcatatgcttattcattctgtatgggcaatcgctttattcttcgtaacactactctattcggcagacccgcactacggcttgtgcatacatcgagtggatcgatacaaaaaatcccgttctcgacctaaccacttgtttacaagaaggtcgctggtatttcgcatccgaaagtaatgagcaatacttacagagaaaagcggcttatgaacgacaatgtcgtgaacaacagagcgactggcgggtgctaactacggcactccctccatgggaagcttgtccaagatgcaggtgtggtgatcgttgtcaggtttttcgttccataaatcctacaacattgggttgaaggttctttgtttgtccaaatattcttgacgacgatttcatggtaagaatattttgattacatgaatccttattttctcacaacatttactaactttgcttgctttacatctattctttcctcctaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtatgggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtccatataatgtttatacgacccagactgtgataggcctatataaattatccgagtactaatacgtcgaataaggtacaaaataatacctcacttaacatatgaaattacgcaacaaccaacttcaatacatttttataacaatattaacaagttttaccaataaatacttctttatttattattaacataacatagaaaaatcttttggccgtacttttttcatctggggacccagatgaaaaagtacggccgcaagctctttatgggcggccaaaattgcaattagccccttgccgccctctgtatgggcggcaagggcctaatcgcaattttggccgacggcgcggtcgacccaccgtctgccacgtcagcttgccgcccaccattagggcggcaggggctatttctgcaattttttttggtcgatagattatttctgtaaatatttaaaaaaaatctaaaaacgaaaaaaattctactattcgatattgggcttcccgttcatgggccttcaagttaagcagtttctacttggaaaaagtatactttgactccctcaactatcgcccgagtatgattcatatcctccaaccacaaaccgggtatataaccggtgcaaacaatgtccctcggtggttttggaggtggttttggctgacgtggcgcctacgtggtggtcttgactgaatctttgtcctacatggagcttacgtggcattaaaataaaaacaataattaaaaaaaatgtaggacacatatgtcattcacacaaaaaaatattgtgggacccactgacatgtggaacccatatgtcatcctccctcattcccttcttcctccccctctctctcccttatagctctcgggagcggcggcgggccgacggctgtggcgatggggacgaggcgaaggggagtggtggcggcggcgatggcggtggggtcgaggcagaggtcggggagcggcggcggctatggcggtcgggagcggcggcggcggcggtctgggagtggcggtggagagcggcggcgatggggagaggcggcagtggggacgaggcgaaggggagcagtggcggtggggacgaggtgaaggggagcggcggcggtggggacgaggggaaggggagaggcggcggtggggatgaggcgaaggggagtggcggcgactgtgagtgtggggagcggc

SEQ ID NO: 74520 - DNA, 75141 bp, Oryza sativa
  unsure (1)..(75141): unsure at all n locations
ttttacaattgtattcctgtcagaatcatgtgttttttctattcctctgttttttcattcctacaattcaaaaggggccctaagtattgggttgatatacttccccctctgaaatatgaaatcaggtcttttactcctgaagttaaccaactcaaataagctccttaagtgatattttatgtggttttgccatgttaatgataacgtggtagcggtattgtttacatgacatgaagatcagtccactaaaccaaagttgatccaacagttttcttttctctcgctgattggcaagattatgaaatagcagtatatattagcacaaatgtatatcattctcaaaccgtttcacatgtgaaaaaaaattaattgagtctatcaccatgtcattagccacctaatgacatgtggctaaaaccaccgtcacgtcatcatgttcatagttaaacctcctaaaaaaccactcaagagggttattttagacagttttcatactttatgggggtaaaataccagatttcatgtttcaggggttaaggagaccaaccccatactttaggggtgaagaaaaaaattccattagttattagctaaaaagttaaagtatggattaatgtgattctttaaagcaatcttcttataaaaactttttataaaaaatacaccgtttattatttcgagaaacatacgcacggaagagataatagaatttgggaaaggatagattagaactcatcctaaggctgtgttcgggagtagcacgtataacgaagcaacatttagcgcatgattaattaagtattagctaaaataaatttgaaaagtggattaatatgattttttaagtcacttttatatagagaatttttgtaaaaagcatactgtttagcagtttgaaaagtgtgtgcgcatgaaaaaagtgataggtgagttaagaaagtagagataagaactcagcctaagtctaccacgggctgaaatagtaatgattagttgagatacttctaaacatgattatatttttcttaaaatagcattatcaaattgttactatcggattgctaaaattatgacgtcacattttcacttaatttcaatcacttttctttcattttaattgctccctcttctatatataaaaacaataaattgtgttcaatcccaattctcttatatacattgtatattataaaaattacaatattgaaacttacaattattacatcataagttttgaaatttatagcataattataatgtaaggtacataatttacacgtataaacaatctactccctccgtttaaggttataagacgttttgactttggtcaaaatcaaactgtttcaaatttgactaagtttatagataaatatagcgatatttataatactaaattagtgttcatcaaataaatattcgaatatatttttgtaataaatttggctaaggttgaaaatgtgactattttgtttttacaaacttggtcaaacataaagcagtttgactttgatcaaagtcaaaacgtcttataacctgaaacagagagaagtaactatttttatttaaaaatatggcatcataaatatatctactcccatcaaccgaaattattaattatggttggcaaagagaagataatatctcataaaaaaggacaaaattgcttatcaccattctatcctccactacgttctcatctaccacatttaattttatctttaactacttaataaaaataaaacttgtgttgtttagtccaccgtcacgcatgacgcgtcatagaaaaatcatgatatgttttttttttgtagaaatggatccacatgaaagaacaaaaagcatacaactacttaaaaaaaggcctccggaaaggatccactatttctcttgctgttatccaaaatcagatggaaattttcattcaactttttagatggtgtctttaataaggagatgacacacaaatgacgatgttgtcgagtccagaagaatcggatggttttcaccacctctcccctcttcacactagtattccatgcctttacatgccccaataattgcatcccatgcaaaaacaagcagacatgagtcactttttttttttagataatagacatgagtcacttatggatgatctagattgctgaacctcatttagtcatctgtggtcggtcttctcgatcataataggagctacttctctaaaggcacccgcaatagttatttataggctctctacaagatatccatgtcagcatatttttctacatagaagagattaaatgaagagagagagcaaaactatctactaacctggagatagtctatagagaaaaacgaggcaatgcattagagagctatagatacccatgtagacatactattgaggtggtttactattaatctagtttattgctgagatgtacatgttttatagagagcaccttattttaccattgcgggtgctctaatcgtcgtccctcgatgattgtcgacaatcaaaggtcctagtaaaaccatctagtagtggttgttcgacaaatgaaaaactaagagccacacgcaatgagaatggtgagccatcgatggagggtgcgttcgaacgtaccaattcggctgggttgaattccagctagcccatgaagctgatccaaatattgtgtttatgggctgaaaagaggatggtccaggattgtggatgtataacgacgtcaaggtccattaggtttccatcgcctgccataccccgtgttgaccagcggttcctcgttattcccattccttcgccacacacccttgcgactgctggtagttgaggaggcagaaggtaatggcaacctcccctacagatttgtgtccccgtcctccttttcttgtgcggctacgatagagccaatatgtgggcgacattgaaggctcgagcaggggtcttcactagctgcatcgggtagaagaaaagggatcaaatctcttccccgataaggaggagaaagatggtctgcgtagctgctgcttgaactagcattgtttactactagaaaaatcatttttctcgatgtggcggtcataacccttagagccaaataaccgcctacaaaaatataaatcggggtgaaatttaccgtccgcctgcggaccactttcgcaggcgccgcttaagtggtccgcctgcgaaaatagacttgaatataaatagatttggataggagtagatttttttctaagtttcaaaacctcacctctcctctcacccacggctggcctctcctcacctcacctctccacggccggcctctcccacgtagggatggcaatttccccgacgagggcgggtacccgccggggacccgaccctacggggccggggtcggggctatatttggccccgcgggtgcagcgggggtggggccccgaaaatatgcggggacgggggcgggtctaggttttcacccgcgggtgactcatggggacccggaaatatggtacatgcgtagattgcaaattaaaaatgtggcccaaacaagcccatgttgtgaaataacttttcctatcccatcttatctaccccagccatacatacagtcacggagccatccatccagatcgagtcaatgacctttcaaatcaaaagaataaaaaaagaaagatacagtcaacgagtagcgactgcatcggcgctaccgcagtcgttgcaagctgctgcgcctcgtcagctccctgcgaggctgcgcctctgcccaggccggctgctgcgcctccgtctcggccgcgggtcgccggccgttgcactttcgctgcgtctccgactgctgcaactccgccgcgtgtcgccggctgcttcgcctttgtcttcgtcgcgcgtcgccggcttctgcacctccgccaaatctccgcgatgctagcctcctcgatgagccacttcatcttagctgctacaatcctggttttgtcctcttttctctatagcttgtggggcctcggtcggggtcggggacccgtaggggttgggggcgggggaagcttttcacccgaagatggtaccggggccgggggcggaggataaagtcgggggtcgggggcagggccgttcctgtccaacccggccccgccccgccccgttgccatccctactcccacggcgggtacgcgcgcggggcggcacggaaagcggcggggcggctcccctccctccctccctcccagatccggccggaggagggaggggggaggccggcagtggcgactacggcggctacgacgcaggcggcggcggcgacgacgatgcggcccggcggcggctcccctcccccctccctcccagatatggccggaggagggaggggggaggccggcggcgacgacgacgacgcagggcggcggcgacgacgatgcggcccggcggcggctcccctcccccctccctcccacatctggccggaggagggaggggggaggccggcggcggcgacgacggcgcggggcggcggtgacgacgatgcggcccggcggcggctcccctccccctccctcccagatctagccggaggagggaggggggaggccggcggcggcgactacggtggctacggcgcggggcggcggcgacgacgacgcccggcgcagctcccctcccgcccggcgcggcgacgccagaggagggcggcggcggcgagccgccgcccgtgatattttttgtttatttgaatggattttcgcaggcgggttgttgccccgacgcgaaaatcgatgattttcacggtcgttgagctactggcggtccaactctccgcctgcaaaaatctattttggccgtctgggaaaatattttttctagtagtcgtttccgagatatttaaccatttgccacatttagatgtggcaattaactttttgtcactggacccacatatcatagacacatgtagacccacatgtcattgagataggggtggcaaatacaccctccgtcctataaaaaaccaacttctagggatgaatctggacaaatgtttgtccaattttatccccagaagttgtcttttttttttactgagggagtagttatttgccaaatctaaaagtggcaaatagttaaaagccctgtggtttccagcgactggtggagcaacctttctcacgtgtggttgttgctctgatgcggtctcgtgcaccatgtgagcggagattatatgagcggagattgtcccacctctagctttcaagggggcaccattagaaattggaggtccagacctcgcctattttagggccctctccggagctcccatggcaaacaaagacgtgaagcagaagcttgtgctggagcagtttgtttgccacagacgccggtccatctagtttgccttcatcttctgcctcgccaaaacgatgcgtgctagtggcagatttagaatcaagtaaggccctgtttagttcccctaaaatttttctcaaaaacatcacatcgaatctttggacacatacatgaaacattagatgtagataaataaaaaaaactaattacacaattagggaggaaatcgcgagacgaatcttttgagtctaattagtccatgattagctataagtgctacagtaactcacatgtgctaatgacgggttaattaggctcaaaagattcgtctcgcggtttctaggcgagttatgaaattagtttttttcgttcgtgtccgaaaaccccttccgacatccggtcaaacgtccgatgtaacacccaaaaatgttcatttcctcaactaaacacactctaaggggtcgtgctagtcgttgcaatttgatggcatctctggcgccactgcagaggatgatgtaaaggtagtaagtagcacatgcactcaccgccaacagtttgccagcttttccaccacctcactccggcaaacggttgctcattcgctcaattgggaggccttcttgacttcaagcaactaatgctgggtttaatttctaaaaaaaagttaaaagtttaaggaaagttggaagtttagaaaaaaagttaaaagtttatatgtgtatgtaagttttagatgtgatgtgatagaaagttgaaagtttagggtagttgagggtgaactaaacatggcctaaggtataacatgcattagttgtatcagtttttctacaccaatttttttttgctcgacttgggttgttagaaaaaaatgcaaaggagggagagtagtaagctacaggtgttggaagcttcatggatgacggcaatttgtttgcttcttctgtgaggaagaatagatcgataggaggagctaggtgggtcccggtagcagcgaggtgaacgcaagggccagtgtggtggggtcgtgggtgagtggagaggtgagtgcaacgagagcttgttgttctcgttcctgctatcatcgcccggcgagcaaagtggccggatttgaaagagaagcactggaaggataactcgagggcaatttgcaaaccaggggtactcaccgtcattttggaagtttcctctcccctaaacagccaaaaacatttaaatagtagcaaatattcactttttaccgatgcattccacaaaagattcactactgcggtgttctacagctagtacgtcacggtgttttatagcaaaatttgccaaaaaattgtcataattttaaaagtttaggggttgattcggtccaaatttaaacttgagagaaagttataaaaggaagattttttccctatgttacttagaaatttaattagaagattcattttaagaacgggttaattttcaggatcaggcttgacaagtctagcatttcccatgccgggtcccaaaaccttaattcatcccagcgcacacattcaggcatttgtttatttggcaaaaaaaaaattttgccctctgcatgtcacgtcggatatacggacacacatttgaaatattaaacgtagtttaataacaaaacaaattacagattttatcagaatactgcgagacgaatttattaagcctaattaattcgtcattagcaaatatttattgtagcaccattatcaaatcatggcgtaattaggcttaaaatattcgtctcgtgatttcttggtgaactgtgtaattaattttttatttacatttaatattctatatatgtattaaatattcgatgtggtagcgcgaaaaattttgttgaagagctaaacaggtccgtcctcagtcttacaacggtcaaccactcaacccaagctccaatgatgcgacctcaacccaaagctctcgacggttgaggaacaacgtggttgtcgctcattttcctcccgtacgttccagctagctcaggtcaaagctgtcaaacctactataaataattctcgttgattagccttggcggccaagtagacgatcacaacgaacgagaccgtggctgccaagcaacctcaacctcccggccggcacgggcgcagactataaatgcgccgctggccgcgcctgcacctacaccaaacctacagcaaactgagcgaggagcagagccatgcgtcgcgaggggaggcagcgcgggtgggtgtgcgtgtacgaccgcgccctggtcgaccccgaggggaagcgccgcgtggtgggcgcggtggcggcgccggcgacggtggccaacggcgggttcatcagggcgccgcggaagccaaccaaccactccaagttcaccggcggccgcgccttcagggagctcgccagcggcaagggcgcctgcagcggcgggccggcagcgtcgacgacgggtggtaaagggaggcacaagttcaagcacgacgagatcaaggcgtactacctcgaactcgaagccggcgctgatgatgctgtcgatgagctaggatcgctatgagtgacatggattcgtggaggcagatggcatgcatcaccggaacggcggcacggcggcatgcagctgccaccgtcgataggagaattgcagcggcggcgctaattgacatggcagtttcctgttttggtgtgtatgtgtgtgagtgtgagtgaaactgtgttgtgaatgtggatctttttagtttggtgtttcgttgaataattgaactttctcgccacaaatgagtttgaattcaggtcctatcacatcggatgtttagacactaattagaagtattaaatatagactaataacaaaacccatttcataatcctaaactaattcacgagacgaatatattgagcctaattaattcatgattagcatatgtgatgctacattaaacatgtgttaattatagattaattagtcttaaaaatttgtctcgcgaattaactctcatttatgcaattagttttattattagtctacgtttaatacttctaattagtattcaaacatccgatatgacatagactaaaatttagtcactggatccaaacaccacctaaatgtttgtatgtgcatttcgtactccaaaatgttgttcattcaaaaaaaaaactccatgtttcttattataagtcatttttttaaaatttgactaaatttataaagcgactaatattaatatgaaatggaggcagtaatagacattttggcttcaagacgattgccatgagccacatgaaaataaaacagaattgctaaacacattcgagtgaacatcgagggcaaaatcttgcaaatttcttaccttaagatttgctttgcgattcatgatgtgatgagcttctccctttgtacgtcttcgtgaccctgaagaactccaatgacagcgacagctacgaccccaaaccagataggctttagggttgggggtgggttagaagggagcggaggaagatggggttttcctaggtttagtgggaaggttgtgggcagcgaaggaccgatggtgggtggtagacataagcgggtggtgccgaagcgtcgggagcgatggggatggatgggggtgtttggctgccattggaggtggggacaagggaaatgagagggcttaggaagcaggggagccctcacagatggttcaaaaatttggaatgaaaatttgagtctatcacccccccccctttccaaaaaaaaaaaaacctgaaatgattcacccggttttgtgtgttgtagcagggggcaaatgccatcccccccccccccctcctattcgaccgaaacatggcaacggttttcagcttgatgcattttgttccaaggtaaatgctttttgagtctttgtgattggtaaacagaagacgcccgagaggttcaacatggagaccttcagttccttttgttgtctcattgaataaagggtaaattgaaaccatgctattataattttgcaaagtttgaataaattgaactttgctgcctcttgtgcaaatggcatcgcctgtaattgtactccagatgtttttttgatctcaaagtaatgttgaaatttcaatcatgccagttcaaagggaaatttactagtgttttaacatttcgtcttttttttttcttttggaaagcgccaaagtgttttttattcctgctgcattaaaacacgttgtgttcttcaaacagcacgtaatatttcggtactgaatccaaaagtagagccgacaataagcaagaccacggatcaaaaggacattggggaccaattactcgcagcaagaactacgataagacaccatgcaatacgaaggtgaaatcatgattccctctattgtcatgctcgcaagtcacaggaccataaaaagaggcaacaaaagggccttaggtaaagaaaaattataccgatacattactgcaactcctcccgaattttcaacatcatacacactacatcgcatgcagggaacatgtgccgctaccaagagaccgacaaaacctcattcctcccaatgacaagttactcggatatattcattggaggttcaaggctctcgacaagaatgcgcaggtctaaatccttatcctcaaacttcttgatgaaaggatgattctgcaagaatatatatgacagttcagaacaagatggtcgaaagatgttattacagttaagttcgctacaaaaattattaaatagaaggcaatgctgaccaagagttctgaagcagacatccgctccgcaggatccttttgtatgctgcaaagcaatgtaacaataaataagattagactatgataagctgatgaaatgaatctttaatgataagttggaagaaactgttatttaccctcaagccatgcttgtatccttatagattagtcatgaaatcagatataggagcacacaagacactgttatttgcatgcataatttgacttaagcaaagaagttcaaaagtacttctgtaaacaacaatctgacagcaacgcaaattgatactagtcatgatgtgggacactgggccagggtgggtatactactgtttagtccgtaactatctcacagcaaaggttttattaatctggaaaacacctagatattttgctgccctttaaataacttgatttgcaatcaccctagaaactaattgataaaatgccaccaattagatgtgcttgatctagaatattgctattttgtacctaattgcatctaccttttttttttacacaatccccaccacaagttctcattttgcccttcttactccatcatctgacctcaagtttccacccctcttcaattcagagatgccagcaatagcctaaactgccttccacacccatagcgccgcatacccccaccatctacttttgtctggatttgctgcagctagggctccagctccccagcaccatggcctcttccatcgactcattggagagctcctctgacctaaccaagtgcatcaagctcacctggcttatctcctgtgatttcatcacattgatgactacttttgtctggatttgattcctttgtggtaagaacgagcaatattacttggtgcaagattctttcttgggttttagtcattcagatccattataacctttaattgcttggtgcaaaattcttgctcatgcttctgttctagatacagaaagcttgccaagttctacaagttggagctccagatcagctttttgtcaataagtaccactaacgtttgagggtgaccatggacactgaaagatttgctgacttctgacctccagctttctcccttatcttcatcaaatcagttattccacttgttcttttgaagcatagcattgaacaagagcaaaataggaaaggagatgcaattaagttcaaagaggcaattggtaaaccaacaccatctaaagggtggcaagaaatcaattaggttccagagtgtggcaaatactagactcaccatctaaagagtggtacatgatcaattaggtgaggcagcagctgtgacagtagcccctggacacctcagtgctcaagcaatgatgaagttaagaccttaatagactacatgcatctcgtttaggactaatacaatttttaatatggccatgtaggtatcacgttaaaatgctaagaactatggtctacaaaagtaaaccaaaggttgcttgctcaaacccactgctacatgttttgcccactgagccattggctgcaaagttacactttaagcctcttggtatgcaaagtgatctgacaaaattgcaggaagttacaactttccagtggataacattgcaggatcgactgcaatataaaaggttgtagaaaatttttaaaaaaaaggattgtggatttcactaattgtgtccatcaacttcttcatgatcacaaatgctaacaataaagctaagcatattcaaaggttaacaaaaggaacactttggtacagaaaatacatcaacttcctggaagagggaattgctacacatatatacaagttacaaatagcgttctcaataattccaaacatttcttttgcagttccagttttttttttttttggactcacacacaaaagactaacaagactttgaaatatagagcaaaacagccaaagtagtatgcaggggaatactcaggaaagcagtaataaaagctaatttcatgtgtaatttcagagagatgattatcataccaggaggagataaatgcacaaaattctggagagaactggtccgctggtgcagagggtggtggctggtcaacaattgcttctaataattcgtagaagcttaaccaaccttccccttctgaaggtatataggggaaccgaccaatggcacactcgagtattactaagcccaaactccatatgtcactcttgtagtcataggagcttccactaatacgctcaggctgaactaggaagaaaggtagaaactatgagaacaaatttatgaattccagatcagatcactgtcttgaacatagactaaggggtacataaataaagcaggtcattatttcaacataccgccatatagttgtaggttccaacaaacgtatcccgctgacccattgaacttgctagcaccgcacttaccccaaaatcggtaatctttacttcacctttacggttaactaacaagttagatggctttatatccctgtgaatcacatgcctttcatgatgaagatacagtagaccctccaaaacctgagttgtcaaaatatcatgcaatgtttttttacgttagaatactttttcaactggatagatgcgacaaaattccaagcttattccgaaaacagggaaagttagaaataaaaggctaagtttatgctaacctgtttgcaaagtactgccaggtatggctccagaattgttttgacttgtttaatgatatctgcaagagatccacggtccatgtattctagaacaagatatattacaccattatggtagaaagattggtggcaaaggactatatgtgcgttctgtgttgcttgatttattttgagctcttgtactatttgtttgcgaactgcctcttgaatgttcatttgtatgccctgtggacagaattgcaatgctagttaattaaatgccacagcagtatgaataccagggacaatgcacagaattcttgattgatctgaacatcataacatgatgttcttcattagcatcaatattaattgaaaatcagagttcaatgtagatattgcatgcaacacgtaagctgacgacagatgcttctgctacaccatttatgtagaatgccccacctaatttcaacagggaacatactaataggtgccaacactaccaaattgattaaaaaatcaatcaaatgctatgatgcagaataatctgattatgataaacatgttcaaaatggaactgagagattgacttccagctttccatgattacaaacataaagatagagaaacagttcaactgaaggactcgcagcctgatgcagccacaagatatacattttccatttaagaattagtgtggaacactagatggattttgtgtaatggaaattaccttcaaggcatataatgtccccacccacttgtgccgaactagttggacgataccaccactccccttaccaatgacttgaatcatctcaaggtcatccattgacaactgaacatcttccaccttcaggtttgttgactgctggaagacataaagatgaaacagaaattgagaaatgtgaacaatgttatatccatggataaactctgaaatgtttacacaatgattccttagcactattgcagcacataatacattgcgagaatgcatgagtggcatggatcccatgcattgcaagtgagtattgcattcaatcagccaaatgaaaatcaacagaagcatgataaggtttgactgaactagtcaacctgtacatgtgcttctacactaacctacatgtcaccataaggagtacgataaagcagtttacatgaacccagtagggagatatgaacaaacaaaaaaagtagccatggcaccaggaactcacaggttcatctgcagtttcctcggatataagctgcaaacctctttgattaagccgcagttcaccatccttgaatgtaccactcgcggtcctaaaggagcaccagcgatcagtgacagctattaaattttaccacgaactcccgaaacataaatcaacgattaggctgatggataaacaaaataacaaacgatctggaaccacgaatagcatttcagccactctaagtgaggattgaagagtcagttcagcaactcagatcatagatatttcaagcaaaagatcagttagacagtataagtagacctacgcttctgtaaatcttatctccatctcagttcataactaaccccaaaatcacagtaagacactatgcaagacaattcgatctgaactccaaaatcgtcaacaaataactaaaaaaaaacacagaagcccttctataccagaggcaaaacctcgaaagttcatgacacccgatcgctccaaaggagaacacacaaaggaaaacgaaatcaagtgacagtaaaaaaaaaaagaaaaaaaagagcacgtttcaggcccagggaaccgagggagggggaccctacaggaacttgtcgacgggcgtctcctgcgcaggcacggagagcttgagctccttgtgcggcttcttccccctcatggcctccccctcctcctcctctccggttagggtttatccgccggtaagagacgggggaccgaagcgcgagcgagaggcctatcccggcacggatctgccccgcggcggctcgagtaatcagccgggagtggcgggacgcggcgggagggagggaggaagcagcccgcggcggcgagggagggaggaaggagaggtgaagtggcgtcggaagaagcgaagaaggaaggaaggaaggagagcgtgtggggaagggagtgggatgggaagagaaagaaagatgctgacgatggggaggggggttgctctgtgggaacgcacgagttggaaaaatcaaaaaacttgcggggcccgcctacgtatgcggctgattctgggacacggtcatctcgtcttcgcaggcaatgaccttgggcacttaccgttattcccttcattctcgattcttgaccttgacattcccattctttcaactacacatatatatggtgtgttttgcgaaaagagaaatttataggtgtcacattaaacgttgatcggatatcggaaggggtttttagatacgaataaaaaaattaatttaataacttgcctggaaaccgcgggatgaatttattaaacctaattaatccgtcattagcacgtgtgtgttgctgtagcacttatggctaatcatggacaaattaggctcaaaagatttgtcttgtgatttctatgcaaactgtgcaattaatttttttatctatatttaatgttccatgcatatgtcctaatattcgatgtgacgtttttaggaaaaaaaattgagaactaaaaaaggccatatatgactcaccaaacaacatatttgtgaagggaagataatttataaataaaatttttatatacgtgttcttagcgatctaaaagcaaaaactgaaaaataaactacgataaaaaaacttcaaaatcaactctaaatttaagattgaaaattcaaattttggcttataagcataatcatgaggctgatacttccgaatacaagaatcattttacggctttgctattttgcactcgcatgaaaattcgtaatccatctccctctggtcgtgaattctgcttcaagatctgtgcacactatcggactagtgtggaaggtttttctacatggacagttcttcagcaggcctttttttcccaagcccatggccttaccctatcggaaagtcctttttttttaattggatccatgccactaaaaatatgccaattcaaaaaaaaatactactattatttactactatttaacatatcggttgtgtgccactgaaatttaaaaaaattggaaccatactactccatcacgaaattccgtctctctccttccctcttcctctcttagcaggttagtgttgctgatacggtggcgcgtggttggtgcgacggcagatgacaggaggtcgatggcgacgacgactcctgagccctcctaccgccacccgcaccagcccaaagacaaacctgccaataaaagcgctatggtggtgcttggtgtggcgtggcagggaggaggtctcgacggcgctgtcgcagttggtgccgacgatcttctctatgtccatgaaggtggagaagaggtcgtcctcggagtcgatgtcgtcgaagccatcgccatccgcgctgccgacgaggcccaagttatccgggaagcggaaggctgcctcagatctggcgtggcgacaagggcagtggcaaccacggccggctgcgtgggcccgtcacgccgctaccaccgccagggatgggtttgtcgcgcatgtacgccaccactgtctcctcgggaagctcatcgttggagcccctgtgcacgatgttgaacagtcgcggcgcctgcagtggcgccttcgccattcccgctgcgcctccttctcctcccccgaccaacgatcgtgcccccgcgacatcgcagtgcacaagacaagcaccatcgttgccgtggcccctgcacccgacgatggtggtggagaatgagaagcgtcgctggagggagagaccggagagaggtagggaaaagagaagagaggggagggaagtgaagaagatgaaactgacagctaggtccctcatgcagttgaggttaacggagattttcgacatatttttgacagattcgtaaccgcgtgccacacacattttgcaaaattggaaaccatgccactgccatcacattttccatccgtcttcttccttctctcttctcatcttcttgctttgcgagcgtcagacatcggtagttttgtgacgattgcggcagtcagcctccgcggctgtgaggaggtcagcgcgagggctctggcaacggcgagggagagaggcaggaggggttggcagagagcgcggtcacccaacgggctgacacgggggatgtggcctccagatctaaagaggagacaaggagctagagagagaagagaaagggacaggggtggagagtggaggggggcaccaccggcgatggaagggagcgtaggtgacaaatggtagcgacggtggtggaggaggaggagcgacgacggtggctgtgaggaagtcggcccgaaggtgggagcgacggcggcaaccagcggcggtggtggagggggaggaggagcgatgggggcggagggagcaaacgactcaaccgggctgcaccgcccgcccttgtgtgcgccatgaccgtttgccaccaccccgtctccggtcgctctggcctcgacttcaacaccgggtgaggaggcaggagaggatggtgatgcgtatcgggttaaggagggaggagcggatgagatggattgctagggaggctgagaggtggtggagagagatgggaaaaacaagagggaaggatggaggaaaaagatgaatctgataggtgagacccacatgcagatgagaaagaagatagaaaatgtgacggcagtggcacggtagtgacagcaaagatgttggccatcgagatcttctgcgattacttcacatcatagttcttcctttcagccttgatcacacacagaaaatcctaaacgcatgtaaacctgtacacaaatatgacacaatgcatgtgaccgaataaaatttgtgcaaacttattaactttggtcaattaacactctaattgcatttggtcaattaacactaattgcttatcagtacgaaaaccatcagaagctgactaaccaaatcacagtgaaccaatatttatcatttggctaattgtttggctaataaccgaattgtgcaaattaaactctcacggctatgtatcaaatttggctcagtgtgattactatattggatgcgtgtaatacatgcaacgagttcctctttattaatgtataatatggtttcggggaactgctggtttcattttgcattttagacttcacacaacttgcagcagcctcttacgagacaaggcagtattttttttcaacaaaactagaccaaaaccacatataaaaaaagcacagagaaattaaaagtatgccgaatctaattcgtacccttatcagaaaatcaagtaggatggctcccataactattgaaatcggtgtaatttaaccctctcagcggttttggagaacggtttcactgacgtgatgtttcaacccgatccaaccgactggctcaacatgtgggacccacgtatcatagtcacattttttttcttccttctctttctctttgtttcttcttttacccaccatggcgacacatggcccaaggaggagctgcagctaggccgccctgatgcgtagcgatgacgctgcctcgaggtgacgctacatcagcctcccctccagccagcgccaccgccgctgctcatcttcgtgttggggagaggggagaggcgacggcaaagcaaaagcagcgctcatcgatgtcgtcgaggttagggccgaggtcgttgagagaggcaatgcgaacatcccaaggtggagaggtcggctcctccctgttgagcgacggaaacagaggggtggtccggtggagcgaagaggagctggtcggcggtggcccaaaccgacggacggggacagggtcagcttggagcagagatccaagaggcgctcctcctgttgtgtcgagatcgataggggtggatcgcggtggaggtcgcggaagccggcgggggcggcacacgtcctttcttctctcaccgcaagcatcttcccccttccattctatccccgtgtcccgttgcccatgtcggcgaggtgctaggagctcgagcttcgactcgctgacaatggcatgcaacagcactatcgtagctccggcggtgggcctcgagggagggcggtggtggcatgctctcctcttcaccagctcggtgacaacggggacatgaggacgagttcgaactcgaggagaccacccaactccacgcgctggtgcctccgtcctcccgcctcttgcgccatgctcttagacgccatgggtgcctcgatgtcaagctccatgacggcagcggccatagccatgctactctaggccggagacgtgcttcggcggtggactcggtggtggtgggctcgtcgcgaccacccctgcatcactgttactgcgtagaacatcgtgcttgaacgccatgccgtcagcgacagccccgctgccgacttgccggccgcctcacactgccgggctagaaagaggagaaaaagagaaaaaaaaaagggagaagaaaatgtgacactgacatgtgggtcccacatacagagtcaaccagttggatcgggttaaagcgccacgtcagcgaaaccgccctccaaaaccatcgaaggagtcaaattataccagtttctcagggtcgttctacccggttttctggttaagggatacgagttagattcagcctactttaagggagttaaagttgatttttttttccactaataaaacatcatacaggcccattgcacattgcctagaaaaagacaaaagcccaatacggagaataaaaaatcagaccccaaaatgggaccgcaaaaggagtgctacgggcccactaactccctttgtttctttgtcacacgcccgttggatgcagatcgaatgctcacacaaattgactgacggattcaatttttttctggcgaccaacagacggtcccttcaattagtagtaaaaatcattaagagatcatgtcttggaaagaattggctactagtggctttcttaatctggcatggtataggattgggtgtaacatagttcggaaagaaaatcagcatgtgacaatgaatgcaggcttcaagctactttgtactcccttttgcttgcttcgagcaccaaaaactatcaggcacttcgaagctacgatgacgctagcggaaaagttctcattggaacggactatcaatccaacaaaagagttcgctcaccattgagtctgagaagtgatttttgtttgccctacgaaaaacattttacctagaaaaacagttatttgaaggctcctatttttgacgctcgatggtgcatctaggaagatgtaaaggggagccatctctagtgctatggttccttaagtaccctaagaaaacgttctaaaattattagagatccctaaaccaatggatccatcaaacatgtattttgcaagaggcatggatgagttagataatgtttagttgtttcctgaaaacacattgccatttgtgagatggttgctagttgctacattgctctgggcccatagctacttgttgctttgcttaattcgattacaatcatttttttaaggaaacccgattacaatcactggtggtatcttgttgtccttcatttttaatccataatttttgattgcaaattacccgccgagtagaaaccgtgataaggttctttttctcaggctattcatgatttgcgttcatgacatggttcaacaaaatgatactcatactctcctagactgtctaacaaattacgatttggccctctctactgttccctagcagcagaaaccacgattggtttgtcattcgggttgagctcggacctcctgcgcaatttcgattgacagggctgttgttaaagttcctcagattcaatgacaaacctcgtggggattctttgttgagtccggtgatgcttacaccaatatcttcggctcagcaatcaacctcaatctggtgccattcccgtggaggtaactgaaggggattaacggtttgtcaagcggtgtgcacttctcatgaggcccatggcagcagtcgacacaattttaagacgtcgtggctttgcagtagtcatggctcactgcagctccctgtcggcttgctcctttttctgctgttcggtttcatctggaaggctgcttccatagttcggttcaccctctcttttcagggttgtcacttttgctttcaatttctatctttggttgtgtactggggtttatcccttaactctgttcttgcttaataaagtcatttgtgtttaaaaaaaacaaatttcaagtaaatatgaattacaaaaatgtatctgttatgagttatcgaaagcatataccagtgctcaggcgaatgaatggtgttaatggttagtaatttctgaatacaaataaacttcctaccactgaatacaaatctccttcaaccctacttccctccaaacttgtttagctgcgccctgcctcaccttccctgaactcctgcggctggtcgtcgttgacgacgctggtagtatttaccgtaacgagagtccacaacaattggcttctctcgacgttgacgacactggtagtatctctcgtaactagagtccacaacaattggcttctctgatcttctgtagtttcttccaagagaagtactaagctgttccacaccacccatgtaacgagctttcctctccattgccttgtggagagcactctcatatctttcccctcttcttttttccaaacgtgacatgctccttttcgaaactgggacttcaggccccttcatgatctgattcgatcattgtgaaaatatgcagagttgtaatgctttgagtaacaattttgacagagaaacaaatcaggcagcaattgctaaatacctcaggtttttcagctactgactggttttgtgcttcagtagacctgactaatttcaggtctgctgttaccaccaaggtctccgcttcagcagccatagcttgttgtgcgtccagtgggccatgtggttccaataccaaatccaatgggccctgcatgcatatgtagttactagttacagattatcagaacaacacaaatttcacaaaggaaactctgaagctgatctttacctctgaattcacaacatcagttctctctgcagcaagattaacatgtttcatcatgttctgagtagcgatcatctgaagcggctccacatattctgcagattgtaaaggaatagccaaatccgctggttgaacctctgtagggtatacaaataagctaaacaatgatttttgtacggttgagcatcaatataatacaggaaaacagcatactattccattcttaactacttgactctcagtcatacatccagccttcccctcctactgccactgtataccgtactgaacttggcactaacattactaccatgtaataagtttctctagtgctttaacaccatgggaatcacaagaacattgctgaaaactactacatctgtcccataataattgtatttctaggatttgaatttgtcccaaaataattgtcacaatagagtactaataggtctcattaatcacttctcatttaatctttttctattttaccctccactacccttccactcttacctatacaccatttaataaggggcatcatagtatttcttctcaaaccttaatatatactccctccgtactcgtaaaggaagtcatttaggacagcgacacggtctccaaaacacaactttgatttcttgtttctataaaaatatttattgaaaagtgatatatgtatacttttataaaagtatttttcaagacaaatctattcatataatttttacattttcaaactcaacaacttgagagttattcatgatttatattcccaaggtttgacttaaacattgtcctaaacaacttcctttatgagtacggagggagtactaaacaaactagaattgcaatttatatgggacggaggtagtatataagaacaagggaggaggacattcaagcaagctgcatcttgtctgacacctcaagaaaaggtcactgtggtttaaggtgcattggatcagcatcgagtggatattttttgtttagcaaaatgatgaaaatgaatcaaccttgaccttgacttaggccaaaccaactgaaatgcaacaaaacaataacgtcaatttttcgttagtgtgatgcctactttttgttagccactaaaaaatgaccacataaatcttatgagatgtctaaacagctgtgtgggtagcatttttatgagacatctaaattactttccaaaacaatagatgcctaattgaacccagtatgcctaccatgaaatgcggccattggcaggtctccatctaaagtctaaacatgactttacaaaaaacatgtacatgttcttcataactaatagttcggattaaacagataaaattagccaatttgtagttctgtcagttcagttcaggaagcatgaaaccaaagagttataattcagtttaattctttaagaattaaatccaaaagttgctgttgaagtgattggaatgctcgccctctaccaacacagtgaccaaaactacactagcaatcaattaagatcaactcacttctcatagcaagttatccacagtaagttccaactcgtagtctaaagaagcaatccactcatatatttggaagtacctaagtgatgtgtgaaagacttaccgctatcgaccaacaaagcgggtggccatggcgtttggaaaagataagtctcgccgctgcacctaaactcagccatgaccttcatattcttcaggtcaatggcaaattgaggatagcggtcatcccaggaaacaagaaccaatccactagccactgttcggacttgtcgcaccagggaatgcctgtcaagcacttcactaaccggcatttccttctccaattcccacctcctgccaccaccgtcctcctccatgagcagccacacttgcatgtggacgttgtccatggtgccatcaaggcatacaaggcagcacacgccatcctccatctcccctatggcgtacttggaaggctggaacaagcttacagggagactgagcatggagaattccatcgtgagcgtgtcaagcaatatcacaaaattgtcctcgcatttccagaagataatccccgccgcatgcatcgcctggccccggcgaggccgcctcatgttttccacccacgggtggaagctccactctcgagtaccggagttgtactccgcggcgcgcatcctccggccatggcgctgcacggacaccacgcggaacgacgccgcgccgttgtcgccgcgcccgtgcagcaagcagtcggcaatgtaggcgtccgagaaggggtcgtcctgtgggcggcggatggagacgcgccggcgggacaccgggtcgtagacggcgacggatctacctccgcagaggagcaggcggccgttgcggcagtcccggagttgccagcggggatcctcgccgtccccgacgcggatgagcgagaagtcgcccccgagtaccgcggcgccgaggtcggggtcggagcggacggtcgcggcggggtggaacacggggaggccggagctcccgtgggagacgaacaggccgaggagaggcgacgaggtgtggcgggcgcggaatcggcggaggaagtcggggccggaggcgacggcgagccagcacttggaggctagcgcggcgcgttggagggaggccgccgacgggaggcggagaaggatctcggcgaggaggtcgtcggtaaatggctgcaatgccatccggatccggaggagtgggggcggcggccggcgcgctacgggaagaggccggaggagacgggaggggcgcggagttcaccggagtggcgaatagcaaggcagaggcccgcgacacatactgacgcacgacgcaggtcgccgccgcccgccggtgaacccccaaaggaacggtgggattggaccgttgagcagtgaggtgagcacttttcacttcgcacgagtccttgtcttcggtcgcctttcctttttttttttaacgaaccgcgtgatgcgaggttccatattaataacagaaataaattactccacaaatgtaaaaaaaaacaagaaaaaattattatctagattacctcaataaatacaatgaaagcagccaatgatactagagatattacagttgaggattaaacaaacaaaatttaagggagacgggtgtgctacttaattgcattgcatgcatacatgcgtgttttttttattatgaaacataagaaaaatagttgtcttatattttagtataaacattaaaaaaataatggttatgtcttatattttgggataggggagtagtagaaaaatgattataatagcttggaaggttataataaaaggaaaaaacaatacgtcatgttgcattcctacaacacattgctcactgttgagggacaaatagataaaaacacgtcagtacgtcaaccaaaatgcacttaaatttatccatgctattgtatggagagggagagggcaattgataaggatggagccgctcttccccgtgcaaaaccgccaatatggccatcttgagaagagcggcgcgggcggcggcgtcgggcgctggggcctgggggagagccgcgcgagcgaccggtgttgagggctggcggcgactcgtgtgggattggggatgaggagtagagctagggttttgatgcatatatggcccttcaagcacatatgggccacaagtccacaacagcatgggctagctacctcagctcattaaggctcgcgagcagctcgcgagccagttcgagctggctcgttatctctaacgagttaaaaggccagctcggctcgttagaaaaatgaaacgagccgagctgagcttggcgcgagtcaagcgagctaacaagccacgagcttttcgtccaggccttttgatgggtgagatagctgggcatggtttgggtggcttggacaccaagcgtccgtggtgatcacgagttcacgacaaggaacaacgtcaggaggagatgaggagattggatcttgtatttgcttgattaggaatgacactgtcgagctccttaaatatactatatatatagagagtatatgtttgaaagttttcaattaaataacttgctataatatttttagatagtcccaaaattttccctattacctccgtcttaaaatatagctatttctagcacaataccttatcccaaaataaaactatttcttcacctacctcctcctctcaaccaatcacaaccattctccttcacctacccatgacacattaatcaataatacacttcctccaatcattctcacatacttttttaatatccgtgtcaacctaaaaaatatctacattttaggatagaggaagtaatacattatcaacaactgcaaaattaacaccatacgaatgtgctttcgaatgcgaatacgatgatatcatatgcatgccactagatatatatatatatatatatatatatatatagttagttagttagttagtttaattattataaaaatgatgcaaatgttgctttttttcctaatattataggcgccttagaatagagggaatagacactacttttattattaaaatgaccaaaacgtcgaaggagggattttatattagacaaattttgcgacagcacactgctattgtgtggttttagccgtaggacaccgcccgaatatacttttgggagaagacactccataaacgtggtaatttatcaatggacaccgcgccgattagaataataattcctggttgaagagtagacagaaatcacgtgaaagttctaaaatacccttgagtccacatgtcatatatttctaacatctctcttctctctatcccctcccacgcttccatagccgatgcctcaccgatgacgccatgcctcaccaaggacgggggagtcgagcagctcggtggggctgagccccagtgggatggcgaagtaggacgacggcgacactggtggcggcgagagcggcaggcttggtggctgtgcggacttgaacttgggcaccgaccaccagagccaccgcgccacgaggaggtgttctccaatggcctcaacatcccggacatcatcaacgagcacctcggcgccgagccgaccctcccttacctcagcccggaccttcgtggcgccaagctcctcgtcggcgccaacttcgcctccgctagcgtcggcatcctcaacgacaccggcatccagttcgtgagtgccactgactgatcactgatcgatcgcggtcggtgagatgcgttcatggcgttcatggcggtgttcttgcaggtgaacatcgtgaggatgagcaggcagctgcagttctttgcggagtaccacaggagaggctacgcgcgctggtcggcacggcgagggcacggcggatcgtgaacggcgtgctcgtgctcatcaccctcggcggcaacgacttcatgaccaactactacctcgtccctttctcccttcgctcccagcagttcgccctccccgactacgtccgcttcctcatctccgagtacaagaaaatcctccaggtctgttagactaagcctgtcacatttagctggttagttattcatttgtttgtgcatccgtggcaggtcattggattctgtcacgagttagtttctcttttacatgttgcatgagccagaggcgcgcagagttcgcgtcatggccgagagtgcgtgtgtgtgtgactcgccgagaatgcagcgttgatcagcacttcgtgggatggcgcggaggaagtggtcatagcggctgaataggtgaagctgttagtttgttatgcatgtaatcgttggagaataaatgagataaaaaaaccagaaaagctgcaagacgttgcgcggcaccaaaaacctgtgttcttgtgttcatctctgttcgttttgctttcacgcgcgtctacacttttgtttttcctgtgtttatccaagtgatcgcgtgtgtgagggttttgccacaacaagtggtatcagagcctgagtttaacatgtcttccgacagcgacagtggccgctacactcctccggggcggcgtggcgccggcggcggcggcggcagcggcagtggcagcaagcagggcggtggttcaggcactggcactgatggtgctgaagtccccatcgtccaacaaccagcaccgagggatcctagcgtagccgtgcgctatccggtgctgacgagaaccaactatgccgaatgggcaatgttgatgagggtcagcctcctggcacaaggtgtttggggagcagttgatccgggctatgctgagttcaaggaagatcgggtcgcactagcagccattttgcaagctgtctcaaaggagatgctacgaccgttagcaaagaaggactccgcaaaggccgcttgggatgccatcaaactcatgcgagtgggtgttgatcgtgttcgtgaggcgaaggaacaggcgttccgtcagcaatacgaagcaatgcgcttcaaggtaggagaaactgcggaggagttcagcttgaggctaacatcggtggtcacggacatccgtgacatgggtggcgtgcttgatgatgagcatatgatcaaaaaattcctacgtgttgttccaaaaaggtacaagcaggtggcagtcgcacttgaacaattccttgatctgaagacaatgccaatcgaggagcttgtcgggaggttgtcgaccgccgaaagggatgataacgtggacgacgacgatgatgcgccacgcggaaatcgtctctatctcaccgaggaggagtgcttggcccgcatgaaactgaaggaccacgatgggtcctcgagcgggtcgaagagcggtggcggcggtgagaaaagccgtcatgacaagccgtgcagcggtgggcgtggtgaccgcggccacgacaacaaaagcggcggtggatcatcgtcgaccagaacgtgggataggtccaaggtaaagtgcttcaattgtgataaacttgggcactattccaaggaatgtcgcaagcctcgccgcgagtggcgggaggaggcaaacctggtgcaggttgagaatgaacagccggcgctgcttttcaccgaagtgcaccagacggtgttcctcaacgaggaacgcgtgattccgaaggagatgcctgatgatgtctggtattttgatactggcgctagcaaccacatgattgggaaccgagcgatgtttgcatcgcttgacgagaaggtgactgggactgtccgcttcggcgacaactccgtggtcgagatccagggcatgggcgccgtcacgttccagtgcaaaaatggtgagcaccgtgccctgacggaggtgtactacatccctcgcctgcgtagcaacataatcagcctcgggcagcttgaggaaggaggatgcagaggtgtccttgaaaacgccgcactaacgctgttcgacgcagagcgtcagctgcttgcgtgggtgccacgcaaaaacaggatgtataccctgtccctgaaactggccacgcctgtgtgcctgctgacgaaggcagatgatgaagcatggcggtggcacgagcggtttggacatctcaatttccgctcattgcgtgatatgagtctgaagcatatggttgaaggcatgccactggtgaaccacgtcgagcagttctgtcaggggtgctcccttggcaagcaccacagggctccgttcccgcgcgcgtctgcattccgcgcggagcgagggttcgaattagttcacggcgacttgtgtggaccaatcacgccgacaacaactactggtaaacgctattttcttttgatcgttgatgattattctcggtacatgtgggtcgagatgctcaggagcaaagatgaagcgttcaagtgtttcaagaaaatcaaggcagcagctgagaacgagcttgacgtgaagctcaaagctttccgcactgatcgtggaggagaattcaactccaatgagtttaccagctattgtgtcgagctgggcattcgtcgggacaccacggcgccgtatacaccccagcaaaacggggtggttgagcggcggaataggacggtggtggagatggctcgaagcatgttgaagagcaagggcgtgccggcacatttctgggcggaggctgtcaagacggcggtgcacgtcctgaaccgtgcgcccacgcgcgctctcgacggcatgacgccctatgaggcgttgtatcgtcggaaacccaaggtacattatctgcgtacttttggatgtgctgctcttgtgaaaaaggttgggcctggggtgtcgaagctatccgatcgctccatcccaggcgtgttcatcggctatgaagacaatgccaaggcatatcgggtttatgatccggttgcaaagaagttgtatgtgtcacgtgatgtggtgtttgaggaggagaagaagtggaactgggaaaccaatactggcagacaagatcctgactggtctggcacgttcactgttgtgtatactcccagggacatgggagacagcttgggatccaacggaggcacccaagaggtgtccgacgcaccggggcagcagtcgccggctacaccggagcggccgccgccggccacgccatccatgccgaccacctcgactggtgtggagtttgtcagtccgccgatgggaggttcgtgtgactcggaagggatgccactccgttaccgttcgctggaaaatcttcaacagacgacgctgccggtcgatgacacggtgatgtcggacgtcaacgacttcagcgggttttgcctcgtggctgccgaggagccagacagcgtggaacgtgcgctggccgaacccaattggcggcgtgcaatggaggacgagatgagctccatccgtggaaatgaaacctgggagtttgcaaggcttccagaagggcatcgagccattgggcttaagtgggtttttaaagtaaaacgagaccctgctggtaacatcgtcaagtacaaggcacgactagtggcgaaagggtatgcgcagcgccagggggtggactttgatgaagtgtttgctccggtggcacgcttggagatggtgcggctgctacttgctttggctgcacatgacggttggtcagttcatcacatggacgtcaaatcagcgttcttgaatggtgatcttgaggaagaagtctatgtgcagtagcctcccggatttattgacgacaagcagggcggtgcagtactcaggctgcgcaaggcattgtatgggctgcggcaagcaccgcgagcctagcattccaagttggacgccaccctggtgtcacttggttttgatcgatgtcccatggagcatggtgtgtacaagcgaaagactggtgatgatctactgctagttggagtatatgtggatgatttaatcgttacagggtccaaagatactgatattgaggagttcaaggctcaaatggggaaattgttcagtatgagtgatcttggtctcctgagttattacttggggatcgaggtacaacagtctagaggaataatcaccatgtgtcaaagtagctatgcaaagaagatcctagagatgtctgggatgatcggctgcaatgcttgtgcaacacctatggagaaccgactgaagttgagcaagaaagatggcagtgcagctgtgaatccaaccgagtacagaagcatagtgggaagtctccgttacttggtaaatactaggcctgatcttgcttactcagttggcatagtcagcagatatatggaagctccaacatcacagcatatggctgccgtgaagcatattttaagatatctgagtggaactattggatttggttgctgctatcgcaaacaagaccagtctgataatggcttgatgggctacagtgacagcgatatcgctagtgatctcgatgatcggagaagcatgtcaggtgcagctttcttccttggagcaagcttggttacttggacgtcacagaagcagaaagtcgtggcgctctcatcgtgtgaggctgagtacatcgcagccgcgtcagctgcgtgtcaaggtctgtggctatctcgcttgcttaatgacttgattggaggtgcagcgaagaagttcaagttgttggtggacaacaagtcggccatagcgcttacgaaaaatcctgttcatcatgacagaagcaaacatattgacaccaaattccattttattcgtcagtgtgttgaggaagaaaaggttcagattgatcacattggcacagatggtcagctagctgatttacccaccaagccacttgggcgtgtcaaattcctggagttaaggcggaagctgggtgtcgagaacgtgaaggtgacaaggcttaggggggtgatttgttagactaagcctgtcacatttagctggttagttattcatttgtttgtgcatccgtggcaggtcattggattctgtcacgagttagtttctcttttacatgttgcatgagccagaggcgcgcagagttcgcgtcatggccgagagtgcgtgtgtgcgtgactcgccaagaatgcagcgttgatcagcacttcgtgggatggcgcggaggaagtggtcatagcggctgaataggtgaagctgttagtttgttatgcatgtaatcgttggagaataaatgagataaaaaaaccagaaaagctgcaagacgttgcgcggcaccaaaaacctgtgttcttgtgttcatctctgttcgttttgctttcacgcgcgtctacacttttgtttttcctgtgtttatccaagtgatcgcgtgtgtgagggttttgccacaacaaggtccgtatacacttcgtcttcttcctctcgatcaattcgtctctgatgtgttcgtccgttggcatggcatggcattggaagaggctgtacgacatgggggcgaggcgggtgctggtgatggggacggggccgctggggtgcgcgccgcacgtgatgcgcgcggcggagctgttcaacccgcagctgtcgcgcgcgctgcaggaactcgctggagagcctgttcccgttgaggaacacgttgcagagcgccgtggcggaggcaaggtctcccaggagcgcaccagtgagcgcattgaggtggaggctgagcgtgtgcagcgccgtcaaatcgtcgtggcggcagaggacgacgccgacgccgcgatggcaacggcggacaccgcgagtccgcgagctttccgacagatagagagagatgagagagcggtggtggtgtggcagcgcggcacgcggcacgcgccatggaagtgtggccgtgggcaaccgtaggccatggacgggatagagagggatgggagagagatatgacatgtgggcccaagggcattttagaactttcacgcgatttctctctcctcttcaatcggaaattattattctaatcggtgcggtgtacattggcaaattaccacttttatttagtttctttcccccaaaagtaagttcgggcggtgtcctacggctaaaacaacacaatagcagtgtcatgtaacaaaatttgcctttatattattacttgaaataatactgtagagacctctatagttctaatggccccaggtaatgttatgctttagggctcgtttggaaaaaaaaaagaaaaagtgaaggatttctagaggatctagatctttagggtacaattaaaacaaaatattgatgcttaaatttctttcgaagatcctatggaaggagccattctatgctggagccattctatgctggtattgaaggaaaacaaacataatgtcttccctgctggaagacctaaattagtagattattagatagtctacagaaagaataatctgtagaaatatcttaaaagcctacctgatagaaaatatttatagtgccatcttattatttataatttatagtaccaccttattagttctagtatagtagacgtctagtcacttgaacaatgtggtaagaattagagaaatgtgcatgctcgtacccctcgtcaggccgggctcaggcatggggctccaaatggtcgcgcatacgccgcttttttctatagctctgctttattgtatttaacgaattatccgatgtttgtttgttaaactcactggatggtctgctgcgtggcgtggatatcatacaagcctcttgatcacacgttgcagtatctctataaataccaaaccgccgtctatatgcaacttacatgaaaacaattgccttctcttttgtattgccccattgctcattgtttactccatcacgcccgccaccatgcacgggcatccgggagagcagctatatgcaacagttgcctttaacatcctgcacctagccagagagggcggataagatttggaagtgctccgcacgactgctcattgttcatccactgtggctcattttcctatgttccatcgatgtgtgttgtcatcaatattttgtaccgcacgtcgtatgggcagtgagtgccgcgcctcgtctagaacaaaatcgtcggtatgttttaactatgtttcgtatatttgatatattcatgtctagtattgtcgtatacatatctaggcaatatttatgtgaggtgataatgttagcttatatagttatatgtttaatattatgatttatttgtatgtggtggcggtagggtttcggcagtggattggggaaatggagcggtggacggggtgctcacgatggctgcggtggcgggaaaagcgacggcgcagtgcgnggtggacgggagcgacgatggggcaccgctgaatgcgatgggaggcggtggagagagggaacacggtggagaggtgctttaggtggtattttggggaaacgggagggatgcccaggtagaacttggcacggcgttgcccacggcgcaagtggcgtggcgcgacggtgactagggcggcggcgaggtgcggctaaaaagctccggcgggcggctgcgcatggctcggcgtggggagagcgatagggggcgcggcgagcccggggatttggggaaaatgggagagggggccccggggatgctttttataggtccgggaggtggaaatcgggaccgagaaaggcgggaaccgaccggcgatgtggggcgccgacgtgggaaggttggcggcggttcggcgctgattttgcggggaggagtgggggaaatgggggaggaggaggtggggatcgagtccacgtgctcgcgaggtgaggtggagcgcgggaagcgcggcatcgtggggcgaaaccggcagccatggcggttgcagccggccggatggaggtaaggggagaagctgacgagtgggcccgcggtcccacttgtcggcgagagaagggggaggaggccgatggagggatgcaaagaggacttgcgggagagggagggggaggagctgggccggcccaaaagaagggagaacttgggccgaaaggaggcccgaaaggaaagagggggattttaattgtttttctttttatttaattggttaaatgaactttgtgctattaaaattatttcttagaaaatttacagaaaaatccggagagtatatttaggcacagagaatatttcaaaatatttccggccaatgatttttaaagaaaattttaatttcctttataatttcccttgattaaattactttaaattttaatataattcctagaaaatgcattactaattgatttttaatccccaacgaaaatcggggcgttacactcaacctcctgctgcaggatcagaaggttttaacgaggtacgccggccatcacccatcgggttggctgcataggctgacacgcagcctcggccgctgccgatggagaggatctcggtcacaggacaggatcggtgatgttgtcgagggcttgcagttgcaatagcctggctgacttcaatgtcaacgccagcacgaccttatcgatgagctctacaaacttggcctataagcctgatctgcctgtacgtcttagtccatgatctaaaattgtgattcctgatttatgagggactatgagtctgatctccctgtatcagactatcagtccatcatctattttgttttttcttcctaatttgtcagggttttttaacaggggaagacaacgaggtgatggaaaacaacaccgcctgccagatgcagtatgttagcagcgtgtatttgtttgacgaattgagtttgcagcgcatatgtgaaggatggttattgtaatgtgtgaaggctagggatcatggtcacttctgtacatgccacaacacggtatttgcactcttctcatttaatctactagcccataggccccatacaaaactaaatgttagtacatgccagatacactattcataattttgccactgtttataggtcaattttttccatgattgataaaagttcaccttcacatctttttttaatcaacgctgacattaactaactccttaattatttacttgcatcctgtacattgactgagcagttctcttcaaaaggaagaatgtcatcacaaacaacaatgtgggcatgatctactgtcaatgtatgaatactaattgaatatttgttttttttttcatatacactaattgaaatagtactaggaagagagctataatacagtaaggtggttgttcgtcacaaataaaaatcaaggatggttattcaacaaaattatttccacgctgattcggcacttcagatttctactgcttgcattgtatcaatatttttagatgattatattactaatattattgatgtacctagaaattatacatgttatgttgtaatgtgattcgtttgttaatgacaggaattaggaaatatgggaagtggtgtttgatgttttctcatacagccatatttatattatatctggtctatgcaagaccaaattttgcttaggaaaaaatatttgacaaagaaaaccattttgcaagtccaaaaaagaccaggggacttacatttttgggctagtctcatattagccaaagagtcttttcaaaggttcggttccttcttattacaagatggctcacaagtaagattttgggaggattgttggataggagttcaatcctttgagaaggagtatcctaacctctacaatctagttagaaataaaaataaggtggtggccaaggtaatgagtggaataccgttaaatctgtctttcagaagatcaatagtgggaagaaacttggaagcctggtatgagctagtgtcgaaagttgttaacactgtattgacagatcagaaagatcgcttcttttggaaaaacaataaagaaggcattttcacagtaaaatctatgtacaagttcctcatgtatgaagggctggttcctaggaagaatttcatttggaagctcaaaattccacttaaaatcaaaattttattgtggtacctcaaggaaggggtaattctcactaaggataatctagcaaagagaaggtggaagggtagcctaagttgctgtttttgtaactctaaggaaacaatacaacaccttttctttgattgctcaatggctagatatatttggagtgcgctcctttttacatttgggattaggcaaccgtgtagcatgtctcaaatgtttgggaattggctgaattgtgttgaacctaggctcaagagaatattgtgtgtgggcatagctgtatttctttgggcaatttgattatataggaatgatgtggtctttaatggctccaatcctacatctttcttgcagatcattttcatgggaacacattgggcaaggacttggtctttgcttcttaagggaaccgatgaagaaatagttaagaactattgcaaagtgttggagaagcatgtggtggaattcttctccgtgtatggctggaaccttagaagaagattggaagcctagtcttttcttcgtttgttgttcttaaaacctttgtttgtgctgtcatctcttatgtaatgggagaggtcagttgatgcattttgtacccttttattagggagagtcttatgtactcgtgttcggattttggctgtgtataccccacaaaggtgtagaggccgggtttgataatcctttatctaaaaaatgcaagctcatgtggttaattcattctaagaattcttccttctgcctggctgctctgatcttttcttactacatcgagataccgtcagatcatgacatgtcttctcttcgtccgttgcaaaattgtgtgtgtgtgtttttattaatcactccatcttctgccaaattgtaagtccatacctttcatttcatctggaccctgtgaacgggaccggatttcctgtctagatttgtcttttttaactaatttttaacttttttctattcagtgtactgatggtctagatggtgcatggatacaggaggctgttctacactggtggagaaaccatctttcgtcggtcggccgaattccacaatagtttcggttgcaataaaaaccggggctaaagatgattttagtcccggttaaaaagggtaacggacatatttaatttttagtcccggactaaagatgatctttagtctcggttcaaatgctgtcagggcctgccaggcctcccccggattaccaaccgggactaaagatcgtaactttagtcccggttagtgttaccaaccgggactaaagatcacggggatctttagccccggttcataacaccaaccgggactaaagtcccacccctatatatatgtcttcttcctgctccagctgcccgagcaagcttcaaaatttcttcaaaaaagaggggaggtcatgccaaaatttctagtgaatttattttggtgattatatacaaatcggaggtgcctaaaaggttagtaacttcatcctccaatgtttttttttgtcatattacatttggagctatgttttgcacacttttttgtctccaaaatttagttgtaagttgatgagagagaaaatttgtgtgggggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtcattattgtatgactgttgaaagagtttgtaattattttataattattgtatgactgtcattattgtacgaataattatttatgtatgattttttttcttttcatgtagatggatcggcaatggatgtacgctgaccggcggtccaaagagtttattgacggcgtgcattattttttgagagtggccgaagctaacaggcataagggttttatttgttgtccatgcaataagtgtaagaatcagaaggagtattctgcatccaggactattcatttccatttgtttgagtcggggttcatgccaagctataactgttggacatcccacggagaggaaggggttgaaatggaagaagatgaagtggaagacgataatattccggactttagtcaggacgctggatttgaaggaaatcaaatgggcgaggaggaaagggatgctgatggtaacgacgttgcggatgatcttggtcagatgttgcaggacgccaaggaggactgcgaaagtgaaaagggggcccataaattggacaagatgttagaggactacagaacgtcgttgtacccaggttgcgagcaggggcacaaaaagttggataccactctggagttcttgcaatggaaggcaaaaaatggtgttagtgacaaggcatttggtgatttattgaaactcgtcaagaacattcttccggagggaaacaaattgcctgagacaacgtacgaggctaagaagatagtctgccctctaggactggaagtttagaagatccatgcatgtccgaatgattgtatcctatatcgcggtgaggagtacgagaacctagaagcatgccctgtttgcaaagcactacgatacaagattagacgagacgatccaggagaagttgacgggcagctaacaaagaagagaattcctgataaggtgatgtggtatttccctataataccacggctaaggcatttgttcaggaataaggggaatgctagaacgatgcgatggcacgctgaagagcgtcaacaggacgggatgctgagacaccccgccgatggttcgcagtggcgaaacatcggcaaaaaatttaaagactttgaaaaggacgcatgaaacatacggtttggtttaagtacggatggcatgaatccttttggagagatgagcagcagccatagcactttgtcgcgccccaaaacaaccctaaaatacatcctctaaattatgcctagaataattaaaatccttgtgaaagcctttaaaaattaaaatgtgcaaagttaaaagtcaataaaggcttggaggattttttgtatatttcctaaaagcctaaaatgtgtaaataaattttagtggaattttcagagcacaaataataattgttaagaaataaacaaagttaaaaatgttttataaaaagaaaaaccctaaaaatcccccttccctctcttgggtcggctcggcccatttccctccccctctcccttctctccccgcggcccatccggcctctccccacgcgcgcgccgctgacgggtgggcccgcccgccaccctcgctgacgggtggggcccacccgtcatctccttcctcccgccgctcccgccgcctcgcccgcgcctagcgccgccgccgccgtgaatcccgccgcctcccgtcgtccccgcgtgaaatcaataggggggaattactccccgtgatcccctccccgtttccccccattttcccctctctctctctctcgcattcaaacggctggatttgctcccgcaaatctcgccggcgccattgatggcggtcggacctcccggccggtttccttccttccccggccgccctctcccccttccaaccccatttaaaccctccccgcacctccttcgcccgtttccacccttttgccgcaccttctcctcgccggaatcgagctcgcgccgtcgccctctctctcctccgtcgccgacgaccttcggccggctctctccgctcgccgggaccgtttcccgccccagcgtcgccttctccggcttcgccgcaccgccgccgtcaccgtccacccccttgtcgagctcgccgaccgccagagcgccgccgtccccgtccgcccgagccgcgccgctgccttcctccgctccggtcgcctttttcgtcgtcgccgtcgacctagagtgagccgtggaccgccgcctcgtttccccctttccctcccctctctcggacgccgctccgccgcgcctatggctgccgccggcgaccataggggcgcaggcgcgccgcctcccgccggccacgccgacgtggccgccttcgggcgcgccgagcggctgccgcgtggggcccggccgtcagccgcccgcgccctcgggtgcggctgacgcgtggggcccacggcgccggccggtgcgagcccgggtgcgcccggtccaccgtggaccgtgaggctgccacgtgggccccactcccgtggacccggtccgcgcccccctccccctcggctgacgcaataatccatttttaaattaaaatttaaatgaagaaattcgtaaatattcatttaaagagcatataaacctcaaatggccataacttggccatttgaactcggaattggaccgttcaagtctctaatttttccttaagaagtcaagaacccatttttgtgctttgttcctacttgttatatgaagtttattagagtaaaagcctttttattttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattaatgcattatcgctttatttaaattcccgcgttatcactgttttatttagccatgcctatttacctttgttatgaccttattattattgctattattattattaccttgttcaccctagactaaacaaaacctccaactagtgggtaccctatgcgtggtaccactagtatgaatttaggtagatgcttcgctggttaattaggcaacattaggtggttttacaactctagactttgggagtattcatatcacctggacactatggaatggttggattattgtggaattggattcacacctccccctctattcaaaatcctcaaaatggttttaggctgggctcggggtgcatggttttgatagtagcgcctcggccatataaggaccggtcttcgggcttctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcctggtagtcgagatgtcatggcacagggctggtgtcctgctgctaggggctcagtcctgcctacctgtcccggaggttccggccgtaggtggggttgggtcggtactcttgtctatggctaggatgggttggaaactatgtcacatcttccgtccgtataccgtggtggtatgtggcatgtggttacacgtgaggaagatgtgtcttgtgggtaaagatgtacacctctgatcagagtataacctattcgaatagccgcgccctcggttatgggcaagcctagcaatgtacccaagttagtgttttaattcttaaaacctgcttaacaactaaaatatggaatggttggcctgggttggcttgggacgagctgggacccagggtcgggttgccagttcggtctgaatcatcgtaggccttgggttaaggcaggttcgtgtgggttcatggccttgattaataatcttgtatagctctaggatcgtatttacaaaataagctttgagcaactaagtgtcttttaatgctgtttactgcaaaccctaacccctcatattataacccccttgtactcccttgcatttattctgcacttgtgggtgtgtcttgttgagtatggtggttgtactcagtcttgctcaatttttcccaaacccagaagaggagttcctggatgatgaaggctttggtgtctagctcgtgcctgccgtcaagcgcctatggtcgtcgccctagtcttccgctgtttttcgtttgtcttcttgtgtgctgggccttcgccgcccatgtaataaattaattatttacgcttccgcttgttaaactctgaattgtatcaacttttggtgtaccttgcctcctaggacaaggaataatacacgcacgtaaggaacgcccgttgggttatttccggtcgtgacacacttggcccgttacgatgtgtatctacaacctccctcctggctatgtatgaagaggaagtacataatgataccaattattattcaaggccccaagcaacttggtaacgacatcgatgtgtacctaggaccactggtcgaagatcttaaactgttatggaaaaaggaaggtgtccccgtgtgggacgagaacaaacaggaggagtttaacctacgagcgctgctgttcgtaaccattaacgattggcctgcacttagcaacctttccggtcagtccaacaaggggtacaaggcttgcactcactgtatggatgaaacagaaagtacgtatcgtaagcactgtaggaaggttgtgtacatgggtcatcgtcgattccttgctgcaaaccacccggtacggaagaaaggcaagcactttgaacataaggcggaccaccgtacgaagcctaaatatcgcagcgggaaaacagtgtttgctatggttaaagaccttaaagtagtgttctgaaaggggcctggaagccagcctatagagagcgaaggtggtcacgcagcgatgtggaaaaagaactctatattttgggagttaccctattgggaattcttggacgtctgccacgcaattgacgtgatgcacctcactaagaacctttgcgtaaaccttcttggcttcctaggtgtatatggaaagttgaaagatacattggaagcatgtaatgatctaaagcatatggaacaactcggcgaccttcacccggaaccaaaggagaaaggaagccattacttgagtccagccagctacactcttagcaaggcagagaaggaaagtatgtttgaatgcttggagagcataaaggtactgtctggatactccacgaatatcaaccgaataataagcacgaaggagaagaagttcataaacctaaagtctcatgactgtcacgtgttgatgacacaactgctaccagttgtaataaggggtatccttccagacaatgtccgggcaacaataacaaagctatgtgctttcatgaacgcaattttgcagaaggttatcgacccggatagattagaagcccttcagaatgatgtggtgcaatgtcttgtcagttttgagttgatatttccaccttcatttttcaatataatgaagcatatgctttgtcaccttgtcaaagagaacagtattctcgggcatgtgtacctacacaacatgttttctttcgagaggtacatggcgtgttctgaagaagtatgttcgtaaccgtgctcgtccagaggcaagcatcgccaaggggtatggaacagaggaggtcatcgaattttgcgtaaaatttattgaaaaccttcgcccaatcagggtacctgaatcacgccatgaagggagactacggggaaagggaactctcggaaggaaagcaataatgacggtagacaacaatttattccgtaaagcccatttcacggttctgcaacaatcttcattggtagctccttacatcgaggagcacttggctctagttcacgctagaaacatcggtaagtccgatgcatggattacacggcatcacattgatactttccccgcgtggctacgacaacatctcatgggtaacgagacgatcaaccaacaactggccttcctggcgaggggaccatctgggtcgatcgcgacattccagggatatgagatcaatgggtacacattctacacgagagcccaagacatgaagagcatgaaccaaaacagcgcagttcgtatcgatgccatgggacacgatggaacaaccggcacgtattacgtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtctagcaaaggaaagaagggtagagggcatgacgagccgaagcgtcacgtggttcacccaggcaaaagaaaaatcgtcggagttgaggacaagactgacgaggattacgattagttggatgggcaacccccttccacggtgatgattgaccctagcatcctcctatcaaatgaagacaccccttactcacgtagcgatcacaaggagggaacaatagtgaggagatagtacgtgcggtcaaccgtcaccgccgatgtattgccgtaattattgtatacacgatgtaaactattttggatgtattgattatccatataaatcaattgttgtatggcatatgttaattacgtacgattattagaggttttaacagttttaaatcatgtatatgctagttatatgcaataattagaatttttaaaagttttaaatgatgcatgtggcatttacatatgttacttagagtttttaacaattttaaatcatgcatatgctagttatatgcgataattagaatttttaaaagttttaaatcatgcatgtggcatttacatatgttacttagagtttttaacaattttaaatcatgcatatgctagttatatgcgataattaggatttttaaaagttttaaatcatacatgtggcatttacatatgttaattagagtttttaacaattaatttaatatcattcatatgctaattatatatgattattagaatttttattaattttaaatcatatatttgcttattacgttttatccacttaatttactacagacaacaataatttttcgaagtaattgtcattaatttttcgactttaaataattttagtgcattattttctattttagaaacacatatgtaatggaaatcaatattcagtgcgtttatcagtagtcctggttcttaaccctaaccgggtttaaaaagaatttgaaaatagagggaaattatctttagtcccggttgatgagaacaaccgggagtaatgatatctttactcccggttgttgagaacaaccgggagtaaagatcttatctttagtcccgattgataagatctttactcccagttgttcttgttctcatcaaccgggactaaagatttaggggtatatatatattcccgatgcgcgccctcgtcttctccaccaacacttagaagttttttccccgatcgatctctctcggcttctccttcgccgccactgcctagggcatccccgcgccgacgccgccgtcgtatctcgccgttgtctcgcgggcgtcgtcgtcgccgcctccgccgcctctgccacctccgccgccgccgcatctctagggtgagagccgccgccgcctccctctctctccaaccttgatctctctctctctctccccaaaccgccgccggccgcctcgttgccgacgccgccgccgacgtcgtcgcggccgaacacgactccgccgcgccgacgatgccgaccccgacctcgatacggcagccaccggcgacgacgtcgcgccggcagtgccgacgaagccgggccaccgcgccgccgcgccacgacgccgggccgcgccacgccgccgcggcggcacaacgccaggacgccacgacgccgccgcagcacgccactgccgcgctgctacgccgccgccgcgccgcgcgccactccgccgccgcgccaagccgcagccgcgccgccacgccgtcgccgcgccgcgcgccactccgccgccgcgccaagccgcagccgcgccgccacgccgccgctccgctgccgccacaccaccgctccgctgccgccacgtgaacgaacgaacgatcgtgaacgaacgaaacgtacgtgaacgtgaacgaacgaacgaacgtgaacgagaacgtgaacgaacgtgaacgaacgaaacgtacgtgaacgagaacatgaacgcgaacgaacgtaaacctaacgtgaacgtgaacgaacgtgaacttaacgttgtatgtgaacgtacgtaaacgaacgaacgtgcgtgaacgaaaagtgaacttaacaagaacgcgaacatgaacttaacgtacgttaacgtgaacgcacgtgaacgaacgaacgtaggtggacgaaacgtgaacttaacaagaacgcgaacgtgaacgatcgtgaatgaaacatgaacttggtgagaacgcgaacgtgaaatacaatatatgttactttgcgtttatcctaatacatctttttgtatgttgcagaaaagacgtagtcgtcgtcgtccctcaagccggagtggtagctaaccctcgaaggaattcgcgcaggcaagtgatgtaaatatatgattgttagatttttaatgcaattaagactattagatttaatatacgacacttggacttagcatatatgattatctaagtttgaaatgtacgacacttagacgacttagcatatatgattacctagggtcctaatatacgacacttatacttagcatagtataagattattagatttgtaataagacagcatataagattgtgtagggttctaatatacgacaattagacttagcatatatgactatttgagttttaatataagattattagagttctaatacaagattatttgagttttaatataagattattagatttgtaattagacttagtatataattattgtctagggtcctaatatacgacacttagacttagcatagttgactattacagttttaatacaatattatttgagttttaatataagattattagatttgtaataaaacttagcatataagattgtgtaaggttctaatatacgacagttagacttagcatttatgactatttgagttttaatataagattattagagttctaatacaagattatttgagttttaatataagattattagatttgtaattagacttagtatataattattgtctagggtcctaatatacgacacttagacttagcatagttgactattagagttttaatacaatattatttgagttttaatataagattattagagctttaatataagattattagatttttaataagacttagcatgtaggattgtgtagggttctaatatacgacagttagacttagtatatttgacttagcatatatgattgttagcatataagattgttaaagcaaaaatgacctatagacttagcaaatatttcttgtatgaacagatggctgatcgcgatgaggaacagatactgtacaatacaatcgtggagggaagcagccagtactggaacgaagaagaggggaacgaggatccaaaccagtacttgaacgaggaagggaacgtggagagggaagcggaggggaaccaggaggggaacgtggagagggatgtggaggggaaccaggaggaggaggctagtggaagtcaaccctccgctggacagaagagggcacgcaggcaacgaggtgccacgaagaaactagagggtcggcacatcataacggaagtggacgaagatggccgacctagtgccccagcggaagcagccaagaactacgtacgacacagctattgggttgtgcgggataacgtgcctgtcagtatggtgtactggcgcagaacaagggcacgcggagatcatgagagctttgtcccagattcggagaaagagatgctgtggaccacaatgctcgagacattcacccttcccgcgggtacagaggacaaagtgaaaaggtggactctaaagaaaatggcagaactgtttcagagcttcaagggagatctgtaccagaaatatatcctgaaggggcagacaccgaacttcgacacattcccaaagctaagggatcactaggacgagttcgttgcatataagacaggtcaacaagggtaggcgatgatggaaagaaacaaagaaaatgccgccaagaagaagtaccatcaccacttggggtcaggcggctatagcgtcgctatgccgaagtgggaggagatggaggcaagcttgcttgagaggggtatcgaactggccaccgctaaatggctggatcgatcgaagtgctggtactatgctcacggtggaatgctcaacccagttgatggctccctggtcttcagcgatcagatacgcgaggctacgcatcgactaacggacgcagtggaagcctcttcggggggcacgttccgacccgacagagagaaggacgagctgtcactcgccctgcagactccagagcatccaggacaaacaagagggaaaggagtgattccttggaagattggattcaaggaggacatccacacgtacaggagtcagatgaggagcaagagagataccgaggcgaagattgtagatcttgagtacagggtatcgagctacgagctaagcatgcaagaggaggcggcaaggaaggttggtgaacacatggccgcacatcggtcccatgatccccagccgaccattcctcctgcaatggtgagcccttcaggcaatcgtagcagctgcgcctccacggggcaggtaggatcacagagcatggacgccatgcaaacccaggacgaaatcacctgccccgttgatgacatcactcagcggacaccatgtgagctgcatattcccttcaagaacttatcaataaaggtaagctcgtagtttatagattttagatttgtccattccgcaagttgctgcttatatatgttgattactaataaataacctctcaccacgtgaaggtggcgtcgggcatggccatcccgacggacccttcaggtacttaccactgcaggccgattccagcaggatactccaaggtcgaagttgagttggtggaaggtgcgtacgaggacctcgagttggattaccctggaggagacggtgagtcgcatctacgagacacaagccacgccattatactatggcgcaagcggtatatcatcctccctggctgacaagcagcgtctcgtgcaccatctcctccggctccaccatctcctcctccgactccgccatctcctcctcaggctcctgcaccgtctcctcctcatgctccagcaccgtctccacctcaggctcctacaccaactcctcctcaggctcctacaccaactcctcctcaggctcctacaccaactcctccgcaagctcctcatccggtaccttccaagtcaagggccccccaagctccaccgcatgcccccacaagggcaacgaagaaggcgaaagttgacgccacaaaaaacaaggacccggggtacgattgcatgcaagaggagcttgacgcttatgtggcatcataagtcaggagacaattgaagcctcgaagtccagaaaagaagattcctatagacccgagtgccaggaactttttcaggggtatgtctgcacctaccaaggaggccataaagctatcggactatgagcaaaccagtccctcagcttggagaggaaccaaaccaagagatcgagccgttggtgaccggtgaagattttggaatacaagaatttattaatgacaccgggctaactatggatcaattgctacgaggcgcaccaatcgaaaaggcggaagtgaaatacatgtacgaactcggtaaaccgcttgtcaagcctgagcagctgcagtccctacccagacaaatatacaagttccatcaactgtacatggagatgagcgccaccggtagagagatgatcggagcgaggatcagggacacggacttcttgcaaggagatgacattctcttgatcaatttcaagggtatctacgaactataccagctggacgccctcgacgtctctattatgagttgctagattttgtaagtatcgttcagttagatttcttattacgtttcctttaattaaataggtccttgtatataagtagactatatataatatatacttccttttatcgttgtagaatggagattcaaagggcccgacggcgggggggttttgatactggattcattgaccctcggaaagtaaacgtcgcaatgctcgaccagtatccgcaagccacagaggacaatctcgtccatctcttgaaggcgcagcattacaagacgttcatactattgccgtacaacacagagttagtttttactgtcttcctataccaaatatcattcccgcacgaacatgctaagtgtttcatatgtaatgcatcccacgcacattgcagattccactgggtccttttactcttcgacctagaggcctgcaccgtcaacgtatatgactcaatagataaaaaagtctacgtttgacaatgttttcgaacttatagacaggtactgtcataagttcctatgttaattaagaatcttgttataattaattgctactatgaatcatagctttaaactgcatgtagggcttggtatcggttccgtcatttggtccgcggcaaatggagagaaagacttaggcagaagttcaattttcctgtgagtacacatgctctacatttatattcaatctccaattcaaatacatacaagtgtatattaattagatctcttgccgtttgtcatttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattgcgtacatatcgatttgtttttaattactaattaatttcatacattcatatagtttattcgtatgagggataacctgatcacacacaaggaatttatcgcggcggttaaagaacaactcatgggattcatcaacgaataaatccttgatcccaagggtgaattctactacgacggaaatacaattcattggtccttagcttctgagataacgactacgactactactacgtcgaaatcgtagctagctaggacatcataatggattgtaattaatacatgtctatttttctatatgcatatacacattttctttaatgtaaatatatattttggtcatatatatatataaaccatgcagcaacaaggccatgcaaacaaaaaggtcagctcgatctttagtcccggttatttcacccgggactaaagatagcgatctttagtcccggattggtagtcccggtttgaaaaccgggactaaagggggttacgaaccgggactacaaacgctttctccatcagtgctatccgccaatgaggtgcctgccctgccaactacttaggagtgtgccagcattctacatggttgtcgcctccatgatcacttagcaggtcagtttcaacactcggcctctctcccttttcccttcccacgttcttatggtgctctttgttctcatgtgtgtgttgcaaaaagatttgctcgatagaatgcttattcgatgtaatatcgttcattgcaatttttagatttttatgttcattactactgcatggcttgatttggaagacaactactgtgaagagcatcagaagtggcaatgacaacaagctatggtgtattatcccagaaatattgccatgtctgcgtgttgtatcttctcacacttatcttactttcatctggtgtaagcaagcactatgtttcttcacttatctgtttattatgtttctttcaatcagtttttaatggcaaagttcttctttgcgagaaattgctttgtaatctgtagtgtgcgttgttctgtaaggaatcatcagtggatcacaatccagttgtatatattacaataatagtattgaggatttgatgtataaattgtttagaccatgaacattaagatgaaaaaattaatttgtgtcccatgatgaatccaaaattttgtatttagttattttgatcacttatatttacattaaccaacatatagtcccataagctttagatggtatttttattaccacgattaatatgggttgtgcataataaaaatatttcatcttgcaatatggcaagtttggtttatattagttaaagaaaatatgtccgatttaattgatattggcttctacgtgcattgcacgtgcatgatcactagtaaattgaataagatataagtttagtttacaatttaattatatcatgcaagggtaattacaagaaaatcataaccagcattcaaagcacattaaataagttcaatttagcttaggatatagcacaagaataaatcaaaaatcatcagtacatggacattcataataaaatttcacgcacattaagaggatgtttggttgagtgccaacctttgctaatgttgtggcaatcaagtttgaccaattaagcttagtgtttggttcatgccacaagtgagttatgccacaatttttcagtaagctggcccacttgtcattgagtggttttttttgccataacttaccacaattgtggctaataaattcttttttttaaacaacccgcacaagatagtgtgacgtttctattaataaaaaaggaataaagtacaagcctatagtcctgggagactatagttaggaaaaagaaaatatacaaccacaccacgcgtctacgactgatcctactgcttaaacaaaacatgcacacaacaccccaaagcaataggacttctaaacgacgcctccaagaaggaaaacgacgccaaaagcgccgccgccgtccgtgctagataaccaagacaaggttttgacatgaagaacccactgggaaacaatagaaaacacggcaacgccccaaggggaaaacgacgcctacaggcgtcgccgttgccagcccaaaggctaggcctttgcctgttgttctactctccacgttaaacagtgcttgccattttagcagaaccaccatctaatccccttcgacgtgcagccactgcgccgacgcctcgccgagggccaggcatcaaacaagagtctccaccttcaccgtgcttcacgtccatccacgtggttgggttggagagggagagggtgagagagaagaatggatcccctctcccccgcactcgcccgtctagcgtggccatcttacggcggcaagccgccaccgcaagagggcagacgcctggaaggaagctcgccgcaggcttcaacacccctgtcgacgtttgatgtcgcgattccggtatttgcatagtatggggatcgttggtaccagggtatatgcgagattgtaataaaagagatggggacgaggatttttatacaggttcaggcccctgaattgtcaggtaatgaccctactcctgttggccgaagccggtcgttgctcttattcatcataatcacaccagtacaatatttagggtagcctatctatttgttgtcgacttggcgttctgaagtgttgactcgtagtcgacaacagggtagccttcctcttcgaatccgcatccggcgagatcaaaggcagtgcttttgtctctcctgacagtatctgtagacaccataggggactagccatgcttatctctgaagtcgatatccggcgtcttgtcttggcgtatgttggcttgtatgttgatcttgtgtcttgatctattgttccgtgtcccctctcctcctagggggccttgtatttatacccatagatgtccccttgtccaagtagaacttggaaaaccaatatggatacaatccttgtcgtttccatgtagaacactattcatccttccttatgcggaactcctcctatatctaaaggttgtttctatataagacatgctatgtggtgggtcctgccaagatttagtcaactactattaggtatatggtatccataaccctgacaaccccccgcacagcatgaccgtcgtcgctgcctcgactagaccacccgtgttccaacgggtgcttggtcgcatcatcgtcgcctccgtcctcctcaccgcagccatcgcctcaccgttaccaccgccgacgggcttcaccaccgcccccggccgctccgtcgcgccgtgcagccgtctcctgtcgccagctgtgccacgtcaccctgcgccatcatcggccaagcctccgctatggccgccactgcggcctcccgcgcgcgccggcctccgcagctcccggccgcatcaccaaccacggcctccacgagcgccggcctccaaccgtgcctccccgcgcgccatcctcctcagcctccgccaccgtggcctcgccatcaccactgcgtcctccacatgtgccggcctccttcaccggcggccgccagccgccagccgccaccgccaccttcggctcccatcgtcgtcgcccgagggcttgctccggccagatccgtcatggaggcaccggatccaaccgcggggaggccagatccagccgcggcggcgccggatctgccgtctccaccgtctccacgccgcgtcgtcaacctttcctccacgcgtcggcccgccatccacgcgcggagacggggcgccgtcgggggttggcctcgccgccgccatcccggctggccgcacggttctccggcggcgcgctccgacggcggcgaggggagggagagaaggagagagtggtggcggcgacgctagggtttcccctgtgtcgcccgcgtgtgggcgacgcgggggcgagagaatcctggttgccgctaacaaattcttagccatacaatgtgtgccatgccacactttgacaaatattttggcctaccttcctactttctccgtcccaaaatgtagacattttttaggttgagacggatttaaaaaaagtaggtgagaatgattggatgaagtatattattggttgaaaagagaaggtaggtgaagaagaatggttgtgattgattaaaagaagaaggtaggtgaagaaatagctttattttaagactaggtactatgcttgaaatagtatattttaggatggagacagtagttaattgtgacagctaaaaaaacacagtagcgaggtttagattctcgcccttttctttattcgacggtacgcacgttaattttggtttgcttgacgtggtgttcaacagcacgttgccgtgacttggatagcaaaacagaacgctacggtgccccggctaggggagtaaagaaagggtggaagaaagatactcgagcaatcagcgataccattccaaatgctagatgacaaatctccctttgcaggctcgcgcagcgtcattctcggagtcatcgcttccgtccttctgacccatcgcctgctttgggaaaccaaccttttactactctcacttcacctgctatctgaagtatcgaaccccttttctttcattcctgtcctacgcagctctcccttggacctttgccgccacaaccaactactgagagcaagtttaatggctataaactgaaatataaccttatacgaaggaaagaaaatttaagaaaataaaaaggttggctctcatgtctaatagctaactattcacatactttaaaatcaaaacattaaatgtataggtgagagataaagataataagaaaaatagagataatcttataacttatctactatacatgttaactctaatatacatgttaactctaatattagttataagcttataattgactctattactaaactggctctaatataagttataagttcatagttgactctattattattactctcagagtgaagtaatgtggtcgtttttacagtgtggtacttgttgagatctagacgcagcggcggagacagcgtgggggcttgggggaggggtctttagaccccctaccgtaccattagagccccccataataccccctaaaattataatccatatatttatactttgtattaaaaatatagctaatttatatgagacatgtattagtttttattgaccactttgtttaaccctgctataattttattctagacgtacctacacggaggcaaacaacgttccatttaccaaaaaaaaataagtgaatataaaatcttggaacacaaattgcttttcacaagttaatgcacgtacgctaattggggcagctgtctatcgatgcaacaatcgcattttacagtgccaacatcatttctcttcatcttcagcgagcagctgggattgcaatctgcaattgctagcgtctggtttgaagtttgaacttcttaaaactcagcgaacagctaggaatacaacttgcaaagtttcaagtttgaacatttcgctccgacgatgaaagaatgcagtgcagcctctttgaggtggttgggcaaacgcgagcacccaaacaattcgaggagccagcgtcattaaagtcagtgaggacatgagcgaggcagccaaaccctccccatcttccgcggttggcctttggccggggctgacgccaagccacgctgccgggccaaaacggctgccaccgatcgatggcgacgaacggaagcggccaagaaccgctcgcgcgaaccgcgcctcagccgcgtactactaggagtattataacgggtggcctttttgccatccccacgcgcggcggccggatccggatggatctccccttgctttttgatccaacaacaagcaggagtattgttctgggtggggtggcgaccgcgggaacgccaaggctggcgtattgggcgttgtcaaccgtggtgcgtgatcgtggtatcggtggtgtgaggagagaaagtcaggagaccgccttgtcgtggcgctctcccgtctcgacgtacttcgggagagcacgagcttggggttggacgcggacgacgacttttcagcggggaattaacaagaaggaattcgaactgaaatattcgctatatgaatatgggttaggtgagatgaaagttgggtttctcttaccgaaagttgggtttcccttaccgtcggtggtggggttaccgcgccttgacaataagcacaggtacaacagtaactgtgacaaaccgtaagattccgtataaaatttatcaaaatttttaaaatttatttaattttatagttaccatgattttaccttttatcttacctagtggtaaactcaattaccacgaaacatgcgtagttaccggattttataaagcctgaatggaaggtgcaaaacggaccgatgatattttagaaggtttgttggaccaatgaagtcttcttaggccctgtttaaattctaacttttttcttcaactttcaacttttccgtcacatcgaactttcctacacacaaattttcaattttttcaattttttcactacatcgttctagttttttcaaacttctaattttaacgtggaactatatgatacgttgaattttacaaggcagttgtttttcatccggaatataattaagagaaatccatgcgtaggccatgtagtatcatatactcctacgtcccgtgtggtggtccagatgagtgtgtgctcagatagtcgcactgaccagagtctgccgtccagggcgatggttccattggaccaccggcgagtcccgcttgaccgccacggcgccacccatgaagttcgcctcacagtcacacgcgctcagacaagcatcctaccactactagtcgctatactccagactagtgccaccgccacggcgcccgcggcttgctccgtcctcgtggatgttaaaaaaataccccttgcagccgtccggggctcccgtcgcatgcacccccagccacagctacaggccacagccaggcaggcagcgaagccagcgacacgcctccgccttcgccgcggcccgtaccccccgccccacgctgcttctcccaccacctgcctcctctcctccttcctgctcctgcctcctcaaccccacttcacctcaccctcctcccgcgcgcggtcacggactagccgcacgccacgccgccaccactagctcgcttcatttccaccgcacgcacgcacgcacgtacgcgcgccgcgccggctccctcccgccacaggtacgcgcggggtaccggcggtgtgtgtgcgtgtacgtgcgcgtccggcggctcgcacgcgtcgtccgtccgttgatgaggcccgcgcgccggggctggggagtgggtgccttggcgcgggcgttcctggttctgctgctgctgctgctggccgcggcaacgacgacgacgatcggcttcggctgccgaggcgcggaggccatccgcgtcatcccgccgcacgggccggcgccaggcagtgcgaggagtagccggggccacggccatcgccgaagccatggcaacgctgcccgggtggtggatgctgcaatgccggtggtggggacgaggccggtgcccgcgctgtcgccggcggcggacgaggagagcaagcgccggatcccgagctgcccggatccgctccacaaccggtgaccccctgacgcattgaccaccatgctctggcacatgtgctcgccacgctgctcctgcatggatcgatcaacccttttgtctttcttgcctgcttaatcctctcaacttctcttcttttgttttctcaacttctctgtaattagtaggcagccagctagatagggctttgtattggaagaatctcccaatccattcctcctcctagcggtaagaggggatcgagattcttggcatacaaagccctatcatgcctcaccactttatttatgatcgatgatgatgagaaatcaatgaaaaaagaatgcaaagatctatcagattcagaaaaaggctacttccaacggaagaagaatcagttgtcgtattgaccgtctcagttcatccacgaaccactccagtgcaaagcacaaccttttcacagatgcgacagccttccatgatccctttttcttcagatacaactcccattttttctgtttgttcttctgccttgtaccacctgccggctttgcttcttgatcgatgttgctgtagtaggtgtgttcgatcgctgctgtgcactgcagggctgactgctgctttgctggtgggagttgcggctccctcgacacggcattaaatgcgcacgtcttccgtgtggccggaaagagtcgagagcgccgtgctgcgacgcgacggcgagtgatggatgggacgggtggcgatggacaggcggatggaccgatgggggcgcgtcacgccgtcccgccggggccggcctctccgtttacctgcccaattttcgctggacagccgggggttttcatgtgcacggcccacggtgtgacccggtctgactctccgtcgtcagcgaccaccgaccatatgcgcggcgcagtgccagtgagtgtgttcacgtttgagttgtgtgctgtgtttgatcggtttgcttccgtcacgctgttgaggttgaggaggggtcgcgttgcagcttgcacgctagctagtcaggtgctttggcgggggcaatgatgtctcatggccatgtgggtatccaggcagggttggtggtagcagcggcagattagcagctgtagtagcacagaagagggaggagggggaaggaagatatggggcatgtttggaaaaccagtttacaagaatttgaaaatgttggatttctcggggcttattcgtttcaaaggaattgcaaaagaaaaaacataggaatagggataggttttaaactaccattcgtttcatagaaatgcaccatagaaaaactataggaaagttttccattcatttatttttgaaggaaaagcataggaaaaaataatcctaaagatgaagatgaagataaaagattaagtgtttcacgcaaaacgaggtggtaataacgtgtgattaattgagttttaatttttacaaacttgaaaaatggattaatcttatattttagaacaactttcatatagaaagttttcacacgaaatgtaccgtttagtagtttgaaaagtgtgtcacgagtgtccaaaagtttatccaactttagttagagaaaagaacagggctgtcactaatgtttgcattccgttggttggcttgctcaataacataggaaaaattcctgtgtttttcaatccataggtttgcacatgtattcctgtactattcctacgttttttttattcctacgtttcgaaaatcctgtgaactgaacgagccctcagcttttggcttttagtttattttttggattctaaattataagaagcaactggttggtaactagtttaggccccgtttagttcccctaaaattttcttaaaaacatcacatcgaatctttgagcacatgcatgaagcattaaatatagataaataaaaaaactaattgcacagttataagggaaatcgcgagacgaatcttttgagtctaattagtccatgattagccataagtgctaccgtaacccacatgtgctaatgacggattaattaggctcaaaagattcgtctcgcagtttccaggcaagttatgaaattagttttttcattcgtgtcaaaaaaaaccctcccgacatccggtcaaacatccgatgtgacatctaaaatttttcttttcgcgaactaaacatgcccttataagaatctgaaaaagttggatttctcagcttttggtttttactccgtggtttattaagctagagtgtttggggaacctctgattcctaaggaaactgtagcagtcagaagccctcctaaacaagcccttgatcagtctctacgtcctattttaacgatgagattttactgcaaaggaggacgtgagaatttcacacaaactttctccatgcatactgtacaatgattattaataaagaactcttaaactgtttaattataaatatttgctgacataaaagagagagaaaaaataaaatatcacagctatggttaaaaaatcaatatcgactcttagggtgtgttcgacagtgcagcatgggaactcatccctcctgcatgtaaaacggagcggccttttatcacgtgattaattaagtatttgtttttttaaaaaaatggatcagtatgatttttaatagcaactttcgtatagaagtttttttttgaaaaacgcaccgtttagtagttgaaaaaacgtgcgcgtggaaaacaagagacgtaggttgggaagatggagtgctgaacttagccttagcgtctatacaacataaatatagttgtatgagggtgaaaattaagaaataagaatagtagtgaaaaatattactctttgagttaataagttagattctttgttatcttaactattataaggaaacggtctttaaataatttgctattttctaaaagaccatactaagaatgtactgatcatgccataactagtgcaaacaataaatattgtcttatcttctcattttctattcgcacaaatggtcattattttggacagtgatgaagatatttccatttcatccaacgcaatgctagccttttggttttagtgtggaaactagtatctcccttatacacccatccaccaatcaaacgtactagatttacatttttggagaaaaagtttgaattgccctctgttttattggggtgagtatgaattatctttctagacgcgaaaataagatatatttcactctcaacttataataccagatgaaaaaaaactaattcaattcgaaatggttttgatactatgttagtagtccagtcaacatttttgtaataaaaaaaatgataggacccacctatcagattctctccttctcacctctctcttctccctcccctagcgcgccgattcggtggctgcagtgggcagcgaggtagcgacaagatggcgttaagcaatggaggctattggggccagtgaacggcggaggcggcactacacagcggtggggtagaggagctcgagtggtagaggcggatgggggcggtgagagatagaggtgggagagggggcggttcctccttggcctccgctggcgtgcgcctccttcttttgcctccgccggtgcacggctgccctccgtacaagctcgtgcaggcacaggggcaatcaaggatatattgagacaggggggaggggggaggtgagagagagaggagaaagtgagtagagagaatttgataggtgtgtcccattgattcttttctataaaaatgtgctggctatactatcacgtaggatcaaaaccgtatgcaaagttgctcgtggtttttcatccagtattaataactgatagtgaaagatgtttggttttcgtatttatggggtaattatattgtcccaataatttaggggcgtaatttagacttattttcttgcattctttatatttgaacaaaaaaatgttgcacaatgagctatatgtgttacaaccgctttgacctaagtttgcacggactatacaagttgtgatgttagagcaaacaaattcgcaactagcacacaattaagttcaggcgccacgaacataatttactcaaatttaaatctttaggctgtaaatccaggaagcgtgcaatcactatggtactgacgatgttactttcgccagattttccagtatggttaatcactgtaccggtggacaagtagcgctgatgaatgattctcactatagattcctagtaacagtagtttccactcgctatactattgggctcatgcgcaagcaactactaggggttattcaatgagttgaaaatccagttattctgactgcaaagtaacaactccattcttttttcgtgaacgcttcaaattagatacgctacagtatttttgctacagtgctgagaggaatcatatccttctacttgatatcatacagtactacagtgctagtaggatcgcttcggctcctttaggcccccctttgattcaaaggaaattcataggaattttaaaggatttcattcctaaaggattattttcctataaagacctttgaatcaaaggattgaatcatgtacaatcctataaaatttctatggaatgccttttctcatacaagttttggaggaaatttaacatgaggttctacctcatgttaagaattctttgagtctttatctctcctcaaattcctatttttttcatgtggctcaatcaaacagtcatttaatgactatatttttcctgtgttttgtaatcctatgtttcacacttgtactcctgttagaatcctatatttttcctattcctctattttttcattgctgtgatttaaaggggcccttagaggataccaattcataggaatcattccaacacatgttctttggaacaaaggattgtagcatacaaattccaaaggaatccattcctatatatacattccagggaaaaatatatgtttttctttttctaagggctcctttgaatcgtaggattgagaaaatgtaggaatagaaaaaacgcaggattttgagatgaatgtaagtgtaaaacagaggattgcaaaacacaggaaaaacacatgaatgaccgtttgattagaccgcaggaaaaacacaggaattagaggagagataaatactcaaatgaaaatttccatgaggtagaatagaacctcatgttaggtttcctacaaaactagtatggcattaggcattctttcgattcaaatggctatataggaaaaattcttataggaatgaaatacactaaaatttctatgaatttcctttgaatcaaatgggcctaaatttgcatgaaggtattagattcaattttttgtgcacaaatatatcgccgtcacagcacagagacagaagggccagttcgtaaatgacatcgcatctggacgagcggcaaactcgtgaggtacttcaccgtggcggcttgtgaaagtgagacgcggacgagttctcgttttttttaaacaagtttcgtattgatatagcaggaaaaatacaaaattacaaccctggggattctaaccaggaaaagaaaaaacaccaccacaaccacaagtttgtagctccttgcttaacccaggagaaggtgctagcaccgaactgaccacagctaagtgtgaccaaatgtcactatacctacaaaggggttgtaaacaccctgccaaagaccaactccacacagaagataatcgacgagcttccggttgtcctcacgtagaatggttgagttgaaggacagggtgagagaaaaggagatccactcgtccctcgctccaacctgatgatgaccaccaagcaactccgacgatcaaactgagagaatatggtaatggtgaggaccaaaagacctcctagacaatggctctaagaagttctcgtattggaaaagcgaactcgcaattgcatgacagtgtgatgccgcgtaattaacctgtgtaattaatataatttaaaggcaacatatttaattaactggtgtaattaatgtaattaaatttatctttctttgtttacaatttcgatattcacgacatcgtgtagcatcatccggactagttctagcagaaggaacaccaagttgacacggttcggacgagttcgcttcaggcatggtgcaagtttgtggccacatggtctaatttggataggaagaatgcgatcccgtggcctcataaaattactttgcttcttgtccatgaactcattgcaaattcgcggtgtccgcacatgatctgttgataatgtctagtttgcaccgttcttttgcaaactggttcttttgaaaaacttatttcgaaactaaaccgcgccaaaaatttcatccaaaaataagtcgcgggctcaacgccagggccgctggcactgaggttagtcaaccgccatggcactaagacggttaacctcagcctgcgtccggcttggacgctagttgacatagcggatgaccaggagcaagtggagaggcagaatgagtaaccacggtctagacgggacctgttcaagacagagtggtgagtatcctttgtatttacttatttccactttccgtacttcgtggttataacttcttctacatgcacgggagttggtcggatagtgaacgatgcgagcgtggcgctgggcacggtccctggctcgcaagaagagagcagcgttcttcgcaatgctctacatgtagatttctaaaattcacgcaccctgcacatatttggaactaacgcctacatccttctcttggtcgtagactctacgtcagcgatgcaggaagttggtggcacggctgggatgtagggccgacaatgccatcgaaccagctcgacgggccgaggaacaagagggtcaagagaaggaacaagagggagaggaggagggagatgatgaggaagaggaggaagaggagggggagggaagacgaggagcaagtggagctcgggccctcctagctataggacacaccacagttgtcgcagggggaggggcatctcgaccacagcgcaagagagcatctacttatgtgtggaggtacactcctaccagcctcatgctcctaggtgacttgtatggttgtgacttgtgtacccaaaacttgaacttgtatggttgtgacttgtgaacctatattttgcttatgtctatgaatgggttgtgatggatctgattgtggatggatgtggatgtgtatgcatgtggatgtgatggatgtgtatggattttggatggatgtttactccctccgtcctaaaaaaaggcaaaccctaggtttacgtgtccaactttgactgtccgtcttatatgaaatttttttataattcgtattttcattgttgttagatgataaaacatgattaatattttatgtgtgatttgtctttttattttttttcataattttttcaaataagacggacggtcaaacgttggacacggaaaccagggtttgtctttttttgggacggagggagtatgtttatgtgtgtggttgaattgatggatggatggatgtatatatgtacttgaatgaaggatgtatatatatggattgatgattactctgaattgatgaattgcggatgaaaactgggcagagagctggttgtgagctctctacctggggccatacctcagtgccagggaaaatggagctgagatgtatgacctcagtgccaatgctactggcattgagacctggccaggtccaacacaggagcagtgttggacgatgttgagcaactgacggctaagtctcaaacatcagcgccaaacataatggcattgagatcatggggttcaacgacatttcaattggtgccgagattagccaggttagcgccggcgggccacccaacataggagtggtgttggacagcccgggcgccagcggctaagtcctaaagctcagtgccattacggctggcgctgagctttggggttcaacgccaaacaaaatggcgttgagtacctgccatgtcagtgaggggagcgtcctcgactccacgtggataggggctcagtcccaatgtagctggcgcaggtatgttcaacctccacaccagctaccatggcgctgagccgacgacctatttttggttgaagtttttttgtacggtctagttttgaaatttataaatttttgaaaagggccaatttatcaaataaacggtagtttgcatgccgttcttgtgacgtctgcatattattgtgaaaaaaaaaatcaatattgatattttttgagaaaaagaaatgaacaatataattttaattttttttcatactgtcggtgttatgggcccggggtacctgggctaagggaaaggaagcctttccctgtgctacgtgcccgggtggcccagaccccccctcgggggattggacacttggccgataagtggccaaaaagcggccgtgtgtccccggggggttcggggtgcctcgtcatacccctcgggcccgaggggctgagtcatccccgaggccctagctcggccgccacgtggcagccacgtgggggctagaacgggcgggggcgctgtccgccagaggcatttatgggcagcgccccaaccgcccccatcgcatttaatgcgacgtggcaggtcgcgcgccgtccgccgatagacgtgcgccaggtgacctgctcttgaccggtctgcgacccggtgatggatggatgggacaggcggcagcgcacccacgcctcattttgtgtcagacggcgtgggggctggtatgccccgtcccatcatctgcagagaatagacatgcgggtcaatactccccacgcacgtgagcccacgaagtcaccaagaagttattagggaatgacaagggatgttcgccgtgtcaggtggaggacttcggtggggaccacccaagggcggccacacgaatcgcttccggcccaagccgtggaccacttttcaatctaggcatgtgtgggcccctctcccagaggagggcgtaggggcggtgcatgtggtatccccttcaactatgaaaggaggaccttgccctacgagcaaggggacgactcttgatatatcagatttgaggcataggctagcaaaaccctagtttgttcacctgggatcctagttctctgtaactgttcaaagatcaacgcacacacaggagtagggtgttacgctctatagtggcccgaacctggataacccctttaccttgatttcttcaccatccacctcgcaaaccaaatcactgcggatccgactcgcttgggtgagatttcgttcctaagcatcgcttccagtcccttggccgaactcatgaaggggggcctcacagcctcctgctagagaggatcactcctcaacacatacattccacaaggaaaggatcacatcagctcaaacctattgttatttgttctttgagaagtccaatgcaacttctctctttgtttgtcttctcactagaacggataccctcatctcaatcgagcggtaagccccatctcaatcgggcacggcgctcgtcacaggctagaagtcactgatgtgaaaagtaatctcaatcgggcaaatggtcgtcactgatgaacctatctcaatcgggctctaattgaagcccgtcatcgatagctttgacctagtctaccagttaaactatagcccgtcatagatgacctatctcaatcgggccacaaataaagcccgtcacagatgactactaacctcagtcgggcctaaactatagcatgtcacagatcacactcatcttaatcgggcctaaactacagcctgtcacagatgactgctggcctcaatcgggcctaaactagagcccgtcacagatgaccatcatctcaatcgggtatttagttatggcccatcacagataactataatccacaaaaaaaaataatttttgttttttggctagcctcaagcctttgctagccatgcccgctgcaaaaatgacagaaacaaacacagatatcaaatatccccagatccccagcatcacccattcatatacatatgcattcacatacatagacatcaatatatttcacacaaccacacattcacagtcatctcatatttcacatccattcacatatttcataatcattcaaatatttatcatatttcacctgcaaaactgagttaattggatcaaatatttatttagcaagtcttaacataaacatatgaaatatatacatagatataagcatcacagttacatcatcacagttacataataagtgttcatcattgcctaaacataaaagttcaacattgttcatcattttattttaagcctaaacattcctttgggttaattatttcgcggaagatgaagctggctatctcctcgcgaatctcctcaaagctagtaggcagagacatggtaattgtgccctacattgtcataattcgagattagttcatcgatcatatataagtactaaaatgtagttactctatcacaattgagaccaccgacctcaaaatcagccaaagtcttcaccttttctgtgtacagaaggcgcatgttgtggcacacatggaatcggcactggtcacctatttgttgcttcaccaggaagtcttttttgtggatgagggtgtcatgtcctgtcttcctgaggcctcctctttgcacatattgggcccgcgcttcatctatcgctagttgaattggggtccaatcatatgcgttcttatcaattctggagttcaggtagtgacatgtactccacttaggtgttatgaccagaaggatccaatgggcactgtggcattaatatagtgaaagttaattaagtactgaaggaatgtgtcatgctattgtgtatatttagataacacacttactattgattataggcgcacataatgtactccttgtctcggcggggccacaaggtgtcgtagatgtagttgacaattccttgacggttattctggagatttgtgacagtgaccacttgtggatcaaggaaggcaacttccggtgaattcttctgacaccattgccaacttaacctacacacaagataaacgatcttgtaagcgagttaaaccgattgttattaccagattgagttgggcgacaatacttacaaggagtagcacttaaggaggcttgtgtccaccgcttggagcctgtagaggtcgaatagatccttgaagtcgaccacgatataatttgttggaccaaggaatggctttccatcgtgctctccaaggatgtcgatagctttattcggcctcctggcgttagatttctccatgtagtatacgtgaaggtccttgcaagtggtgcccattgcggcaagcacgtcatctccaaccaatggtatgcctagttggaactcctgtggagcgacgtatttcttcttgacctctttgcccttagtctcttcctggcccttgcccagatctagcttccttggagctagaagcgaggcctgcacctttcctccccttcctctcccctttgcttcgggtttatcgatagtaattctctgaggggaagagtgtgccttcctgctcttcttcatcggtgggggttcatgaatcgccttgctgccggcctccgttcggtcctccccaaaatccatgtcatactgcaactgcacatcgtaagattatgcatgacgatcttgagcaggaggggttgaaggagcagatgcgggtctctttggtggacgaccgcctggtgcagtggttggcctcgctgtaacccttatctcaatgaggtccttgggccattggatgaaggtaccacgggcatttccaagtgagaggacctcgtcgttcggtggatacttcagtgggaacagctcgtattcaggcttcaccgagtcgacttgaacttttgcatagtcgcccctaagttgcgctccatgcactcttgtctctggggttggcttgtacgcaagtccctcggctgctggaaccgtgaaggtcggcatcaccctaactgtgagggtgcagctcgttggttcctgcgatagattcatcaatttttttagaatattatatatcatatggattcgttaagtttttcatgcattgtggacaaaacttttaccgttatgtggtcgacggcgctgtcgaccgatgttggattttccgccaactcagttgatgcacaactgctacgtttttgggtgggacttcctaactcttcgtgtacagcagcagcggcgccctaggggttctgttgctcttctcggatctcttgcctatcttggtcctcatcgactcgagcttttcgtcgaattcagatgtcagctccgctcttatcgatgcctggatcttggtttcaaggcgtgcatctttctccgccttgttggaagtccgcttcttgtactgccacgtatagtctggaaatccatacttccagggaacggaagacccaacgccccgtgttcgtccacggtgttccttgttgcccaacgttttcgtgaggaggtcgtcctcgcgtctttgagagcaggcctcttgcgaggcttgttgctcggcaaccaactccttctgcattacaatttagtgtggttaaataaattgcacgatgggaaacaatgcgaacatctattttgactagacacttactatagcatcgtacactcgttgatcttctggatttggcatgaagattgtgccatgagcattcttctggtacctggccctggccaagttccttgctcgagggtgtgggatatcgccaaacatgagcggcgtgttcgattcctccgcttgttcatcctcctgctgccattcctcttccttaccgacatatccggcggtgccaagccggtgcggatgctggttcttggtctggagcaagcgatatgcctcccttctagctctggactcgggggtcgacttcttcgcatggaattcctcccagacctattccgtgatccaaggaaatttctcttttggatctggattcgccgggttgtagacgaactcaccgactagcttagtcttgaagttcttccaagcattgcccataactttaaaaacagtctacctgatacggtcctcatgctccgtaggataatcgaagctctccttgaacgttagccaagcaatgtccttctctgcggccggcacatgcttgatgtcatcttgcagaatactaaatttctgcctccctatgaccctgcagatagacctaaatcggctcaatattttccttggagatgtcggcaaccctacttggtccaccgctgttatgcggaaccgttccttagggattttgttccttgtcctaggagtacgtgcccttgaggactcactagttgtcatcgacattggttcgccttgctgagacatcgtctactttttttcaaaataacgaaaatacacaattcagtgcttcaatggcttagaatccaaagttctaaaatcacttattcacgtaaataaactaaattgcacatctcacaaatctaataaactgaattgaatatcacatataaataaattaaacatttcatctattcatccacattcatctatgcataaacattcatctattcaaacacattcatctaatcatctattcatcacattcatcaatcgaaccacattcatctattcatcattcatgcgcgatggaggactcacctgggggtcggcgtcgggctcggtggaggcggcaggctcggtggtggtggcgtcgggctcagtagagggcgtcgccggggtcggtggtggctgcgccgagctcggtggaggcggcaggctcggtggcggcgtcgccggggtagatggtggctgcgctgggctcggtggaggcggcgtcgggcgtcggaggctcggtggaggcggcaggctcggtggcggcggcctcgagctcggcgagggaggagtcggcgaaggaggagttggcggcggcggatagtctcgatggcggcggcgccgggctcggtggagggcgtcgctggggttggtggaggcggcggcgtgctcggtggaggcggcgtcgggcgtcggagaggaggaggcgacgacgatgacgaaggatgtcgccaggcttggtgggggtcgtcggtgaggaggcggcggcggtccgaatggagggcggaggaggctcggtggcggcgggctcggtggcgacggcggcgggctcgacgatggaggacgacagcagcgctagggttctaaggaggcaggaaactgtagcgggacttagaaaaaaattcgatccgatatgagaaaccctagttatagtagagtgatgagtcatctcaattgggcattgccagagggcccatcagagatgactcatcggtgacgggctccatactaatgcccgattgagatgacactcaggcccatcacggatgactcatctgtgacgggccctaagataatgcccgatagagatagattaatctctatcggacttaaagtaaggcccgtcaccgatgactatttttctatttttcccatcaagtctatatttgtgagtgcaaaatatatagctgctatataataattcaatttgttagtcataatacattttcggatagtaaatgatttcaaatcgaaatatggtcaacaacaaaattgtagagcttatcaaggacaacttttattttggtcatttgactatataattttgttcccaacagcttgaaattgattttgaaaatatgacaaattaaaacagcatttgtaaatattaaatgatttcaaatgaaaaagtcaacaacaacaaagttgatcctctcatcatgatctacaacttttatttgggtcatttgtctctataactttgttcccaacagcctgaaattgaatttgaatatatgacaaatttatacaacatttgtaaatattaaatgatttcaaatggaaaagccataaacagcaaagttgtaaaacatatctaagatctacaacttttatgttggtcacttcttcatccgacaaagtgatagtaccaatgtttacaaaattgacatatctgtattgatgtttataaaccagatgagagaaatgtgatttttgtgaataatataactgtcattttgtcggatgaagaagtgaccaaaataaaagttgtagatcttaataagttgtacaactttgctgtttatggattttccaattgaaatcatttaatatttacaaatgttgtttagatttgtcatatattaaaattcaatttcaaactatttggaaaaaagttatatagaagaatgactaaaataaaagttgtagatcttgatgagaggatcaactttgttgttgaccatatttccatttgaaatcatttagtatttacaaatgttgtttaaatttgtcatatattcaaattcaatttcaaactgtcaggaaaaaagttatatagaaaaatgtccaaaataaaagttgtagatcttgaaaggctctacaagtttgttgttgaccatatttacatttgaaatcatttactattggaaatatattatgactaataaaatgaattattacacagcagctatatattttgcactcacaaatacaaatacttgaaatggaaaaatggaaaaatagtcatcggtgacgggccttagtttaagcccgatagagattaatctatctctatcgggtattgccgtagggcccgtcacagatgactcatcggtgacgggctccatactaatgcc

SEQ ID NO: 74521 - DNA, 11004 bp, Oryza sativa
tgttgatgtgaaaacacgaggcctgggagatctgcttaactccagtgcaggtccaaaactcgccttcgggtatgctagcgtgccagttgatttgatcctgcaatcaacaaaaaacaaagacaaagaaaccgcggttaaatccataaacgatagctgatcagctaggacatatcatttgagccgatgtcatatatgcaccgatcgatagtcattatctttgaactaaatctactcgatcggccgtagatattaacggcatatagtccttatatcgatatatacttaaatcaagtgattgggatagatcggtcgccatgccgagacagtataaatcacttagaccgaaatatatattaataataagactatatgtgtttatagcatagccgattagatagatctagcatgtatcggctattactccgataccactctatattaagatattaaagcaagtaaaatataccaaacgaaagcctaatatacttaaatgcagcaagatattaacataaagggcggatttaacatgtcaattaagcatataggataaaaagtagttaaatcaggtaagatcggctgaaaccccgatactactctaatcggcaaccaagaagcaggctagagattgagattctaatcacgactcataagatcaaactcaactgatgcagctataagtatgaaaagaaagacaatatctagacaatcaagccattggaagttttatagagtggtggatatcatatataatctaagccaacgtcgatatttaacctaatcggctgccttctattgacagatgttagccgattgtaggttagatagcgatattgccagagattatataagatatatgataactcgacgaattacataaacaagattagagtatcataaagatggaatcactaatactgagaacgcaagccgccataacaagttttatctcttgttgaagatcaaaaccgatgcagctcaacccaaaagcaaaaactcgtcgaaacaaaatgaaagtgaaaaggtggcgatgcgccgagattgtattgaacgtctgttagtttgattacatggggctcggggtctatttataccctagaattacaaaatatgaccatatcggacacgactcttatctctaacaaactctaagataccataagtctttgcggcagacttttgcccaaacatatctctaagaaaattacataaaatatcataattaatagatacaatttccttctcaggactctatccatgcgtggcaatcatcatgaagcacatcaacctaaaccgacaacatatgctatgtcatattgtcggattcggctcaatcggctaacctagtccgactcgaaccctgccgatctagccacagccgattcggacttcagccgatcttcactctgtttgcgggacgatttccatctcgaattccatctcagtttcttcttcttctctgatccttggattaccaaatttggtcgttaacactaagcagaattgcagactggttgtcaaccttcaatgtgacggcgctcccttcttctcccctgagctcaacaaggagacgcgccagccacacacactgtggcacgcagcagtcgtcgccgcaatgtactccgcttcactggacaacagagcgacgaccttttgcttctgagactgccaggtgatcaaattatccccgagaaagaagagaactcccattgtgctcttacggctatcaacatcgcccgcaagatcactgtcattgtagccaatgaggcacacagcatccttcttccttcggtattgacagccatagttggtggtgctggcaatgtatctcaacacccgcttcacagctgccatgtgctcggtggtgggcttcttcgtaaaccggctgacatatcccaccgagaacgccaaatctggccgcgaatttaccaagtatcgcagtgatcccatgatccgcctataatccgttgcatcaacagccggtgcggcactcgacttgctgagcttgaggcgtgattccatgagggtgaggctgggattgctgctgctcatcccggccatctccaatatcttctcagcgtatgcccgctggcacacggtgatgccgtctttagtctgattcacctccaatccgacgtaatacttcaacaatccgagatcgctcatctggaacgtgcccttcatctcctccttgaactgctcgagctcggtggactcgccaccggtgatgatgagatcatcgacgtagatgccgacgaccaaccggcgcgtgcccgtgcctcggaagtacacggcgtgctctgacgagcttcgagagccagcagggatgcgtcgagcttggcataccacgcgcggggcctggcgaagaccgtatagcgctttgtcgagtcgcaacaccatgtgctccttgccggcgtccacgaacccggctggctgcgtgacgtagacttcctcctggagctcaccgttgaggaaggcggacttgacgtccatatgatgaacggcccagccctcactcgccgcgtgcgccagcagcacccgaacggactcgagccgcgccaccggcgcgaacacctcgtcgaagtctatcccctgtcgctgcacgtagccttttgccacaagacgcgccttgtacctggtgacattgccagcggcgtctttctttgtcttgaagacccatttgagtccaatcgggcgctgacacggcggcccgttgacgagacgccaagtgttgttggcttcaatggacttgatctcctcgatcattgcctggcgccagcactgatgttgctctgcttcatcgaacgacgccggctcttccgcagagaccatcaggagatcctcgtcgaactcccgtaccgcctgtccaggtggtgttgctggggcgagcacgttgtcgacggtgcggaacttgagtggcgcgtcatcatggtcgacgtcgaggttgtcctccagacctgatggtggtgacacgaactccaccgtcggtgttccagcgtgcggaggagtgcttggcgacgcctggctcggtgacgacacgaacggcgagcctggcggtggtggcgccgcagctggggaaggtggcgccgtctcacgttccacgaagcgccgtgtcgatggcaccgcatctggatgctgcacggtggcgtactcgacgacgaagtcggtgtcgacgcctgtttcagcctagccgtcccacctccactgagcctcctcgtcaaacacgatatcgcgggagatgtgcacccgtcgcgtcacggggtcgtaggcgcggtacgcctttgatcctagcttgtagcccacgaaaatcatgtgtttactcctgtcatcgagtttcttcacatttggcatggtgttcttcacatgtcccacacacccaaatgtacgaagatgatgaaccgccggcgcaccgccgttccatagctcgtatggagtttttccgccgatgctcttcgacgacgacctattcagcaaatagactgccgtatttactgcctctccccagaacatacctgggagcccttttgcctttaacatgctcctcgtcgtgcccaccaccgattgattccggtgctcgacgacgccgttctgctgtggcgaatacggcgccgtgagttctcgacgcagtccgagctcggcgcagtactcgttgaagtggctgttgacggtcgttatcaatcagtttcgaccgtcaatattactaaaataggagagaactagtgatgcttccaatgcataaatatgatagaacaataatattccactagtattaggtttactaaccattttgcagagaatgacaataaagtggaggagaatcgacatcaacacaaacgataaatcaatcggacgatgtcaagagatagacttatgtatgaatgggccaagaaatcagaattgacatgacaaactgggccaaaattcacaagtctgcggagaagaacaatggaggaggccacctgccgattttgggccaggttgggccggcccctggttcggccgaaactccctctccaccgttggatgtggggtttggcagggacgctccagatcctctcctgatggcggttgcggggtacttcagacatttcgcagcagttacaaccgtcataccttcctataaaaggacttcaccttctcacttcactcacacacctcaagcaagagctctctcattcctccaagtttagtttagtagtatctagctggtggaatagaattagaataggaatcaggagtccggaagtcttcagaagagttcgggtatggctctagcagctttcctttcctcttttgtaagctttgtacttttattagaatactcttctatatacatttatggtattgaaatacttttcgagtatatgagtacgtactttacattatgttcttgttatactgaatgtacggctagcttatctaggagatgctttggtgcgggtataatgtttgcttatgcaattactctatgtcatgacgatgatattagagtagtatctggtagtttagacgtggtgtctagattacgggatatcattatttggggttatatattgcggatgagaggtgggccgctgatggtgacagctcagtacgggtattccttcgagcctatatataatcctaagttaatttcctggggagggtattcctccgtatttagccccggttggatggtcatgacgggctgtcgtaaggaactcgacagttaggggtggcttctcgaagtaccaggagggcatcggatagagggtattagctagtatatcagttaactagaatgtatgtatactatgtatattagaagtataggaatagattttctttctcttttctttccacctagcttagaagtatttctgcgtcattactgggaattatatttctagtaatgttgttaagaaataccaacaagcatttctggcgccgttgccggggaagattcataatagagattacttgaactaatactttatatttacctctgtataatcattttcctttgcaagctagccttggttgttttcactttttgttgtgaaagcagggtagtgcatgactggtttcaacctgccggaaaaattcaaagaaaatccagaagctttcttccggagtgtcaggccgcgggtcgttgcttcgcagaaaactctaccgacagagaaaccagccttaccagcgccaccaaccttcaagacaatggccagcaagactcttcgcgagttcgctgctccctctgctgacaatgtggccgttgggccgcaagtaacataggagatgtggattttgacttgaagtccagcctcatttcgacttgtagcacgtacaccatcaagggcgtcagtcccaacgccgttaggctgcggctgtttccgttctccctcctcgggagagcgaagcagtggttttatgccaaccgtgctgctatcaacacctgggataaacgctctacgacattcctcttgaagtgcttcccgatgggcaaaaccaacgcccttcgtggacgaatttccagtttccagcagacaagggacgagtccattccggaagcatgggaacgactgcaggagtacgtggccacctgtcctcattatgggatggacgactggttgatcctgcagaacttttacaatgggctcacctcgatgtcccgcgatcacctagacacaacagctggaggagcgttcttctctaaaacggttcaaggagccgttgaactcatagagaagatggtctccatatgggttggagcgaggaacgactctagacccgtcagcgaggcatgcacaccatcaaggagacagaactacttgctaccaagctggacctcctcatgaaatgcttggacgaccacaagaaacggccacaaggcaccgccaaggccttggactcacatgtcatgtatgaagtctgcggcggcatgggtcattctgggaacgactgcccggaaacctgtgaggaggcgatgcacatgggcaacaacagcaacgggtatcgtctacaaggaggtcaggggtggaaccaaacacgaccatattatcaaggaggaaataataacggtaacttctgtaaccaaccctccttgaaggatcttgtttttgcgcaagctaaaaccactgatgcggtaagcaaaaagcttgctgccaatgattagatcttagagaacataaatgtcaaactagatggctttgcttccgcatttcagaaccggctgagctttaataagatgatggaaacttagttagctcagttggcatccttagtccctgcaaatgaaactaggaggattccggggcaaccagactcctccattgaaaatgttaaagcgatcacgacgaggggaggtaagtccactcgtgatccgccgtatcctaaccctacgggaactaatgggatgtcaaaagaaacgccatgtaatgactcggctgacaaggagattcagccagaaaacaccgtgccgcaggagtactgcgacacactgttgctgccattcccccagcggagtaggaaaccgtcagtggacaagcagttcgcttgttttgttgaagtgatccaaaagatccacatcaacgtgccgtcattggacgctatgcaagtgccaacatacgcccgttatctcaaggacatactcaaaaacaagagaccgctcccaacaacggaggtggtcaagctgacggaacactatagcaacatcatactccacaagctcccggagaagaagaaagatccagggtgtcccacgatcacctgctcgattgaggcacaacaattcgaccaggccttgtgcgaccttggagccagcgtcagcgtcatgccaaaagacgtcttcgacaaactcaacttcacggtgttgacaccaacaccgatgcgcctccaactggctaactcatcagtccgttacccggcagggatagcggaggatgtgccagtcaagatacgggatttcttcatcccggttgactttgtggtgctggacatggacacagggaaggagaagccgctcatcctgggccgaccgttccttagcaccgtaggagccaacattgacgtgggaacggggagtatccgtctccatatcaacgggaaggaggagaagtttgagtttcaaccaaggacggaacaatgctccatggttagaatcaagtatgggccgaacccgcagaatattcaagaggtcaaagtggagccacccaagacggatagcctggtaaggtttatgcagaacttcctggagaaggaaacaacaatgcccaggaatcgttattggaggacgccggtaaaatcacctataccgccaagaagttagagcagtcagctcagaagaagccgtcttccacaccgaaatcaaagaaggtgtggaaggaaaagccaaagacgcccgccccattacctccggagacgggtggaaaatccatgaactgaatcgaaaggagatacggtcttgcacgtcggactttaaatgacgcgaccttcgccaacaggtaaattggtatgtatccgcatatttgttttcaacaatttgaatttttgcatcatcacatatttgaatttcaaaattacatttagggtttttgaattttgaggaaattcttcaaatgaattttttagagcaaactaaaataaaattttcaacgaaaattcactataccacgaccacactgaccgttggattccaacgaccgaaagtggggccggttgggcccaccaggggtttggccgaactcactggttcggccgaaccggctaggcaacggttacttgccatttttggcagggtaatggctagtgggtcccacatgtcatttctgaccgttgtgggtaccctataaaagccagccggccgagagaaggaattccaccccatttcaacacattttcattccctctccaaagtttgctctcaagttcattcaagctttgatagttttcctcaagttcaaatcatttagttgcatatatacaagttgctttggtgaaactaactggcgggtgaaactcttgtcatttctaacccccgccgagttagcccgttcttgctccattgtgcagtatgaggaggcgactgtctcgtctgttcaaagggtcgggctctccatcaagtcgtcatgacgagtctagcactcgctcatcagctgatgtctcgatggaagacgctgacgctccacgacaactcctgagcgacgctgacctagaccttgtcagtgatcgggagagacaagcctactacatgctgagcgaccgggagtatgctcacacgtgaaaatactcaccggagttgctgaaaaagataggtatggatgttgaattttgttctatttggaaagctgttggttggcagagatttgctgtggtagataagcccggttctcgtttgcttactttgcaatttctgtgcactttgaaagaaatagaagatggtatttcttttcgctttttccgtaaggagttcacgctcacatggaaaggcttgagtacacttcttggttttcacgattcctgtaaaatcgatctctagaaaggaatttctgggttcgagaaaaataggttttgggaagatatttctggtgctccaatttgcaagaaacctagaacaaatgatatccataatcctacacttaggctcatgcacaaatggattgctatgactttgtttcctagaagtgatctgagacccattaggggagatgaattaattatcatgtttgccatggttagaaaaatcaatattctcctgtgaaatgtatgataaggcaatggttagaaagtataaagttctctgctcctgttgagtgcacttctctgattactcggatagcaaaagggctaggggtcgttagcgaccaaattgcttttatctcagccgcttgtccgcgtattgatgaggcctatctagtgcaagggcatattttgaaacatggagcagatggatctttgatatactttttccccggttgtacaaatgaaatcccattgccaaatgcagggtatcatttgtacaactgccatgaactaaccattcccctgcagaccatagaagaatctcgtgcaagtggaacatacagggagacgcgcaacctgacaaggaacgaacgagaaagttcatcatcctcgacacccatgcagatgtatgaggcaggttgggcaccaactggggatgcacctggatggacccaagctccacgccatagcatcggagtctcaacctgggcaagcgccagtgaggactcgtggcatgcgcctcatgacgaggggacaaccaaccctccagatcaagtggtgttcctccatctccaagtgaatggcgcttgagttcctctcattgggacttggggtgaaatcactaggagaatggacacccttgatgtgcagacgggggagatctagtaggacctcgcggaacacatagctcaaacgcaagaatggcaacaatctgctgatgctcagttcgctaacatcaacaacatgatgcagcaacagcatgatgaccttcaggcgtactttcgctttcaggggttcaatccttatcaaggactctgagcgaaagccaagcttggggggagatacctctgcccccactgaggtaacttgtatcacattacatatctccctttccaattgcatatttgctttccaattgcatcttacaaaacatagaaacaacataaaattttgtaaaatagaaaataccaaaaagatatgataggtttgagtcatgctaggtaagacaagctagttctctttgttgaaatgatgaaaagttgctctgttttatatctatgatatatgggttcttggtaaatgctctctcaaagattgaatttaagtagccaacaattatccgggaacctgaggtaaatgggctgcacttgctgatctaagcctaggttgttgcgagatatgagatagtaaatatgagtagctatgatcctgttactagtttgacttgaattccggatgttttgtttttcaaaatgataaattgaaagttcctcagttgatataaattcctactagagccaaaaatgtgctatcatgattacaccatatacattttggttacttgccattccattaaactttgtcaaactcatgtgacttgtgtagatacttctcatgctttatgatcaagatcatacactcacatatatgcacatgctaaactccaacactgggagctaagcaatattccattccatatccatatttccaccaaaataaattctccatgctttcatgtgctttcttctcctaaaaaaatcattttgaaaaaaaagagaggagggaaaggcatggttatgagaaataaagttatgctccatcaagcatgagcatattactggaaaaaaaatgtaatcatgccctctcctaataaataaaagaaggatttttgggagaagaaagaaaagcacaaaggagaagcattttcttttatttttcctcatataccatttccactgtataccacacacattttgcacgatcttgattttgagtatgtttagttatctgctttagtctaagtttttgacttagtaataaatgtgaatgcaagtatgccatgtttgatccttaccgagctccacatataatccttagagtaggaatcgacaaggcaacaattcggtgaggaatttatgttgatacacttagagagactgagtgaatcaattgaggaacttggctttcttttgcaaaatcatttgaaaacttccggaataagagttgaataaagattgggtgactagtgctctagttgttgttctgtctttcaaccgtccaaggcaaggagaagcagtgtctcgtgggaatcaggggtaagggtaagccaccgtgccaaagattatttaatctgagagagagtacatataccctgcacctgtatctttgagatatgcaacatagtagcaactcctgatcaacaaccaagtctttgattcctttcgtccttcgctcgagacgagcaaaggttcaagcttggggggttttgttgacggtcgttatcaatcagtt

SEQ ID NO: 74522 - DNA, 11882 bp, Oryza sativa
ttggtgcgggtataatgtttgcttatgcaattactctctgtcatgacgatgatattagagtagtatctggtagtttagacgtggtgtctagattacaggatatcattatttggggttatatattgcggatgagaggtgggccgctgatggtgacagctcagtacgggtattcctccgtgcctatatataatcctaagttaatttcctggggagggtattcctccgtatttagccccggttggatggtcatgacggactgtcgtaaggaactcggcagtcaggggtggcttctcgaagtaccaggagggcatcggataaagggtattagctagtatatcagttaacaagaatgtatatatactatgtatattagaagtataggaatagattttctttctcttttctttccacctagcttagataaattattacgaggatgagtaggaatgcttgtgtgtcactctacccttggattatcttaacccctgcttagaatatgattatcacaagtaatatataaattattagttgagttttctctacatgatcttcacacgggataaaataaatacgatacccttggaatactctcgggtgaaatgctacaatggtatatccgtatgcttgcggatgaactctgtaaccataatataccagaagtattttgtcgcgtcccaaaacgactctaaaatacatcctctaaattatgcctagaataattaaaattcgtgtgaaagcctccaacaattaaaatgtgcaaagttaaaagccaaataaggcttagaggatttttgtaaatttcctaaaagcctaaaatgtgtaaataaattttagtggaattttcagagcacaaataataattattaagaaataaacaaagttaaaatgattttataaaaagaaaaaccctaaaatccctccttccctctcttgggccgaatccggcccatctccctccccctctctcctctcccccgcggcccatccggcctctctccgcacgcgcaccgctgacgggcgggcccgcccgccaccctcgctgacgggtggggcccacccgtcatccccttcctcccgccgctcccgccgcctcccccgcgccctagcgccgccgccgccgagaatcccgccgcctcccgccgtccccgcgtgcaataaagtggggggaatcactccccgtgatcccctctccctttccccccccccatttttccctctctctctcgcgttcaaacgggcggatttggccccgcaaatctcgccggcgccattgatggtggccggacctcccgcgccggtttccttcccctccggccgctctctcccccttccaaccctatttaaaccctccccgcgcctccctcgcccgtttccgccccttgccgcaccgtctccctgccggaatcgagctcgcgccgtcgccctctctctcttccgtcgccgacgacctccggccggccttctccgctcgccgggcccgtctcccgccccggcgtcgcttcctccggcttcgccgcacccccgtcgaccccgtccaccccctcacagagtccgccgacccccggaacgctgtcgaccccgtcgacccgagccgcgccgccgccttcctccgctccggccgcctttttcatcgtcgccgtcgacatagggtgagccgtggaccgccgcctctttttccccttcccttcccctctctcggccgccgctccaccgtgcctatggccaccgccggcgaccataggggcgcgggtgccgcctcccgccgcccgcgccgagtggccgccttcgggcgcgccgagtggcccccgcgtggggcccggccgtcagccgcccgcgcccttgggtgcggctgacgcgtggggcccacggcgccggccggtgcgagcccgggtgcgcccggtccaccgtggaccgtgaggctgccgcgtgggccccaatcccgtggacccggtccgcgcgccccctcccctcggctgatgcaataaaccctttttaaattaaaatttaaatgaagaaattcgcaaatattcatttaaagagcatataaacttcaaatggccataacttggccatttgaactcggaattggaccgttcaagtctctaattcttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggtttcacaactctagactttgggaatggttggattattgtggaatcggattcacacctccccctccattcaaaaccctcaaaatggttttaggctgggctcggggtgcatggttttgatagtagcacctcggccatataaggaccggtcttcaggcctctgttgcaaagcactaccgtacttccacatgtctagtgggtaaggcttagtttgtggctcagtctggttataaacaaaagtacacggatggagatggacaaagtcgggggtcgatggacatctctagggcaaatgaaggctacacgagctgcggcccggtagtcgagatgtcatggcacagggctggtgtcctgctgctaggggctcagtcctgcctacctgtcccgggggttccggccgtaggtggggttgggtcggtactcttgtttatggctaggatgggttggaaactatgtcatgtcttccgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggaccatgtttacaaagtagctttgagcaactaagtgacttttaatgctgtttactgcaaaccgtaacccccctatattatggctcccttgtactcccttgcatttattctgcacttgtgggtgtgtcttgttgagtacggtgattgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaactatttacgcttccgcttgataaactctgaaatgtatcagcttttggtgtaccttgcctcctgggacaaggaataatacaagcacgtaaggaacacccgttgggttatttccggtcgtgacatatttctacgccattgctgggaattatatttctagtaatatcgttaagaaataccaacagtggtcggcggtgaactcgccccctcggtccgtgcgtagtgcacaaagcagcttcccgacttgctctcggcggccgcttgtatctgcttgatggcggctggtgcgacgtccttcgacaaaaggagcttgatccacatgaagcggctgtagtcgtcgacgaggagaaggaagtagcggttcccactcggcgtcgctggcgagatcgggctgcagagatcgccatggaggagttgcaggggctcgttagagcgagacagcacgcgttgtggaaacggcgcccgtcgatgcttcccggcgagacacgcctcgcaaacctgatcgacatgcatcaataatggcaatccacgtaccagggtctccctgctcatttttctcagcgcagtaaagttgatgtgcccgaaccgagcgtgccaacgccacgcgttttcgccggggcgcgccgtcaagcaaactggccgcgcgagcttgatgtcaagcacatacaagcgccctgggctccgagggatttgggtgagcaggcgccactgctcgtcgcggacgcgcatgatgccgtcctcaaccaatacttggaagccagttttgtggagttggccgatgctgacaatgttggcagcgagccacggcagaaagtacgtgttggcgagggtgcggtgttctccattcttgcaggtgaacaacaccgtgctgcgcccctcgatagggacgatcgagccatccccgagccgaacgttgccggtgacactagtgtcgaggtcggagaaggccgctcggcaacctgtcatatggtttgacgcgccggagtccatgatccagctgcgcgggtcgcggtctgcttcatcatctaacgcagtgaacaccttcttctcgacgagctcgatgcagacgcactgaggcgccggcgtcgctggtggcggcggtggcggcaacatggagcctgcggtttcgacgcagcctccagtcaggagcatgagcgtgggctcgtcttgggccacatgggcctggtcttcatgcttgggcttgctccggcactccttggcccaatggccgagcttgccacagttacgacatttgtcatccctgtgtgccagtgaggaggtggtgtaatatacccgaaattctaggactcaaaaatttcatgtcaaaataattagaggttaacttctccaattttgagagccaaaaatttccgttttaaacttaggtgatgaccaacttaaaccattgcatgattaaaatttgggagcaaaataaaatcttttcattcccaacattagactagaaatgtcaccaagcatatgagcatacatgtacataatgcatgcctaggctcgagttctttgtgcatttggagttttggtcttgcattccataataggtcccatgagcataatctaaaagaattatttcactaaacatcactaaacaaacctatagttaatcttaggtgataacatgtggacttaatattaaactcaaatatcatcttctcagtctaaaagaagtttaatgtaatccctataataatattagatgcaattatgaagtgggaatacatatacaaacaaaggtcatcctaattctctaaaatattttgtgcaagataaaatcatggaaaaatttatgtagatagtgattagcacaaacttatcctctgtactttttgtcaaatgttaacactcaagttgatacctcaaattaatcagtcaaagcaaacaactaaaagaaatcaaattaaattttaatcggctaaaaccatatttcatccaaaagtacatttacctgcacataagtgaatatgggaaataatttattcgaatactagattatttatcatgaataaatgtaatttttctagaattttcctcctctgtttaagcctcctaaaaattcaatctagctttctaatagcctatctttgtttaatttctgtgagcagtctacccattatttttaagtgcaaccaaagaaaatggaatctagatataaacatctaccaccagtaaaatctacactaattcttctggtccacatattaagatattgagttgcaaacttagggggaagaaataattccgaaaattatccaaaaactaagtctacccaaactcctacccatacctctcttcctagagcctagcttccatcgacttggccccacctggcagcctctccagctcgcccttcctctgtccctcatcctcagccgaccaagaaacacagagggagagatcgagagccgaccgagtcctggacgcgtcgacgcgtggtgacgacgtgtcgacgccttcaagtcactgagtcatgcctccatctcctccagaccgagtcgcccaactccacacatcactctggagctgaagaagccgagggagaggtcctcagcctctccatcatcctcaacctcgctgccggtcgtagtgacgacgaccttcgccaacgccgattgggtcgaggtcatctgtatgtttttcgcgttcccttctctccacacaatgccgaaccatttctcttttgaccacctcccgttttgtgcatcacagccaccgaaacgcgaccacgccgacgacgccctggagcacgcaccggagcgtcgccgcttcaatcatcgttgtcgtctagccatcctcgaccatctcggagcaagccgctgcgccaagaatctcacctcgacctactcttcaaaacgcctcaagaaccccagccgaagacatcaagaacacggagaacgcatcttttcttccccggcgccgatttgaatccgccaccgtcgccatggtcgattccgccttctctggtgagccattgtctgattctttgcacatgaagcatccctgagacctcgctaacaacgtatgacctcatgcatgccagttggattggtagatcaagccgtcgacgtcatcccggagtgaagcgccgtcgccaagccattttcgtgtgctgccgccatcgtccggacctcatcaactccggccaacaccatgttatatacccatgaacctcaaatactcacatgcatgcacccacttaaccaatacatgactgtagatgcacatgcaccatcacccgaaaacaccttccgctcacactcgccatcggcgctactccgatgtcccctaaccaagaaaactagaggaatggaatcgcgagagcttgctcttcattttatcttttgacctcaacctcaaacgagacaccgtttgccgccggatcgagctcagccatcgctagctctgctctgtctagagcagagggatgtctcctttgaattagattaacagcagggatccatttacaattgtagaaacacactgacatatgggcctaggactgcgggttgattcctagaaacctcaagggcctttttgcatattggtccctcacagccatgtggaccccatcctttataatctggagaataattaagaaaatgcccaaacaaatatatgtttaacacaaaaatgcacaaacttgtaaaatccataagaaatcaaatatagcttattttgaagtgattccagtttctgtagatttatgaagttatgaactctattttataaatataaaactttacactcactgtacaaactttgcctctaaaatttatctaagataagtcatgcaaaaagcatatacaaatttgtaaaatgcatagaaaattcatctcaactcattttgaaacaaactcaaattctaaaaattcatcatcatgcactctctgattaggtgaaataaaagtaattacttactttgcatcaagagcctctaaaactattatctttaaaatgactagttttagataagctaaactttagaaaatcatataaaatccaacttagcttcaattttagtaagcttaagttctttagaataataaaaatgtgtattcccaggttatgaaataaaattatatacttactgtgtagtaaaagtctctaaatattcatgtaaggatttaccaacatagagcagcctttaatttgtaagatttgtagaaaattcatttttagtccaaatgaaatgaaccaagtttctatagaaccagaaaatagtgagcttcaacatagtaaaataaaatatgacaccttttgtacaaattatagctttaatctttaaatagataacctaggagttaattgcctagtgatggttaagcaaaatatatgtgtagaagtatttataatgcactctagctatgaataacctaaataaaacttgttagaacagtggagccatagttcctttcccatccactaaaacttagaagaacttagctcataaaataatttctcggttaatataatgtattgttagtctagatcagagcacccctagtttataaagtatgaaccatagtagtaaaaaccttaaacatgtgaactaaaaatattttagttaaccaaattacttcttttattcaacttaaacaggaggtagcatgttctgaacctacaactctagagtcatgcacatataaaacactatacacctataacacgttatagcttgtaaaatgcataaagaattcattataaatccaaaaattgtgaaaccaaatgtgttagtcttagaaaacacatctacacacccctgttaagtctaatctaataaaaatcactttacaaaagtattttgtagcactacctaagactatactactataaaccgacataacttataaaaattcataactcccaaatggaataagataaaatagaaattctttcacctaaattcattttagaccagtaccaacccactgtgcacaaatcatgcattttagagcattttggatttttagttctttcggtgtttaattgcataacatgtatttatctagataattgcataatcggtgaaggagtggattagttgctaacatttctctgatcaaggcaagttttctcctcccatcctttgaacacattgaatccccatgatttgaggaatggaaatgtttgattgcaaagttgcatgtgaacttagactatatcggtatttaaaattgggttaaggtagttatgacctatttgctgcattccctaccttgaataattgattctcttgctgtttgaatccctagaaatgtttagagtacagtctttgtgctcaaatgggtttatatatgctctatgtgcaactacttgcttagccatgcttagaaatatgcaaatgctcattccatctataattaaaatgtgattttgacacatgaacctttgctggaataaaatgaatatgatgggtatttgtgaactaaaatgtgtaaaatgtgattttagacttgggcggcaagtggtgtgcatatgatgttagttgcatgccgatagggggagtgtttgcccaagtcagtaaggaccgaacttgtgtcaccaacttaaagttattcgtacatccacatgtgctagtatgggatggtctaagctgattaatctatttagaactagccttgcattctggtaggccggtgtgtatgagttagtcgataattctgaagaattagtcgatgattcagaggaacttcctatttgccctgacgtggtagtttaggtgactaagtctgtccaatacaacggtattatgccacgtgggtgggttctcgttgtgtccgccaccacggcgttaagtttaaggcgtgggcccgccacttaacggttctagacatatttccaagtatgcctaggatggaggaaaacgtatcgtgctggtgcaaggctagattctatgtagtgtaaaggcttcgttttgacctctagtccgcactcataatgtagagtgtggggtgcttggccggcactgaaccaactagagtgtagcctctgggcttctatcacatcatgtgggtaaaggtatacaaactctgcagagttctttaaactaatcgattagccgtgcttacggtcaagagcgctttggtgaagtgtcgtgagtatagactatgctttaaaatgtgtacatgtgacttggtttaaaattgataaaatgtgttgagttgtgtgagtgtgatgatatattatgacttgttgtcaaggatgacaacaagagtttgattatgatggaattatgatgaacttaatattgaaacttaaaatttgttttgttaattgaagcatcaactcctttacaaaagaattgcgaaacaaaacttgctttatgctgaaattgaattacatgttgccttcctttgaatatatgccttacatgtagtatagtaggattgacttgtgcttgccagtacattaacttgtttaatgtactgactcttgctgttgatataactttttgtttgcaggtttatacttagtctttgagtgatgcgggttccgattgcttcttctaggatgagaacttaatggggtaaacccctagtcggtgtgcttgtgattgggtagtcaagcttccgttgttctctaataagtctatttggccggtcgacctatgtaattattaagttgttgtaagtcttaagtttctttcatcttagttgcgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggtacatctcaggctgaagttgactggcaggctaagggctcagcaatgtctccaatattcctctctcgaggcgtcggatgttttattatgcttttttgatgacttgaattattcacttcatctctcaaatataatggaaggtccgaagagcctacgataggtggacccatccgagctgccgccggtgcacccctttctgccgcggcgcttgttgcgtccgctggaaccggcaccagagcgtttcgcctcctgctccttcttgtggcactccagccattcttcttcggttaggtagagcttgccgtcggtgttctgggaggatggtgggggctggtaatcctcggccgccttgagtctcccggtgatttcctccaaagataaggtagatatatcgagaagagtttcaattgaaagaacgagttggctaaacatcggtcgggcgacgcgcagatacttctcgacaaccttgtcatcgggctcgggatcaccgagggtggcgagttggttgacgacactggtaagccgcatggcgaagtcctccaccgactagccgtcccggaacacgatcctctcgtactccgtacgcacccgctgtgcgctggccttgcggatgcggtcgtcgccgacgcgcattgtcttgatgcagtcccacgcctccttcaccgacgccttcgtcgccaaggtcgagatcatctcgggtggaaccgtgctgcagatcccatcaagtgccatccgatcctcgtgcagctcgacagcagcgcggccacattcgacagcgtcccacaggcaacgtgctcgcaacttgatcttcatgagcaatgcccagtcattgtaattcgtcttcgtgagaaccggatagttcgtagacgatcctgactccttgaccacgcggtgtataaccagcccgcggtcattcccgccgctgcctgaggcacggccgctggaacctccaggagtgcgtgcgctcggcgacaccgaccaacggcacggggagcttgtgacgccttggcataagtgcttcttctagcgcacgatcacgtgtccaagccctaaaccttgctctgataccaattgtcaggaaacccctaatcaattggcttgtgaacactggatgaactcacttgaaagtggaagaacacaagaacacgtagaacacaatactgtagacgaacagacagcagaaacagagtttttggtgctgcctgaattgcttgcagcttttcggggtttttttctctccttttattgtgcagaactgaaacatgcaaagtgacgccaaaatactcggatcgctacccatgactcgcggcttgatcacgtccatccccgcgtccacacgttgaggctcatgcgctgacaatgcacaaaacagaatcc

SEQ ID NO: 74523 - DNA, 2333 bp, Oryza sativa
attggacaataattcgctcctggcttgtcgctctctttcttgagctgtggctctgtgcctgtttccttccaacatttgcaggacgtacctcacctgatgcttttaataagtaaaaaatgtgagattggatcatacaaagcaatcagtagctgccaagaagggattactggaagcgaagttccgctatctgttttctcaataataatcatcctcacattcatttttctttttgtgccatgtgtaacagggtgagacaagtcaagagtttgagggtcagggtccagatgaggcctatcctcgccagcataaaattttttcactacgggaactagaagatgcaacaaattgctttagcgatagcaatgttcttcaacgtggtcgattcgacggcagcatgtacaaaggaagactaggagatggctcattagtagctgttaaaaaggattatataagccgggctttaagcatgggttatccaaacattgattggagaacatggcactttcaaacacaagttgagatgcctgtgcatagaaacctgatgcgtcttcatggattctgcataacgccaacaaaaaggttccttgtctatccatacatgtctaatggaaccgttgcatcacgtcttagagttacgttgccttttttttttctagtctgacatccctgtatctttcagataattagagggttgatttgggttttatattatagaacggccgccatatgaacctccacttgattggcgaacaaggaggaggattgcattgggttccgccaggggactgtcctatttacatgatcattgtgacccaaagattatccatcgtgatgtcaaagctgcaaatatttcattagatgaagactttgaagccttagtggggggttttggtttggccaaactaatggatcacatggataccgatgaaccaaatgcagtacgtggaacaattgggcatatcgcaccagaatatctttcaactggaattatctctgagaaaactgatgtatttggttatgggattatgcttttggagcttattacaggacaacgtgcctttgaccttgctcgtctagccaatgatgatgacgtcatgctactggactgggtaattgactagcacaatcttcaattcgaattgcagtccatattcatgtccttttgtggcttgatgttgtgttgggagttagataaaattacttttatgtatgtccaaaattgtatcatataaaaaatagtagttacagtaaggtcttaaaagtagtcctttttttaatcattatggcattagctaagctaagcataggattgaacatcatcgtctgagaaatacactgttatatggtaagccaatattcatgtgctgtgctttgtgcaggtaaaaggattactcaaggagaaacggctggagatgttggttgatccagatctacagagcaactacattgatgttgaggtagaatcactaatccaggttgctcttctttgcacacaaggctcccccacagaacgccctaagatggcggaggtggtgaggatgcttgaaggtgatggccttgccgagagatgggaggagtggcagaagatagaagtagtacggcaggaggtagagcttgttgggaatagtcacacattgtttatttagagagagttgaactaacttaaaagtggggggagtcactcacctcttgatgtagcttttggggtgtagcaaggctttctcccttttgggatgtagcaagactttcttccggttgagccaacgtctcctgattttgggccctcagagcttggccctcattgaaactcagagtggattgttgacttgaccatcggaactcagagtggattgttgacttgacggacatgattgttgcgcactggtagtttgctgctaattcttgtctggtagttgctagttcttgtccgtcggaagagtgatttttatcataccaaccaattggcccaatgtagccagctacaactatgttttgatgtatattgcttgattggttccttgatgtgctgccttggatatcagtgctccgaaaacggcatgatcccaaggaactagtgtcctgagcagggtttcacaaaccgccgcggccggggttaccgtgccctggcggtaagcacagttaccgcggtaactgtgaaaaaccgtacgaaaccatgcaaaatatattaaaaattcaaattatttttaaaatttatttaaatttaaggaggttaccgtggtttttctattaccataccccgcggtaaggccggtaaccgcggtaaccgcgcggttacagatggtaagtcaaaccctggtcctgagtggctgctg

SEQ ID NO: 74524 - DNA, 3642 bp, Oryza sativa
tatgcgttcagtaagtcatttaaaatatttacagaagatgcctgtcataaatagttatggaaaaacaatactgcgaaaaagtcaaatgagtataactatcgttaatttctgtctaatcaccatcttgcagtaactttgtgtcagtcaacccgtaaggttacaggtcctaatctgtccaaacagacgagcttgagatataagcattaattttcagctggcttgcaaaatcgtgatgttcctttggtcgatgtaaattaaccttttctgtttcagtaaaaaaaaaaatcaccgtttatagcaaactgagccgtgctaattactgagttaagatataaatgtttgtttttagttcttcgatgatcagactagctacagtatcaccaagtagcataaaaacaaacatcagcacacccatatcttcgataatcagactacactatcaccaaattataatactagtataagaacaaacgtcacacccatatcagaagtgacgcgtataggaacacttggaaaagaacttgtttgataaatcgagggaagagaattaagagtttagatgagagaattggtgagattaatatgagaatttgattcttaattttattattttgtttggtagagatgatgcgaacaaattgagatagagacgggattttaagtgaaaatatatggttaagattttcttaggaaacttaaagaagtaattaatttcgtttcaactctcaccccctaccttactactattaaagagtatggagttcctttcttaattcttcatccttattctactataacttgtagctcctcaaactaaatagaataaccatcattccatactctcaatcccttctaaaaactaaaacttccgcaaccaaatggagcattgcatttaaacaaatagatgaaaatgagtgcatacgagaaactaattaagcacgaacagaagtcacatttcatgcatccaacacaaaaaaggtattactgagtcaggataaacatagatctcctagtcactcatataatctcaaacctctagaccagttatcctaatcaatcacttgaagtttctggtactcgtccccagcaattgcatcaagcatctcatcttccggctccaccaccccattgttctcaagaaacaatctcatcaactcatccgagtatccactaagtgtcatgactccatccttagttgcggttaagcctgcagagcgtggccccttaaggttccacagtacgatctgaggtaccacgtcctgaaagcctaccctcttgaattcttcgcacaccctccgatattcttcatgccacggacgcgacgacaatggattaaaatcttcatgttcaatcagctcaaccggacgcactgatgccttctcaaaaaacttgtctgtgaatatgaatatggtcttcaccatattgtccggggtaacaccactcgttactgcccttgtaattatcccctcaaacaccttctttaggttaaacctctcttcgcaaggcatctggcgaataaaattcaacttttcccgatagctgccaacaggaagcacaagagggaaatagtttgaagcgaaggcatgcaccgagttcgtccatggaggcgaactgagttcagagattaagaatccaagccccacacagatcttcaacaacttctggccttcacttttgaccagcccccccttgttgacgtcgcagaccgccatacaattgcacagagatcccttcccacggagatgatcgaccaaagtgcgccactgctgagcagcatcctcccttcgtttgatgttgctggcatgcgatgccaggccaagcgaggtaatgatgtcttgcagaaggggtggctggggcgccgccttctttgccttgtgcttggcggcctcgcggctatctttgtggtctttgagaaacgccgtgaagcgcccttcatcgtgcttcttgaacaagtgctcgtaaatcctcatggcctctgaggccacgcgctcgtaaggcagatcagaccattggtttttggacatataaatctcgggcagctccaggtccttacgcagcggcacgagaacctcgcggcggagacggcggcgcacaaggaagatgtaatgcttctctttcatgttggcgtagctagcgtctgattcgcgtggaaagagaccgcgagcgatggcctcacataacaatgtggattggtcgaaggacgagtctggtgagggacaacatttggcggtgagcccgatcttggacagcttgccggacttgtggtgctcgagatcggagcggaggttttgtccacaaagaaactggtgatggagttgaagaggagacgatagttgtcatcttcatggtatattttcatggccaacttggcgaggcgggccgccttgagcaccttcttgctggggctgcccttcaccggcgcctcccccacgacatcctctgtctccaggttgacggcgtcggcgagcaagtggtcgggctggggctggggctggggctggggctggacctggaccgcatcggtagacgccgcaggcgtagggtcgtcgtcgtcgtcgcgggcgcgcttccggccgctcagtctggcgaggtcgccccctcaggccttggacttggccttagcgaccttgcgtgcatcagcgccgtggatgatgcggtagagaagctcggggaagtccttgatgtagccgaactcggcgaacgcggagaggttgccggcgagcgtgcgtgggtggtattggtgcatccagagcgcggcggtgtagaatccctccctgtcgcccttgccgttgtcgcgcacgccgcggaggttgaagacgagcttgagcgcggtgagggcatcgtgctcccaggcggcggcgaggaggtcgcggaggtgctggggcggcgtgtccctgtcgacgagggcgaagaaactaaggcaggggttgccaaaggcgccactttgcaagtgctcgacgacctccgcgcctgcgacatgtcccgcggtggaggtggagcccgcttcggctgacgacgacgcattcccgacggggaggcccgcgacgggagggccaaggattaggtggtccccggcggcggaggacatagcgcgcagcggcgaggtggaggagggttttgggggtttcggcttgctctctccactctccatcacccgtgctctccaggaaagggaaggggtttccttgtccttggtttttctccgcctgcctgggtccgggttttggttttggttttggttttggggtttcggcttggtctctccgctctctctcccactctccacccccgtctccaggaaggaaacattgggttgggcgaggtgccaaagctacgtgtcactgttttactcgttgcagctggcctccatgccctgtccccatggaaacagtgaacccgcatcttctgacctgatatgtgtgtgttgattcggtccgttgcctattggtctgctctgtactctactctgcacagtgacgttgcagcctgcctggtccatggtgcaccgagcgtatatgctgctactagtcaaatttaaacccaaaaggcatctatattccattttgaaatcaaggcttgaacggagtagttcatatttaaacccaaaaggtatctacattttgggtgtgtttagttcacgct

SEQ ID NO: 74525 - DNA, 8493 bp, Oryza sativa
aacttttttgttttccattagcacgttttcgaaactgctaaacagtgtattcctatataagaactgttatttcttcgaaagatcaaataaacttacaaaagtaagtttataatggttttgtcttgttctctgtgtcacgaaattgtcattgccaaactctaaaacgaactcaacaacataaatgtattgcccggaatagcccgtatgtatcctttcgccacctacataatcttaaagagatcttctggaatgctttaaattaattagaacccttgatcaataatgatctaacggacagagagagaaggtactagaaaaaaggtattaaaggagtgggccaggtacgaaaggtgaaaggagtaattgattttcattaaattatttttcggtaaatggcaaaagcggtggacctcgtttccatgatcgccatggcggatggcgcgggaggaggtgttctgattagggccgcgtcaattgatttgagatctccggtgatcgatctggtcaatctatctgcaggattggattgttcgcttgatcgcttcatcactagttggtcagttggtgtcgtttttctttcgtatcctgtagctgtgatctcggctgcctgacagcctgaggcccttgtgcttctgaaacttctgattaatttgatgatccgaacctgagatgagattgactgccttgctgttagttcgatcattcaagatgttcgatcgattttgattgtctcatcaatgtgcatgatcgacctgctcgagtacccattaccctttgccttcctggtgaatggatttgtgcagtgtaaaaaattttgttcctaaattaccctttgaagattaacggtggataacacttcattaagaggtacctcaggtaccttccaagcactgtaaaagacctcttaattaaaagggtatacagcgagcggcatactcccggtgcaaataatactggccaattccggccaaattccgcttggtattgaccataatgaccagatttgacgtaatatttgttcatgtgtaatgtaagtgatatttatgtagaatttgctctagttgattggtcggggaataagccaaatgacatatttataaacaaaaataatttataaataaaaattttatatgcatgttcttaacgatcaaaaactaaaggctgaaaaataaacttcgataaaataaacccagaatgaactctaaatttaaggttgaaattttattatatctataaagtaatagaaaaaggagcctccacgttcgctctcacgacctagaaattctcacattaatccaaaaaataagaaaaaagaaaaatagaactagattaggattagttaaaaactgaagaaagaaaaaaaaggcatattatgaaactcgaatcggacaatctgtccaaaacaaaaaaaaaaggaaaacctaatctttctttttccttttagaaaaaaatcacgttttatgtgtgcaatgtccgattggacaatgaagaaaaaaattacctaagctggctacagtaaccgtgtacagcacaaatcacaagcgtgcatgtatgtgacaggtactatccaatattggctcactgtttatctctattctctccgttgcaacaaatcgaatctctgatgacgggttcagatgtgcagactcctgttgtagtggaaccgtatcctctgacattacacaataatgtcatggtgtgacattctttcaaaaatccacaccatccattctaaatcaacagtcatagattatttggcatgcaattaatcaaactaattagtggattgtgtagttataaattgtccctagatcaaatattgcattttcaagagacaaacatcgttgttgactggtggaagaatccgcaagttactagcacatgatgataattaggtatctccgtcagaacggcgcaattctgaatatacaagccgatgggttaatgtttaatgaagatgaggatactgctttagtgctaacaaaaaaaaattccttcccacctattaagtacacacctacataatctgttaattagtttgattagttagatagcaattaatatgtggccattgatttagaatggatggagcggattaaggaatgtcacactgtgacattactatataatgtcagaggatacggttcccctgttgtatttatccatatatctatattatcttaatgtaataggaaaaagggccaccatgttagctcccacttcctagaaactcccataatataatccataataattagagaaaaaaagagtccaaacagaaccacgtggtcaacaattcaatacatctaaaattcagaataaaaaaataaataaaaattagagaagagtctacgtagatgtacaatttagaaatatccgaaactcggattaaaatttaaaaataattaatattgagataaaagtacctttagaaatacaatttaggcaaaaaatagataatattaagagaataagtacctaaaatttggagagagaaaataaatattatgaaaaaaattgttcatgtatgagtattatataaaaatagtttgaagttggattagaactaaataatattctttccgtcccaaaatatatcaacttctagcctctataatttgtctcaaaataatataggtataaatataatttataaatacctataattaagattcaaaaaatattatagaaaatggatttttttaaaaaaaatagtaattgagagagtcattaagaatacaatttttagaaaagaaaaaaaatgagagttcaagtgaaaagtagaaaatacaattcaaactatgtgaaattcataagtaaaactaaataaaactaaaaaagagtccacatataaatacaggagcctccacgttcgctctcacagcctataaattctcatattactcggagaaaagaaaaaaatatagtctatctataaatacaatttgaaaaatagctgaaattcaggattaaaaaataagggatattggaagaggggactagagtccatatagttatacaatttagagataattgaaatttggaatgaaaaaaagttaaatatagagttaaagtccatatggaatacaataaagaaataactaaaacagagttagaactaaaaaaataagaaaattaaaagtagactttatagtccatatagaaatacaatttagaattacaaaaaatcaaaactaaaaataaacaagattggcagaagagactagggtccatataggcataaaaactagaaataataaaaaatcagaataaataaaaaaattagaaaattaaaagtagagattagagtccatatagaaatacaataaagaaataactaaaattcgaagttaaagataaaaaatattagaagaagagtctagagtctaaataggaatacaatttcgtggaattcaatttttttaagaaaagaatactaaaagaagagtcaaaagtccatatacaaatttagaactaactgaaagtcaaaaattaaaaaaaataatagtatatcttagagttcatatagaaatacaattaaaaaagaacgaaaattcaagataaaaaaagattgagagaagagtctagactctagagcacctattggaatacaatttagaaataattgaaggtcgtaattaaaaactaggagtattgaaagaagagtatagtgtccatacatgaatacaatttagaaataaccgaaatttgaaatttaaaaatgaggaatatggaaagaatagtttagaatcaatataaaaataattgtaattcgggatttgaaaataaagaatatggaaataacataactttcaaattaaaaaaaaggaatataggagaactttgaaactgaaaaaaaaaagaaatattggaagaggagtctagactactctagagtctatataggaatataatttagaaatactccctccaacctccatcccataatataaggcgtccacgcattttaacattccaccttcaaaacattttgaccaatatttagtacaatataaattgaattttacttgctaaaaattatatcattggattaacatttggatttactttcaaatggttataattttgttactacagaccttatagtatatgagaaattataagataaaaaatagttttagagaccgtgtcaagtttgatcatgccttatattatggtatagagggagtaactaaaataaggaattaaaaaataattataactatcacatatatacaatacaacatgaatactacacattggttagtttggtcaagttcatatagaatttaaaaattatgttgccatttttaatatattttaataataaaatgtgaaaatagatatgttaataagtgaaaaaatatataacggtactagccgtgcaatctgcgcgggccaccatactagtttaaattatgacagataagcataaatataagcgaaaatatgaggatgcgaagtgggagttaggtttagggtttgtatatggctaatgggccaagagaaaggggcacaagaatgaagagatgggctaaaattagctaatacaaaagtatcgggtcaggcatgggttatccgtgaaaaataataatatacgactattgcccgctatgttcttagatttcagacggacgtgtccgcgggtaaaatattacacccatacccagtgagcggaggcagcggccgggcaccacgggcaattgctcgggctccatgcgtacaacaacactgctccaatgcatatgcagcatattactcgttaatcatatacttaatcactttgtctcgtaggttataatggagattaatcagatgaataaacagaaaacgaggcagcaaggaccaaaccatcgaactgtagctaatccagttttaaattaaaggacgtgttttagataaacataatagttgtggggggttaaaatggactttatcgtttacaaatgatctgaatcaaactcgatgttaaaacgagggaccttattgcacataagaaccattttgtccgctgagccggggcaggtcgacctctccgtccccttcacccgcgggttcccgcgccgatctccatcatcgggagcggcggcgccgacggcgtccaccgcatactctcgcctctgaatctttgcgcccaagtcgatctacccgttccctcggcctcgactcccatctcctgcgagttcgtcgccgcctccgccgatctccatcaggcgagcagcggtgccgtcgtcgtgctgcttccgcctccgccctccggtgagcacacccgtaccgacgcacatcctatttctttctcatccctcgctttcgttgtaccgcaccttttctttttgccttatcttctcatcatttggacgctaggtttaggttgccccctcccccaactgaacccccatggccccgcccttggctggtacaaatttcaatagttgagctaagaaaatatttggagacacctatcaacattatcgttgtctatgcccgatacatctacggatctaccccttgtgaattggaggtctgaaaaagatattgcaaggaaacattgtgcttaattctaatgacattatggattttaaaatttgtatattttctggtaactgttttgagtcctgtccaacaaactcattgagtgaagagtatttactcttttatacttttgtaaagttgattttggatcttacaggaaagtcatcatcattgacataaaacctatatttgtgaccttttaattagtaaatccgtgttagttttatggtgctgcttttctgttctgatccacattttgcacctttttttcttttaaaaaaacttatgcttcagtgctgagaagatgcggagcggtcgttatgatctcagaagtaacttgaagagggatgaaaaaactgattttgtcatgacgtattcaaagaagcatagaataaaggaggacatagtttgcaatgaaggagagatagctgagtccttggtttcaggtttgctggtccttcctcttttctgcatgtctcttatatctcttgctgagcattcacggttgtgttgtatgtaactaggtgacttgccctgcgaatcgaatcaaggtgtcttctggagtgagctcagtggagaagttgcatctaatctgtccaaaagtgttgtttcacttgccctgcacgatggtgattatatgtgctgttatacccttcttacttttccaggcatatatataaacaccgctaattatgaatgatttaaatcacaatcttatgtaggaaacacaatgttatttgtatgctcgggcatagctgtacaccgtaatggacatgttataaaattgctgacctcagcaagcttgcttaaagcttttaatgacgcaagaaaagatcatgataacttgaaggttggtgctgctaatcatcctttactattttttcttcttacataaggtagttgactggttgtgatcattgcttactcttcacctgattcttcattataggttgaagtgcaccatgaagacactgttgtcatagggtttttgagagaatataatttagatcacaacatggctgctgtcattgtggagaacttacctgatcttcgtcctgtgcctttcaacaatgttcagaaatttgtaccgcatagcaaggtagtagctctaggccgtgatatctctggcaaattaatgaccacaagtggggtattgattggtgaatcatacaatggatatcttatgtcgtccacttgtaaattctctgaggtacaccttttcttttactactgtgaggtacacgcttgcattacaacaaaaatatttaatcccttttgttttatacctctgaggcaataagatgatgatttttcctacatatcttcttgttccatttcactttattttgtccaatgcaactagtattgcctgtaatcctgttctgtttggtgccaggtttatgaaggtgggccactttttgattttgatggggactttcttggcatgaacctttccttcactaccgagggaaccgtatttgtgccaggggatagagttcttgaccagcttgtgaattgtatactcgatcatgaggtcagatttgctgcgcggttagaggctttgaaggaagtctggtatgttttgcatattttgaatgggacacatatcctgctctctccctgccatacgtgatttaatgaatttagctgttctttatgccaaacagtttatgggactaggttttgctataatctggatagttgggtgttgttccttttgtaggttttctgacattgtagttcctctgcagttttcaatgtgttatgttcccataatgcaacatgattctctcccacctataccaagatgtttctctgtcctattggcacataacactacctccctgtactagattagtcacatgtttcaatgtttaatgatatttgtctaattttattagagaaaggaacattttgtccagatttagtggtcacactgctatgaattatgatgcctctagacactggaggttttatataacatttgttcaattctcttgctttcttgaaatatttatatccataatactccaggtcctcttttatctatattgtttgttcctacaattatattcatgctggtgttgcatataaattgtgctggacctggtttgataaattttacttttggctactcatgttgatatttttctgcagggttggagaaagtcccagcggtgagatgcctagctctcatcaaggtgagcacagtgatactttaggcttctagtattttggtatatgcaattcatcgttatttctaatattctgtatttgtacataaatggtgtaaattttaggttttacacttacactcttgtgataactatcgatgggcttagctttttacggttgtcatggagttagcgacaatcagttaatactgttaccctatgctcatgggtattgttaagcagaatcaatatattgtggtttgcaactcgggttatcatcatatattgatcgtctgtacttatattatgtgtggaattttagttgaatcttatcatatactatattagtgttaatcactcactattgatattgatacgccagtacatagagatgttcttaacaaggatcgatacggggatctagaatccttgggctatcctgagcccccaaaatcgaaaggtaagtaaaaccctgtaaatatcgtgacagtttcatgcattgtgtttttgtacttactgtaccacttacactattttacttggtatgttcaactagatggcatgattttggcttatacttttgaagagccttttggtgacatatttggtaaaggtgtctggagtgaactaagtgaagatgttgcctctagcatatgcgaaaatactgtcgcacttgcttcattcaacggtgatttttcagtattgtgctgtttacggtttcatatttgtactctaatcataactaactaatgatcaaaattatgatatccaggagataaacgaactt

SEQ ID NO: 74526 - DNA, 18128 bp, Oryza sativa
aaaaccactagacactttttgacaggagattttcttgaattgtgagaaatcgataaacagagttaggctttgtcgcaccttttggaggaaagtttgatcgacgtgttccttacagtgggtgcaaagattctccaagatctcggctgatattgtcctgtgtctggtgttgtacttggcatcaagcattccaatgagacgatcaacgatgtcattatgctccctcacgatgaacttagagatagcttcactctttgatgataagattgacagtgtttccccagctgtagctttgatggtcttgttcatcttcttcttcttcttgataggtataggggctctcagcttcttcttcttcctcttcttgatgggattggttgcagcaggaggaactggtggtagttgtatttcatcttcccctccattagcgaggaggaaggtctgcaattgcttcctgacgaggttttctctggtttccaaggtgatgtcgagagaagaatccaaaacaagttcagtgaagatctccatggttcgcacctgctgctcctctgttcccagatcaagaatactttgcaggttggtgaccgcctgtttatttgaggagatctcgtggcgcagccttgttccaggagcggcatgggttatgaggtggtgcaccaccttgagcgagctgtttgctatgttggcccacggctcgctcctgccgatgtcttggatgagcgtggcagagtagagcggcacggtgatcttgtcgaggaggcccggagcggcgcggatgtccgtgcaattgtgtgggtcgcaggtgagcccctcgagaatcctgagtccctgcaggatcagctcgttgcagcctacttgttcttcttcttcttccctgccatcgttctcgttttgtcgcatgccaacacctggcttcttcctctcacgccgccgctgcttcctctcacgccgcttcttctccatttctgcttttctacgagcccattcccgatctcttctttcagatggtaagagctgatcatcgtcgcgctgattattgttccagagtggctggacggttgtttcgagcaatgatgacacggaccggattgctccagggaagtgcgcaagctggatgccgccggcgagatgcgccacaatcctcgcggcgaggactctcatctctttgttgttgttgccatctgattctgactctgatgatcctgttcctgtttgtgtgctccccagcttatctacgagtatctgtatcttggtcttggagcgaagaataatgctactcgcatcttccccggccgtgatgagcctgtctaggatccttgctccccagaggcattcttcctgcgactcagattccagcagccctgctgcgtagctgagaaaggtccttttctcagcaagaggagcagggtcccgcacgcatttcttccgggtgtactgaaggtattttctaactgacctcatgcgccactcttctgggaacttgcattgcttggagaaattaacggcgaggctgatctcgcaaatgagaagacatatcaagaagcagtagagcacacactggcacagaaccaggacgtagaagaagtccagtcctggcgtcaggttcgctaagctgctcgcttcaccagtaataatggaggaggatgaggatttgtcccaatggccctggtaatcacggtgcctcaggcgccatgacgagaggccgatgcacacgataggaccaaaaaagttgaataggagtagaatattgaacatcggaaggactgggcttgctagtattgcagtaaatgcgtgagcaatcgccccctccccaacacgaatgtatgagggcaacaatggcaacgtcaacaagtcggaggcagtaacgagtaccatatttcttatgttccaaacgctgactgtcaggatgtcctgcgactgcaactcgttgaagatgctgtgggatggacaaacagagtaatgttaatgatatgcacgtcccagagaaagtcatagtatagacgattgcatcacacactgtattcgtaaatcttagtatgcacatgcgcgtgcatcccgttgtaaagctatgaatatttctttttacatgacttttatatatgatattatactgttacattttttaacttatgatcttatactttgagttaactatggggaattattctaaactctcaaataattatgaaaacttttgaaacaattcagcaagatagaataaccaagatcagcgctgagagaaattatgttgcttgagatgcattctacaggtgtcaatcggcacgcgcgagatgtacaagtctgcatagagagcctcctccttatctcttcccacacgagcacacgcggttagagtggagcgggtgacgacacgcccgcgcccccccccccccctcttccagcaaactggccccatggagaagaggggatgtagttgagcgacggcgatgtccgtccagtgagttccctcctcctctaccccccctcctccaccgttccgctgctcggcctcgccaacaccaaaaggcgtcaacgtgctaacgtggccacgccaaccggtctccttcccttcccctttgccccgctttgcctccgccacctacactggattacctcccactgctggcaccggggttttggcggcaccaccactccacctcaccggcaccaaaaacatcaacttgtcagcgtgacccagctggcctcctccccctccccctccccttcgcctcactttgcctccactgccaacactagcctaccccccgttgctgaccccatggcttcggcgatgccaccgccgcctcgccgtgtgccctagtccgtcacccaccaccggtttgctgcctcccatgtcatccctctaagcccgatcacccactcccccttcccatagcgctaccctttccccaccctaccctcaaaaccttaatcctagcttgtcgccatgtggtcgaaaaccgcacacaacttctctccctggcgcttctaataagtattctactccctttgttctcttatatatgacgttggttacaaaatacaagaaaaccccacgaaaatcgctcctaggcctattcgacgactggcgccaattttcagtagctgccaccccacaacactctgtactagccgagccactgccattaagcacttccctgccagatcagcccaatcgacagtggccacagtgccctcttcgtgtcgaatgtattgcgacaatcccagatgagctcccggtcctccacgcctttgccattcttttatcttgaacataatcctgcccatgccccttccaccatgcgtcaccacttcctgtgttggatccggctggctgacggccaaaacctcgggatttggacggttgatgccttgatggtatgcatttcctctctcaagttagttctgatggataagttggagaggaggaagaatggcaacggggctgcacccgccgggttgtagcatcccgtccccgtccccggagtggaaaaaatctcccgtctccatccccatccccgcactcgggtggagattttcccccgtccccgtccccatgggggtgatagccaccccccgggttcctcacccccgacgacggcagcaagaagacacagcagcagaggaggcgacaatggcatctaaacaccggcaacggcgtgcagcaggcgctcgcgcgagctcgtggcttggcgacggcaacaacggcgtgcacgcggcgccccactcgaacccgcggctttggaggcggcgatggcagctcatcgtggacgcgctgcgacgcggcacggaggcaacagcagtgcagcatcactgcagcttggcttggaggcggcggcgatgtggcgtggtcgactgccgcggcttggtggcgcccctggccttggtcaacgagaggacgagtggtccgtgctgttgtttgtgcctagggtttagttggtatatatgcacctacgaatgggcctcaagtgggcttttaatttctttatggttgtgggcttttaacatagacatgtgcacatggacctaactacacaggccccatggggattcggggacggggagctaaggaatgtccccgcccccgctccacccgacggggggcaatttttgtctgataacaaccccatgggggatgatatggtctcatttgaagcccctaatagaggttttccccgtcggggatcggagagagtgacgaatgagcaagagggattggggcaggacaggatacccccaccgtcttgccttcattctcacgcaagataagcagaaggccagacaaccgcaacagacctacagcctcatcttttcgcttttgcttatgcttatcagccaaaatttgaatttcaaccttaaatttaaagttgattttaaagttttttcatcaaaatttatttttcagcatttgcttttagatcgttaagaacgcatatataaaagttttatttacaaactatttttcgtttacaaatataccgtttggctagcacagtcgtgccagcttccttgctgatgctgacgcccacaggtgcgcgcatgggcagctgatgcgtctgcgcttgcacgtgtcgaggcccattgggaaaggtgtttatgtttttttttgtttgtttgaattattttgattgtattttagaagtccacctacatcatgaatctttcaacccaaattttaaaacattctattgaatctttaaaaaaaataagagaataactttcaactcaaaatttcaaaattttaaacttccattccgaacttagaaacttttaagtcgaatttaaaaaatctcatctcaaaatttaaaacactgaactcaactttttaaaaactttcaactcaaaattaaaaaacttccaactcaaacttcaaaacttttttacttagatttaaagaactttcaacgcaaaattcaaaactttcaactcaaaattaaaaatctttctactaaaattcaaaaactttcaagtcaaaatgtaaaagctttcaactacaaatttaacaccgtcaagtatttttaaaaacttttgaactacattatttatgtattgcattttttaaaaaaataatactaaatacgtactatcaatagcgcgtactaatagtcgtagtgggtatatatactttagagtagcggtgggcacggctgcactacttaccaggacaacagagtgagagatggtgagttggtgactgtcgtgtttctagtgtgagcaaaactcaaggccatttttttcctggttgcggttgtatttctcttctcaatgaaattaggtaaaacttctgcttatgttcaaacttaagaacttttacgatatatttactaccaatataataatggcaatttaggattttaaaaaattatgtatttggcagcgtcacccgcctggacttgttgtggctaccggtgcctccccatgaagaacactgactaggaatgagtaaatagtaatactctctccttttataattatattataagtcgtttgaattttttttctaattaaacttctatttgtttgaccaaatttatagagaaatatagtatgttttcaacaaaaaaacaaaaatattatcaaaatatattcaatgttagatttaatgaaactaatttgatattttaaatgttattaatttttctataaacttggtcaaacttaaaaaagtttaaatagaagaaaagttaaactagggagtagtttggattgctcgggggaaaacgtcttgcgttgtttcaatatatgctatgattttaccgattgccaccaccaaatagtgtagaaagaaaattaacccttttaatatgtaatctacttaagtaaaggggcaagaacacatcaatctaaatacttcagttacttatactaacagtactccttataagtttaaaaaaaaaaagtgtgtaaggctgtcagttgtgccctcgtattccatataatctttttttagacaccatataatcttttaagagagaaggaaaagcagtggggtaggtatatttttagagtaattttactacttcatccttttaagttcaaacaaggtacctaaaactttacgctcatacctcgagttacatacctattaaatatggaaattatccgtacttttactagtgctagcaaattctagtggcaagggcgcgctgaaaagatggaaaattaattgacaaacctggttgcctgtacaacagtaattgctgtcaagcacgcgaaatcctttctttgcagcgagctgacgtagccaccaaggaggactaccgtcgaccacgtgaacgcaaggtacgccatgaacgtgaagaccattctgatgtacacctgcacggcgaggttacgattgatactcacttccagctcggcgcggttctcctgtcgtcggtcggactccgactcggactcgccgccggcaatcatcgtaccctccaccagctatgcttcgcttcaatatggggcgaagctgcagcaggccacacataccatatatatagtacttcgtccgtttcacaatgtaagtcatttttagtatttctcatattcatattgatgttaacgaatctagataaatgcatatgtttagattcattaacatcaatatgaatgtagaaaatggtagaatgacttatattgtgaaacggagggaatacttctctcttttttttaatatatgatgtcgttgatttttttagatatctttaaccattcatcttattaaaaatattactacatatgttttataatataagaagttttagagttggacacagtaattaagaaagtagataggctaggttgcagtgacctaaatagcaccctaaggttctgagttcaaatctctataggagcgaatttcagattgagttatttgaggactaaattccctgtttgataagctaagttcccaatttaaaaatgttgtatatatccggttggatgtagaggccgggtaaaaaatacccttatctaaaaaaaaaagaaatatgtgggaaaaatgaatggtggatggttgtgacttgtgattggttgggaaaaggaatgttggtagagaagttgttatattttaggataaattctgaatgctaaaaattattatatattgggacagatggagtatataattattatttattttataatgatttgatttattatcaaatgatctttaggcatgacgtaaatatttttatatttacacaaagtttttaaataaaacaaataattaagcatttgttaaaaagtcaataacatcgaatgtctggaagaggcgacgctagcaattcttcttgttaggtttagcgctagctgttactggccacttggctatatagtccatggaatcatcgtcaataaattagccccaccagtttatcgaagtgcagataataataaactgggactgtcacgaaaggtcacggacgatcctattcttcgtgtggaatcaggggaacgatggcggctgggcgatccagccaaataagccagcggggtcatcacgtagtacgtactaccttccatttcaaaattaattagcttctttttatacacgaattgtcgaatttgcatataaaccagttcagttttgtaatatataaatgaatttattttagcacgaaaaagtactaaacaatattcctattttggagtcttatgtccagagagttttaacaatgaaagttaatttgtcacaggtaaacggggtctgcagggcggatccagatcactaccaccggggtcagatgaccccgatgacgtttatcaatccatcagccaaaagctcgttgatgattgaccccgccagcagctccaatgatttaatgcaccccactcccttgaaactacgttcaattcggttcaaaatatagcagctaagtacaacatgaaatatttatagtatgataaatttggaaaaaaaaatgtccgtacggatggagatagtactatataacaatgtgtgtgttcaaattttgagaaacgtatattcatacctcatgggatactgggatatacacttgttgttgcatgtcacttgcatgtcacttaaaaagttataaaaaaagtaagatagatcaatatgtgttactccacaaacttgtactctctcggttccataaaaaacgaatctagaactagatatgacatactctaatactacgaatttatatgttcagatttatagtattacgatgtgtcacatcggattctaggttgatttttatgggatagagaaagtaggttcaattcaacctgtacaaatagaaacaaaaacaataaatttaactatgaataaaacgcataagtcatactcaaatttgttagggacaactttgtttttgccctcactttcatctcaatattgattttgcccatatttttttaaggttttctttttgcccccactttttttgaaccgaacaatccgtttacccctttttagatggagcagttaacggtgttaactttttatcaaaaggatatttatacacccttccatctttattcattaattgtgattttacacctagcccaaactcgaaggcggctagcttgctggcactgccctacttcttccctggggcaaaattgggggcaaagtgatgtctaaattgggggcaaaatcacaattaataaataaagatggaagagggtatacatgtccttttgacaaaaagttaacactgttaactgcttcatccaaaacaagggcaatgtgggggcaaaaatgaaaaccctaaaaagtaggggtaaaatcaatattggagatgaaagtgagggcagaaatgaaattggcccaatttattacaattacttctaattgcataagttaaatttaaacttgcatatttatcaaatgatatatcacatattgatctatcttatcaagttttttttttgataacttttttaagtaacatgcataaaacgacggatatctcttgaagagacaaaaatccatgtccccaactctgttgtagaataaagtaagttgtacatctattttatcatctcaaccgattatgactatctctatgtcaacttttctatctcaaccaatccaaacaatctcctatttatttctatttattttttaatccagcactactacacatattaaattttcttactaaatttatagtagcaattatctcaactgtttaatttaagttgaagaaagttataaaaaattatagatacacgtttcctttttaatcaactcttaaaatctccgagagctctccaccgccatcgcctgctcccatagacgacggtgcctaccctccacgcgaggtcgggcattggtcgagcagtgtcgtcattgcatcatcctaccggcccgaggtcacctccgcatccaccgctcatatcaaggctgccgggtcgctcagttttgcggcttaagctcggcatatgcgctactagagtgcgcatctcggtccaccaatcatggttcacccaagtcacattggacctgctccagcataggtctaaccgaagccacaactttaggtcttgagcctacacaacccataagattagtcggaccgtccacaccttttaagtcatgctccccatcattaattaccgatgtggaactaaactcaataatgtcccccatcacacatcgggcccaacaatctctcccattacatcaacccatgtgaccccgaagacttgttacctggcctcaggcccaacatctaccggtcatatcgatccatgtgaccccgaagactttttactcggcctccccaccatgtaacccatgaaaattgttccgggtttcaaaccttagactctgataccacttgttagagtgtgcagctcggcccaccaaccgtgggccatccaggtcacattgggtctgctgtaccacttgcccaacaagagccacaactttaggttatgggcctacacaacccaaaagactagtctgatgggtgaagaccgcttccaccttttaagtcatcctcccccatcattaattaccgattgtcagctttgcccaaggatacgaacggagcagcaaactcacgcaagcagcgaactcaagcgatgacacacgcaagagtagcaaattgtagtggacacacacgatagatcgacaatggcgacgcacacgcactaagcttttctctctatggctcaatggagatgaacacagggaagctttgcggcaacaaatctctttatctgtgactcacacacacaaacacagaatttacatggagcttataaggcccaggcgacgacgtgagttacacgccgagcaacgtcctgatggccgagtctcacgcacatatacgctcacacgatctatacatgcatagccaccgactactgcatgccatgctccacgatccgcatgagacagctaacaaccctgaggaatcgcaccaactaatccatgcaagacacacacacaaactaattatgcactaacaaattagttagtctaccatgcaaacacaaacacgtacttcacgttgctgcctatacacaacacatgcaattaaggatatatcaagcctactagtcaagattaatactaacacatacgagttgtgagactaaacaggtccactaaaaattagtgcatccaaagttaaggtgtttcgatttaagctaatatgttctgatatattttgtgtctgtagattccttttcaaatttcactctgtctgcttgaatctgctagacctattctaacgcgacgcgcgacgatgactgccacgacgacgacggtgccgatgccttggtctaaccgccggctgcgacgacgcagcctggatccgccgccggctcgcaacgggcacgccgatccactaccggctggtctcaggtagggaaagggaggcgacggctgcgcggcggcgaaaaggtgaggcggcggctcggctcctccctctttcggcgacgggcatatatatatatagttgcagcgacgtaagtagcaccccaaagtcttgagttcaaatctttataggagcaaattttatattggattatataagggtgtatgttcttaatttaaaagtaggcctggtaaaaatatacccttctctaaataaaaaaaaaaggcccaaacccttagcaaccaggccttaattagcggagtcgcagactcgcttgttaaaaaatatacccttctcggagtcgcagactcgcttgtaatttggcaacgtttgcgatcttaattagcggagggaaagcttaggagacgactacggatcggacatctgatgcgattgttttcgtcggacgtctgttctactgttggatccacatccatccctttatgtccatctgattaaaaaaaactattacatacgtatgcagagaagagcaacaacaagaaaagtttaaccgtgcatgctcagtaccaaatgagagaggtacatggatagtgacaagcttcaaactattttttctcgaaaactatttatccaatttacaatttgattacactgttgtattcgttataattaaatctatataacaagatatcacatcattatattctgagaaaaaaatacaaatgtttcaaccgttgaacttggatgtttcacgtgtgagaaataaatgtttcaattggaatttgactatgttgcacattttaagttctatattgtagtagatctttataaatattacacgtgatattatttagatgtttcactagttcaatgtaaatgttgcaccggtgttttttttagtgtttcaataaataggtgtagtgttgcaacacttataactcgatgtttcatatatagaataaaaatgtttcaattaggatttaacagtgttttattctttttatttattttttaccaaaatataatcaactaagatcttattgtaaagatttaattgcaacggatataattctgtaatcggattgtagatttaataaatatttttaggagaaaactagtttaaagctactaatgcatgcatagcttttttttacatacatacacacatatattagagtgaagtactaaggagaaaagtaagagagagagaaatgtgcaaccctgcagtaggctgagagaaaaaaaaataagacaacagctagacatatagtatgtaggtcgtgagcagatcatgtctgattttgtttggtgcgtcggacgtccgacggcaagcattttctgaaagcttaggccatgtacaggggtccaagctcaggccttgggtttcactgatcgatcggcaaattagctaacgaatcatagagaacaagttttttagtctttccaaaccctttcaacaagaataactaaaaccccctgagcgagggtttagacaagttgatccgctatcgccgtatttgttcctattgtgtgctgaaggtttctctgccttacacaatttgccacaaagcaccaagttcgtggatattcaatgcaggctcgagcttggctcgtagtcatgaattggaagttcgaatcgagctgaattcgagcagctatcaaacctcgagcttttttgtcaggcctacatggcattatgaggaaaaaaaaggcttattcttggtgagatcggcctcatagagtgttatgtgatgagagccagcgcacaagttatagagaggcagcctcaacaagaatttctgcattggcttctgaaatctgaagaagtattggagagaatttggaagatgaagtgtctaaacagaattgaacattttgtacgtaggttggctcacaacttattgaatagtttcacattagttgtggaagggcaaataatttaagatataagtaggggagccccttacttcaatggctagcttttggggtgggaaaggccctttacgatcctacaattggtatcaaagtctggctaggttaacatctctggtccgatgaacacaatgtgtgaaggcctgatggactgtgggtgcctgcggggcccgtatacctgatggaccatgggccagtggggcccggatacggtgaaggggctgagggataccaatgtgtgaagggggagattgttgaatagtcctacattggttgaggaagggcaaatgacttagttgtggaagggcaaaggacctaagatataagtgggggagcccctcacctaggaatcctaattggcgccgcgccggcgccggcccacatagcccaataggtggatttttccacgtatgtgcaaactttcaacccagatttgaatactttcaactccgacttgaaaactttcaactccgatttgaaaacattcaacttcgacttgaaaactttcaactcatatttgaaaactttcaactcagatttcaaaattttcaactcgagattcaaaaactttcaactcagattcgaaaactttcaactcgagatttgaagactttcaaatcggattcgaaaactttcaactcgagatttgaaaactttcaagaacagatttgaaattttttaagttaagatttgaaaaaacatgaaaactttcgactcagatttaaaaactttcaactcgagatttgaaaactttcgacttcgacttgaaaactttcaactcatatttgaaaactttcaactcagatttaaaaattttcaactcgagattcaaaaactttcaactcggattcgaaaactttcaactcgagatttgaaaactttcaagtacagatttgaaatttttttaagttaagatttgaaaaaatatgaaaactttcgactcagatttaaaaactttcaactcggattcgaaaactttcgactcgagatttgaaaactttcaactcaatttcgaaaactttcaactcgagatttgaatactttcaaatcaaatttaaaaattttcaagttaagatttaaaaactttcaactcaaaatattttttaaaaaataagtgtgctaaagattaaaaaaagtaatcagaaaaaaagaaaaaatcgcaaaaaaaaacgaaagaaaaaaaaatcatgaataaaagaaaaaatcgcgatgggctttgtgggccagggggcagctcgcgagcgcgccagttagcaacacccccctcacctcaatagctagcttttagggtgggaaaggccctttacgatcctacacaactcgctagctttgtgttgcaatctgaagagaaggggaattaaacgttgatactcagtgttttatacgcagaataatggacgaggatggtggccatctgttcttttagtgcaagtacataaaagcacgtttggctggacatgttctaggaggaggtcagacaggaattggcctcaaagagaacagatatagaagtgatggagagcgtacttaagctagatttatcgctacaattgaaggtggtgtttttattctactactggtggtgtgaaagaaagttttccttatttgcttccaattaaaaagtaggtctatgatcaataccgatcaactagagtgacacatcagtagagtcaagcttaacttcattcaagctcaattacaatagattgaagctcaattacaaactagcaaacattgccaggtcccccataagagaacacgccatctctaacatcagtgacagggtaacaatctgatacgtgtgctagatcatggtcaattggatgggcgttgccagctgcatcaaagaatttgagattactaaatgaggcagcatttttgggtggagcaatcccactgcccatcggagggctcggtttatgttctttccagaaggcaaagcccccaaacacaatgttcaccggcttatttgacaaggatgtaaagagagatctcggatagtatcctataatcttggccttcccatcaaaaccaaagtagatttcccagtcaccagagttttgatcctagaatcatgtgtaattgtattgttatgtcagatatatacacgcagaattgtaatcattgatgagtgaatgatttctccattgttggacaaaataatgaatggtaccttggatactctgacagtaatgtattgtttccttctagaggtgctggaaacagggttaatcacctgtccaggaacgaatgggtgcgagccacctgtcctttggaatccaggacagcgcatatctaaacaacctttcttggattcttcaacctagcattggagtagtcatgacatgataaatgtaaaatctatatgatagttcagtctccatctgaccattgcaaattctttttaggatatggcactccctgtctctctcatgggaattaacttaaagaaaaaaaaataatatgtcgaataaagaactgtattgttaatgaagaaacttacaaaccaacttgtagtgaagtgcgtctgtgaatcgttgtatgattcaggatcgacctatatgaggtacaacaaaattaaacataaaaactagatgaaatgaagtaattgattaatttcattattagctctacttcacaaggattttgactgtatgtttaaacttgtttatgtcagtattagagaagtaaagaagaaaaggtaattcaaaaacatggagataaagttcaacttacattccatccagcatgaattacatttgcagctgttgtttcatctgaattataaatctatatgaaacctctggtttgttgcccgtgctctagattaaatccataaacatccatagtagcctctaatacataatactcagtagcaccgtcgtctggaggaatccatccatgtactgcaagctgccaacgtatttggtcatgaaaatcgtaatcatgtcagcagatgcatctttcagaattagaagacaaaaaaaaaacattgggttgggcactcacatattttgcgctagattgatttgattcatgactcgatttagataagtttgcatgaagtatgggggccatcaatgctctccaattcttttgaaccttgttaattgtgttcaggaaaagcagaatgaacaatatcaactatggctgccactactagtacattttacattaaactcaatcaaatttgaatcataattaaagacagtataaagttgtagatgtacttcctcaacagtagggaagcatcctcctattgttgaaccagtaagaaacaacacaaagaacagtgcatatccagaaaaaactttctccatggtggaattggggagtggaaaagatattgtgttctgtgtgccttttgatacacgtgttcctacatatcctctttatatagacgaatcagaaggggcctgcaaactcattaaatcagaaatcaaaactaaatatttaattcgaagagaaatcaaaaccatatctttcattcaatgaatattaatgaatatatatttatattgcaatgaatgagaagtgcatcaatagaagatatcttcaaccaacttaataaataaaatagatacaaagtgtatcaaacctaattattattttgtctgtacagggttaaaggagagatactgttcaagtccatttatgtacctagatcagttcttttgtaattgacctgaaatatcattgtggtcagattagcattgctcaggttaaaaggatggtgaaaattaatacttttccttatgaaaagtgagtcgcctttggtactggactctccaaggcgccatgtataacctgctaatgagggggaaagtggccgtagaatcgttcttggcagccagccaaacaggagatgctcactgagagctccgccgttgaggagtccaaagctccatattcatctcctgtggctgctcatcgtcttgtacgggtcgtcagcagttagtgggaggagatgggcaatggtggcagataaaaattgggtctgaaaacgagttaggcccagtgtattgagccttaaaataggcctcaagtaaattataagaacacaattcatcacaaataatgctttgccacatcagagcatacctcattattggatcgatctggcacagcaataaggtactggttcagtagaaaccggcacctattataaattataagtaccggttaagagcacaaatcaaagctatagaagtatatgtagttgcactctgcacttcgagcatcgcacgtgacgaggccgccgtcgccactcctgaccgctttgcaaaggtggttgaagcatggcagcttagagaaggaggacgacttgttggggtagtaggatcaggggcggagctagagtattgagggggtgcccaggaatctggtcaagaaaaatagttatacctatctattttcactatatgtatcccctcgatacaaatttagacactcgtagcttaaacttgatataaagcagagtaaattaaacaagtggcacggcgattccaagggctaggctccatcaagctctagcataccctccgatttttgcaaaatattttttttaagaattatacagtacaacgcagacactcacaacgcacgcgcactcacccctatgaacacacgcacgcaaaccctacccctatgagcatcttcgaagactgggccagcaaattctggatagattgacgaagtcactacaggcgcctcgctgtcgacgggtacgtcgcctaccactgaaagcacaacgccgttaaatcctggaaaattcattcccatggggagtcgaacccaggacctcgggtgctactaagtctcttgtaaccactattttcaactagatagctaaaccatggcgtgatagcagcgtttttcctgggaagaagatgaacaggcggcggcgcagcgcctaggagtcgagagaaaagaccaccgaaggaatgaagcggtacgcacgtgttaacagtgaaatttggtaagcccagagtagtcatcggcttagagtcaacatcggctttgaagtcctgagattagccgatgagagttgtcaagtcgtcagttgtcggattcgtgctatattcggttaaggaaattgatctactaaaggaagcttatccgaagggaccgagttcaaatagaatgcggcatgacaagttatctattaattaggaatagcttgttagtttccttttatctttaggaaagtgtgtttagtgtcctataaggactttatcttttccttttatctttaggaaggtttctttcttgtccgacaaggacttgtatcaacccatgggtataaatatgtacacccggggtctatgtaatctatcgctacgatcaatacaattcggtgcatcggccctttttaccctttataatttattt

SEQ ID NO: 74527 - DNA, 9877 bp, Oryza sativa
acacagttgaagtaaatagttgcatcagaatatgagttaactatgattatttgattggcattaccaattataacttctccatttcacctggataggctggcattggagggcctcttctttgtttcgatggaacctttgttggcatgaacttctacgatgagggtgtagaaggcaccgcattcctatcatggtgtgagattcgcgagatcctgaagtattttaagacaaaagggtatgtctagatctttttggttattcaaatgctttgatgatgtgctccttccagtcacaaaatagtgatgttcacatgtagttaaaccaattgactttgaccatagtaattatttcaaatgttaagctttgaatgtataaaatgatacagtaaaatatcataatattacactagattaacattttggtgacttttttgaagttaattttttatgttctgccatgttgactttgaaaagccaaaaacttgatcctttagtaaacagaggggatattgtacaaattcatgttttgaatgtataaaatgatgcagtaaattatcataatattacactagattaacattttggtgacttttgtgaagttaattttttaagttctgccacgttggctttgaaaagccaaaaacttgatccaagtaaacagaggggatattgtaaattatcatgtttcaaggacgtgctcctgtaatacttgtgagaacaattaattttgaattgttgttgaagcaggttcagtcaaatcataattttccattgaattctttgttgtgtttgatagggctgttgctgaacatagccatggtaatccatctgatgtgcttgattggaagattgctggagatgatagtgttcaccctgataggtattatgatgcattacactactatcacgttaaatattcgtacaaatttgtggataacattacattgtgggcaaattactgaatggcagatggccggttcctatgccgtattggactcttcctgaggatctggtccaacgtaaacttgcagctaaaataagaagacaagaggccatcctgtgttgaattgatccccatatcactatcttgtgaacctgtttaacgtcgagagacctagtttctaactttatcacaatgattattgtctagttagtgttgcatgtattatagtgcttggtttcataaattattactaatgtttctgagtagtgtttaagtgctctgccttttgagcccgactgcccgagggccatccgaccagtgatggacgtccgagcgtgcactgtgatgggccatatagcctatggtcttccatgcccttcttgtgctacaaatatgtaatcatcctttgtactcccttcatcacaagagttgcacgtacttatttcgtttcagttttttctcaagagttttacgtattctgcatgtgtctcgaaagactaatcgcgcgggccttcgttttgcggctgaattgaattgtccacgcgagcggcccttggttccttttaattaaaattgatgaatctgcggctgaattgaattgttcacgccaacggcccttcgttccatttaattaaaattgatggattcatcaacgttttcctcaaaggccaccctcgccgctgctgcgccaatagcaagatggataatgggttagtccgctatgtcgtcagagatggcaaggatgaagcagcggtcgctgagtttgatagcgagcacggcggcgccgacgaagcaatgcaagaatctgactctatctcgtagtagtacgtgattgattccctagccggcgatactgaagtgatgccagcagaatcccagcagggggaccgtggacggtgagctcgtagcccgtggaaggcatcatcgtgggaacgacactgtcgtcgatgcgctgcatgccgatggtgacatgcatgaagctatccatgcacttgtgcacctctcatcgatcaatgagtggatattccagatcaatgagttcatgatgcttgggcagccattgcatttggattgaggagggattggaggcaaagaatacgaagactgaagggctgattgaggagcaaagaactgattgagaagcaaacaattgagtggcgatctggcgcccgacccgcctgctcccgcgtggtcgccgccgctgccgcatcgcaggtcgccggccaccggccgccgaacctcctcctctcccgtctcaccctgtcggccggcctgcccacccagactagaagagaagtgagagagaagaagggaaaagagagacatgacgtggcatcctgatacatggggcccatatagacccacgctaactcagcagtcacgccagataaaaccggtatcaagtgaacagtttttcaagttgagagacgtggttttacggttggagacgattttgcaactcgatgacaacttgagggaccttgggtatactttttcctccattcttcccccaagctgcaagggttaccccatattcaggcccaattactggggcaaaaagcagccgctagggcaagggcctactactacagcgttgcgccgtccgcctgcgtccttgcttgatgcttcgcacgcgcgtgacggcgccgccgttcctcgcctctctcctctctcctctctccgccactccgcctctcccccatcccatcgtccacccggcccgagctgcggaggcgcagacctccgccgctgcgcccgcatcggcacagctacagaccaacgcggccgccggcgctgggagctcgggacgcgaggacagcggtacagccggacccccggctgactgacgcagtgccgcctgcctctgcccgtcgcggcgtcgccgttagcctcttctcttgctctctgccctctgcgctacggctgccggctcgtgtgactcagtggctgtgaagtccttcccagcgggcgagacggcgacccggctcctgcaggttatacctctagcagtttagctcatagcttcattattcccatttagtcattgtgtttgaactttctgccaattgccactaccatttgctaatctgtgattagtgaatgggatgctgacttgctgccgctgtagtttgtaggattggtaaaacatgaagagaaatggggatattgctgttgaactatctatacttctatactatgagctggtggttctgccaaccaccaccaccaccaccactgaaatatgggccatggtgttagtataagtttctgagtgcttggtcagcttttttctgtacttctgtagaatagttgtgtagtctttactctctagctggtatttgaagtactatataaactaaagttctttaattttatattgatttaccttttgtcatcttgattcaactaaagaaaacccacaaactttttaggttttaattgtaatttaaaatgacatagacagcacaattcattgaagagtacatattttgtaatcatatcaaaggacatattgttagcacaattggagtcatctatctatactgaaacaaactatgccatttttctttctgtttgttaatacaaagaagctaatatttgttgcaacacggatgtaatttgtttgttgctgttttgaatctggtgtaacgcacaggtatttggctagtctatatttattatttgtaccttttgaacttgcttgtttcattagtcgattatttgttttataagatgttatttgctatatttgtatctctttttaccaaatttatacttgcaatgttcaaaaatttttggcatgtaatgtgaaattgtgaagtagggctagtcaaccataaattcctggctatgccagtctccgtccggttaccagaggagctcaatccagttgcttgcagcttgtatcaggcggtgagcagctcactcctgtagatccgcttgcttgcagcttggatcgggctgggagaagcttattttgggacaaacggaaggaggcaaagatgaactttttatggaacggagggagtagggtggaacagaaaaaaaaaaaagaaaacctttgctttgctttggcaaggaagttaaaccgcatgggtccttactccttaaatcctagctttgctagctctgctccccttctcatttttcttctcttcctctggatcaaatggagcacaaactttgtttaatgcacacttgcaaaaattgagcaccgcaccaacactgccggatgttagcaccctaagcagcagcccacaggttgtcttgctgggaggagctcgctctagtggtggcgggctcatctgggtagcggggtcttcgatttgggtggcgcgagagtacccagccattgtggttgttgtccagagagcgagggagggtgtacggtaggaggtgtacaaagtgagatggaaatggatccccgagtaacatagagaagaggccaagaagggatccaatcacatctctctcgcaatccaagattgggaattccgaccaacataactctcaacgacccgctgcagtgctgcgatttttgcatcccaacctccatatagagggtcaaacaacgagatctctttggttaagacattgaatattctatcattgtgctgttttttttttcttttgctatttctactgttgcagcagctctctctctctctctctcgttgcagtactatgctgctaattgctttctttttattattttgtttcaaaaggttgtcttattgtataaatctataaatgtttgctcctagttgtagcgcctctttgatttttcatatttcgtttttatttaaaatgaacatcactataggttcatgattgggatttattattttgcagttgagttgccatggatattgagcgacaagttcaagagacatttagtaaccactataaaagcgtggtgctaatcagaaggggatcagatggcatcggcactggctttattattggtaaaacaaggaaaagttatgttgcgatgacatgctaccatgtcatctcaggtaacccctctggtgctttaaaggtcagactacctagggacacaaaggattatgttgctgagctgctatatgagcatcagggttatgatcttgcaattattaaagttaatggagtgagtggagaatgcccaattcttcaatttggtgatttagaaggtgtggcgcatagggccaatgtcgttcagcttggatatatccttgggtcacagtttgctttaaacttggacccctcagtatctcctggatcagtcatgtgagttattttcttttgttatttttttgttagcttgtctagtttatactaacttatatagtagccacattatttttttttgttatttttttgttagcttgtctagtttatactaacttatatagtagccacattaatatcttttatttgttttaaagaagaccggcaaaccaaaatggaatgatgggcagccaggatgttgtctacagtgccgctgcaagacatggcgcctcaggatctgcagtgatgtttgatgataaagttattggagtactatattcaatgtctacaaatagccaagttgcgtatgctcgatcaagtactactgttcacatggccttgaagaattggttgcatccaaatgtgagttgtttctgctcttttttaaggtagtcacttaactgttgcttgtcacctaattatattttatgacttcttttttcaggatgctgcaataaccactgagaagatgatagaacttgtagtaaaacctctaaatgattcagagttagacgattgattggactggctatggattgcaagggcatgtggactcaatgggtgtagactctattaatgtaatcgcccatggttgtttgttatttttattgatgtcctctttccatgggaatatgttgtctatgtaatttttaatgtttgaaattatcaatagttagctagctattagatcttgttcttttcagctgatggacagcttacggatagttattgcatgcttttaaagctagaattcctttcaaaaaaaaatgttatcgttgacaactttttctaaattgtgggacagtgatagtattagttaaacccagtctctatagtaatttttggctccgttgcccgtgctttataaacaggaaggctaatacatttacaagtgaaatactctatttgtttttgtttggcattgattagtttaaaattgaactaaccaatgtcatacattgtggaatggggatagtattagttaagccccaagttagctctagtcttcaaatttttggctccgtcaattatgcccgtgctttatgaacaggaagggtaatgcatttataagtgagttgctctggtggtaatctatctactcagctgacactcttctcgtagttgacactattagtatggatggttaaccgcgtgcactaatgtagaattgtagattgtagaatccaaggcaaatcttttgtttgctgagaatttctgaagagtttaagcgtcggatgtgaatgatgtagctctcccctctgtgataagagttgccaatatatgtcaggccaccactattttgccggtcatgcattgccaaatctaagggcactcacagtgaagaccctcatttgaggagcctcaggacgtttccgaggacgtgacacatcagaagagttgcacccttttcgattttttttcttttttttggggggtgggaaggggaggaggtattatacccggtttttattgttgagggagctgactacgaaaattaatttgtaaataaaacttttatatatgtgttcttagcgatctaaaagcaaatgctgaaaaataaagttcaatgaaaaatcctcaaaatcaaatccaaatttaaggttgaaaattcaaattttgactgataagcataagtataagcgaaaagatggggcttaataaggtgcaacagattagggaggcaaaaataaagttattcctatttgagggagttagggtagacttttgccatgtcaaaatgtcaatgaagcacatcaacacgatcaggtcacacaagcctgaatcgtcgtcgggtaaaaaacggcccgctcgactcatgtaatacggcaagagtgtaaaggtagacgcccctcagccacggagacaccaaccctaaagtgtcttgcggtctcgccccgccgccatctgtgtagtcgccacctccccaccgtccctctcttccaagttcttccaagtttcagttcaccggtggagagatagcttcggcggaagacagggaaggaggtcaatctgccgcgtaagttgtgctcttcactcatcacttcgttaattttcttttctcagcttgggtgtttgatcttgtgatggtgttttgctctaattttgcccccaaactgcatttcaatgaagaaccgtagatctgtgtgtagcaactatatttggccattgactttcctcaaaactccattccgcgaccaacaggcacctgccggatgcggcgagctgcggtgcgccttgtagtgttctttgttcaagggctggggttgggacttgggactccgcgagctcaaagagagcaccttatcttctgttttgtttgtataggactaatatataatattgcttttgggataaattgctattgtgttgttagtttatgagataattagttgatatgattttctgttttgtataggactaatggagaatatggagaatgaatttcgtagggtcttcaacatgtctctccaagtgttgtgttagtggaacaagtcggacggatcgactattactgtattggttcgattattttcagtgataaaaaaaaactttcatactcacccagtcctcaattacttcatctgctgcgaatctgtctgtccgtttctccgatggttttaaacagtcagcatccctcattttaaaacaagatgtacaagaaagtgcaagcggacaatgtgaattatgcatcttgatgactgattatcattccaattccaagacggtggagttctttgaaggtgatgttgatcattcatatgcggttgctatcgcccctgagtcaaaatattccgtacacaacatgcccggttttattatacataggtcacttgaagcagcaagcgatagctctgaaagtgtgtacaaaggttctgaggattatttcactttcgcatgccgatatggagacacaagtccgaaccttgtgagcagattaatcacaggtccagtttttaatctgaatgggcaagttttagggatcgttgttgatgatattgagtataaattctggcccaagaagcccaggaaggaagatggtagtcaagagattattcatgaagatcttttctatcgcgctggatatttcttaaaggttgctatgcgtgttaacaaccttcagcaagacttgaggtcgatggtaaaagacaatgactggcagaatggtctgaagaaaatagctactgaaagaagagtgtaacagcaaaaaggagcatgattcctgagatgaacagtaatagtttttggtcgcgatccctaaactgtttctgctgtagtttagttgtctgctaagtactttggcttgaatcagtcatatttaatcgtactgtaagactttatttgtcgcaaagtgttggctctgcagactttatatgttttcattcgtaccgatcggttgtaattaatttatcagacttgaggtcttttgtttggaaaaagttcatttttgtcttaattatcaccaaattcaaatatcgagcgatcttcagatatgcttattattagatttgttttatcgtatattttgaataggaaatattggttcaaactgtttgtgattttgctatatgatttaaaagtttttagctgtcaaagagaagattaaactaccagtattgtttgctaccatgtgcttgcatggtcattaccggtaacgtaagagcaagtttaatagtatagtccactattagctccaaaacatttataattaatgtaatagccaatttatataatagttgtttactatactataattatctggtcccacttgtcatacacacattatatcttggagttcgtgccgtagctggctacagatctgtagcccgctgctcttctctctcatccgttatctctgtagaatatgtttatagctggcttatagcctgctattgtacctgctctaatgaggcaaatacacatgatgtgtggcccactgtcagtctgtcattagctgttctaatctaatactatatgtcttccgacatatgatcctcgtctcctcgatcctcttttttttctagtccctcctaattcgagctcaacacagataaacattcagattgctacttgttgcacttgcacctgatcgttgcaacagctggtgagaaaggaaaaggattggattatacatcaccatcggcatctagttaaaaaataacaatcaacaagtcattagtggattacattcacgtttgcacaatttactccctgaatttaaattattctccactggacattttcaaatccagactatcaacattagccaaattaagttgtgatccctaatttgctccaaaaatttgtgaaaatagaataagtccaattatataagatgtaaataaataagtagagcatgctcatctttcctggaaaataaagaacccatgcaatacctgcacatgtaattcaaaatggactccgatgattcccatgcaacaagaagctgatcacacacatttcgtgcacgtttcattaaaaagggcaatcatttaaaactctcttactctatttggtcagcgttaccactactagaaaacgacttttagcgacattggccttttatttttccacacgggtatgatcctcgcagccaaatatctgcctacgaaaatgtaaaccgaggtggattttcgtcatccgcctgtgaaaatcattttttctaggcgga

SEQ ID NO: 74528 - DNA, 7686 bp, Oryza sativa
caaaatcaaagttgtataacacattgagatctactatttttcttttggtcatttcgccatctgtgtttgattgaactatataaaatttgaattttaaaaataagaaattcaaataatttttcaggtagtaaatgatttgaaatcaaaaaaattgtcaagaacaaagttgtaaaacacatcaagatctatttttattttggtcatttttctatatgactttgtttcgacagtttgaatttgaatttcaaattatgacaacttcaaacaatattttcaaatactaaatgatttcaactgaaaaagtcatcaataacaaagtggtataacttatcaaaatctataacttttattttggtcatttattcatccaaaaaagtgatttgtaagattattcacaaaatgtacatatctcttatatagttttataaactataagagagatatgtaaattttgaaaaaatgttaccatcactttgtcagatgaagaatgaccaaaatagaagttatagatcttcatgagttgtacaactttgttattgatgactttttcagctgaaatcatttagtatttaaaaatattgtttgaagttttgaaattcaaatttttaattgataaaacaaagtcacaagaaaaaatggccaaaataatagtagtaagaacataataacatggtagagcatgattttagaaatatttaggaaaaagaattatccaatttggtgttcatatgagtgagatacactattttcaaaattttcaaaattatttttgcatacggctgcttaagacgcccgtatggaaaaatcgattttttccatgcgggcgcttaagtgagccacatgcactcttaagaggcccgtataggaaaatcgatttttccatacaggcatcttaagcagccgtctgagaaaatgctactcgatttttgcagacgccactagttatggtccgtttgtaaaaataaaggggtctcgtacagaaaaatcatttttgtagtagtgaatacaaataagatatgttaacacgcttttacttgcaacaataaggagcatatcaagtaacatgattttacattaccatgaccatgccttcatgcattaaatatataaaaaaaacacatctggacaaaatcgccaaccttcttttgttccacaaattagaactatggagtgaatttaattctaaaagatcattcatggatattgccatagatggatcattcatgatatagccaataggatcaatagttaaatacacatacctcaaactctcaacatgctggtatagattatctcgactcactctagcccaaaaacatgttgtcttattgaacctctcctatcccttagcttcaataaattgaccatgttctagacagatggccctccaataattgttttcttcttttaaataatcttccttcacaaactgcagcaagtatggtactaaaatatgtgccatgttagaattctagatctggacatcacatttgacagacgaccatataatttcattgtaaccttgaatgtccacttaaaaaaaatgaagttacaaactgcgatttttttagagataattgtttctctgcgaactttaggaccaagagtagtctccatatccattccaagaatttgtttgtctatcttgctgagcgacaaattaacttctagattactaaaagcatgaacacacctgatgtagactgagaagcggcaagggcacagcaatggtgaagatatatatagaagaccatgtgcgaaataagaacatttcggtgcagtaccgccaatcctatgtaagttataacccactgaatcctaaacctcaacatgcaaatataccacattatcatccactaataattattacatttaaacatcatgcaagtaagttatattatctataatattataatttattaaattttagagttttaaaatgtaagcatgttaagtcataatcccacataattcacatgatattttcaatatatttctttatcattttttataatatcatatatatgttatttccctcttctctcattaaatcacatcaatagattgtttttagtattagatgattaatctatggtccaaactatctcgagattagctcactcattttcttttttcataaagcaacatcaccttactattatatttgaatcatcattctatatataatttaaatttaaattatcataaatcatatcaacttacataagtttacgttgtctagttatcttatagattatttttacttattgttatcataataaacttccgccgcagcacgtagggtttcacctagttagtacaagaagcaagactattttaccaaccaaaaaacagaaggggatcagggcctttggccgcgttcttttcagtggttgggtttggatgattagctgcacgtaaaacgagaaacgcgatcagcatataattagttagtaagtattaattattaaaaatttgaaaaataaatttatttgattttttaagcatcttatatatagaaaattttcgcacaaaatatactgtttagtagtttgaaaagcatgctaacggaaaacgaggaatatatgaactgcattagagaaagtttaatagtataacccaactactaacttcaaatcatatatagccaatctaatagctcattcatacaactaggaaggtagctcgcgtattcgtgtgggcatgtaccgtatgtaagacgaatttgagaaacttatagggacaatataccagcaaaataatatctgcaatgtttcaaaattgtgattgtttttcatgaattttcttcattagcatcacaaaacgaatttaattgttatttgtaaaattatctattgaagattggggctggtaacttatggtacctaagaggctaagacatactccctctctgtcccataaaaaatcatcttagattcatagttagaagttgacttttttttgacggaaggagtatgactcttgaagttccatatggaaagagaaaaaacttaagttataaaagatattacatatacaaccatatataattaatggttgtactgatttatgtagaaaaattgatactataacaatattattggatggcagacatcgattggtcatagctatggataatttctcataggaaattatgaatatgtgtattgtacagggatacaaattagaaaaaaatagtagaggctacgagaaaaaacaaaatatatgaccctcaatttttacttaattcggtagtccattatttctgaccattggatatttagatgatctaacatattgtgcatattccaactaaccaaattattcgtcttccctcatcaccaatgttggacatgttaatccggataaatctatttatctatgatttacatatataaaactttaagtataataaaatgtacacactactctgccaacgcagccaacgatgtgtgcgacaggttcgccacggccggcttcaacgtgaacatgatcacgtatacctgacgtagcagctgcaccggccgctggtggtggcctcgaacctcctcaccaacttcaccggcacggctgattccttcgccagccacctctggaccatcgccaccgacggcgttctatcccagctcggcatgctcggcccctcgtcgtgtcggcgctcgtccctgccctccgccccgcgtcgtgcagtgctgctgccgccgccccgtgacgacgactatttagactacgtacgtatacgtacgtacgcacgtactgaggagagggtggatctatgggagaagaggagggttgtgggattttttttttctaaagataaatataatagttgaaaatagtaggtctagcgatttattattacagaatagtgggtctatcgatttattagaacgtcacgtgatggcttaattaggagcgtggcagcttaatagtgtttgtaggaagtttattggacttttagtatataatggatagagagaagatacttacctataaacatatactacaccattaatatatggtcccatctctcatacacacataacgtattggagtccgtgctacagctggctacaaatctatagcccgctttccttctctcttctcttctctcctccacatgtgcttacaagctgacttatagcctactactgtactcgctcttaggccctgtttagatcccacacacaaattttataccctgtcatatcgaacgtttgaacacatgtatgaagtattaaatataggctaaaaaataactaattgcatagaatgcgactaatttgcgagatgaatcttttgagcctaattgctccatgatttgacaatgtggtgttacagtaaacatttgctaacgacggattaattaggcttaataaattagtctcgcggtttactgacggattctgtaattagttttttttattagattccgaacacccccatacgacaccatatataatatccgatgtgacacgccaaaaatttacacccttgaatctaaacacccccttagatgtttagaacgcggcccaagacatctctgaaattgtgcgaggaaactactgattaagagatcgattgttgcttcagatttactataattcgcgcatgacccttctatggcaattattgctagtacttcctcttagagcaagtataatagtaggctataagccagctaaatgttgaggtggaggagagagagaagaagcgggctgtaaacttacagccggcttggacacagaaaccaagaaactctgtgagagagacaagtggaccatatattaattgtaaagagctaactattatatgggtaggctgagagaaggctatcaaatcttatagccaacaggtcggctatattattagccttgctcttaagcagctcctgcgtctctcgttagcatgtaattcaggtcatccagccatatgatcttgctgcacgcatgcaattaaatcattcagacatgaaagaatgcattatcaacttaattagggacatatagaaattcagtgtcagacagcggtgtaggatcgaacaaaactaaacaaacctaccgaagtgtggataaatggtagagaaaactgaaaacccagaatcttttgtagaataaaagatttacttcgaacggagtagacgacaaagctctatcgccgctggtcacaccgcccgcttgccgccggttagaccaccgtgtcgcctaaggttagaccgccacataatcaaccttggagcgttccttaacctaaaacagcctgttccctttcataatccgattgatcagcatgggcttcccacacctccgaggcctcggaaaagcagtagtcagggagaggcttcgtatcggaaacgtcaaaatccagattaaggccgtggcgatggattggagaagaagacgacgacggatgagggatgtgtaggggcggggagggattcctatctctcgcccgcggcccagcaacagaggtcgcgcgacgccgcacccccccccccttcccccgctttttttttcgattttctcatttcttttcgtgttattttctgatttttttttaatcttcaacacatgttttcaaatctttacttaaaagttttcaaatctctagtcgaaagtttttaaaatttgtcttacaaatttaaatttcgagttgaaaatttttaaagtttgagttgaaagttttaaaaatttgaatttaaagtataaatattgagtcgaaagtttttaaatttcgagttaaaaattctaaaagtaagtttagagtttcaaattttaagttgaaagttttaaatttatataggacttttaatttttcaatagaaagttttaaatcggaaaacacgcacgggctttccagggtggggggttgccggttaggagcctctttctagagcaatgctacatgtactaattttttcttactaaacttttactaacaattatctcaaccatttaatttacgtagatgaaagttataaaaaatctagatgccacatagcatgacacaacagtattagtaataatttagtacgtatagccttttccctctagtagatatcacactatacatgagcagatgagctctcaaggatcgaattccctatagatctgtcgacagattttcagttaaacattataattataattacattgtaattttagtttactatcactatataccttcaatataaactttttttcccttgaaccaacttggcttaattgctttatggtgtacggttaacagggcagtgcaactagagctcttcgaatcaatccccgctatgcacgcacttgtgtttttatccatcgtattagttagcacaaatctccacgcaaatcatatggcctaaaaatcgataaatctttaactgaaaatctgtcgacagatcgatagcgaattcgtttctttttcacacgcatacttttcaaacagctaaacaaagtattttttcattctttttaaaaaatagataatacttaattaattatatgccaagaagttttatgtgcgtgtgagattagtttcccaaaccacgtgatacgtacaatccaatactactcgttgctctctgtatcaggcgctcttactactccctccgtttcaaaatatttgacaccattaacattttagtacgtgtttgaccattcgtcttattaaaaaaattaagtaattatttattcttttcatatcatttgattcattgttaaatatattttcatgtacacatatagttttatatatttcacaaatttttttttaaataagacgaacggttaaacatgtgctaaaaagtcaacggtgtcaaatattttgaaacggagggagtatttcttactatccgggcggcatgctgagagggtggcggcggggcacagtccccgcaacaatctcagaatccggtacgggggacaaagaggtgaaactggcaacggcggtagggagctccggcatgggtggccgcgcatccgatgtcagcgtcaatggatccagctccccctgtctggataaggtgcccttgcgccggatctggcaggggccgtggccggcaccgcgggggcgcaaagctggcgtggccggaagcggcgatcaaggccgtgcgtggcggcgcgatggggcacggaggaggtcaagcggcgcacgttgctgagcgatgcgtgttagacacgggagctggcggccagagtggtgggtgtggtggatttggccctccagtggctagatcaggagcgggcagcgacaaagctcatggcgagcaggcggctccaactacgttgcttctcgcaacggtggcggagctcgcggcgactgcagacgggtggaagcgtggggtggagtgcggaagcgctcccgtggtcggtggcggaggaggacgacagcgtaagcgatggttgcacgacacgaccgtcggcgaggccgaaggcatggaggccgtcaccgtgaggccagcgtaggcgtgggcaatgtcagtgaggccggcacagatgacgccatggaggctgtcatggcgagtccggtggcggtgatggtggctagccgatgaggcgcacgacgagcatggtgtgatggcttgtggctggcgagcgcggcgcggaggttgaagcggtgtggcagctgtggtgggcctgcagcggcgaggctacagccatgggaggtcggaggtgacagtgatgcgaccaagcg

SEQ ID NO: 74529 - DNA, 5441 bp, Oryza sativa
tagaagtgatacaaccctaccagtctaccaccacagccgtctaccgcactcctccagtccccaccgcgctgccgccgcctccttcagcccccaccgccgccgccgcctcctccagcccccaccgccccgctccctcttccagcctccaccgcaccgccgccgccgcctccgatctccgccgcgccaccgccgccgtcctccaccgcgccgcggccaacgcctccgccctccaccgcgccgacgatgcctccgtcctccaccgcgccggcgacacctctagcaaattttttcgttccaaactttctcctcaaaaattttggtcagaccgagaccgagaccgagaccgaatttgccggtcctgagtttttttggatgaaattcggtcctgagtttgcaaagaccgaactgatcgaaaaaccgaagaccgagaccgaatttttcggtctgaccaaatgcccacccctaatggccacactagacgtgccagtgccccggggggggggaggggatccatccttctctttcaccctttccctctccaacttgcccgcgtggatggatctggagcgcatcgaaggttaagaccttactctgatggccggccaacggcacggtggctgcgcattaagggagattagctggtgatggatgctatatttgacgggcactcgttgacgcgggagagtaggaaagcaatgggtgaaggcctagcctctgggccggcaatggcaatgcttgtgagcgtcgctttctcccttcgggtgttgttacactttactccttctccattggtttctttaggtgcgaagcatctaggcccccatcattgattttggtaattaatgacaagcgctaattgtggactaactattttcttgagttatacattttgagttaggaccacgtgatatgtatgcatggatgatcaccggggactaaattcaatggtgcaaagcaaaaggaacaaagatggtaaaactagaggttttattttaagtgatcgatgagttgggcgatcaaaatttgctagttttattcatagctttgtcgtactataaagaggggtaatgacctaaacaaagagatgataaaaatgccacattagatcatttgcatttagacttggttcacaattaaaattgatttacttctctatctaatgccggtctgaccgagggcctaatgccgatctaactggcaggtgttggccggtctaaccgatgggaccttgccagtctgaccggctggcctagtaccggtggtcggcctctgggcgaaaaacccaagccccagagccacagccagtcggtctgatcggccgccctatggcggtttgaccggctcccgtgtgtctgtgcatttaatgcactgcaacggctagttttctagccgttgcaaagtagtccggtctgactggcgaccctatggcagcctgaccggcaatgcactgagttggggattatgacccacacggctagtttttgtgggtgggagtataaatactcccccaccaacagcaaggagctctcttggcacttgcttcacttgcatataccccttgtacactctctcacactctctagtgcttgtgttcatccatttagtgtgattgagggttgattagccaatagtgaagtgcatttgattcattgtagagctagtgtggcacttgatcatctccgagccaggtcattgcttgttactcttggagtttgccgcctcctagatggcttgtggaggtgttgcctggtgacctctccaaggagattgtggagaaggcccggcgccggttgtgagtggtttgaagttcaccaccttcggagtaaaggaagaactacccctagtaattaaggctcgggtagtccacttcgtgggtcggctcccaccttacccaccccttgacaaagggggcttgcggtggcttcgtggttttgagcggtgaagttgggctcgcctcaatgggaagtaggaaaccggcgagtttccgaacctcaggtgaaaaactccttctctcttgtctcatttgcttattctatttatatttgtgcaatttactttcatagagacatatttaaacccatatcaccctacgattgcaaaacttatattatgtgtgcaatttactttcacatatacatatttgaggccgtatcaccctaggattacaaaacataacttagtttcttagttaaccttgtatctcaccaagcctaacaacttaggttagttttgagtatgtgtcatttagttttaaatcgcctattcacccccaactaggcgacatcacgatcctacaaggtgaaaaccataacctggttttttagaacgggcaacgacggcactcttggcatcgccacctccttggaggcgttgtttagaagattcattcgtgttgtgtgcctgttaggcttttcagtagcaggatcaagcgcagacgcgtggtgtggttgtattttccttttccttactatagtctcccagtaatgtagacctttttttcttgttatatatcaatataaacgtcataatatcttgtaccgatttcaccgtacatgaatgtcgcggttgctgtttttgatggtcgttgagacagatagtttggtactatcagatttcagttccgtagctcctggatcatgatagcatcagtttcatcatcagttggtctgcgatttcatcgtaggctaataaatagtacttcttcttcttctgtaccctaatatatataagagatttcgatattttgcttacactgtttgactactcatcttatttaaaaaatttgtgcaaatataaaaagtaatttagataataaaataaataaaaaaataaaaaataattctaaattttttttaaataagacaaatgataaatagtgcaagcaaaatatcagaacctcttctatcaggagagggaggaagtatgtgacatgttctagccttttggaaaggagaatctactgtttgacctgagcatctgaacagtgcgagccccaaaactgaagtcaacctggtgaatcttgggaagacaaatgatgccttttgccatggaaaaacatttcaaaagtccccaagaccgaagcagaaatggagatgctactactgctatttgtctctttggcctatttttagagcgctcatgtctttctgcctcaccgctgcctctgcctccttccaaatgcttcgccccccgagctctcctcggcgtgcgcggcgcagcgccatccaccccgacaactcctcccaacccccaacctatccaaacacattttcttgcccgcccctgcagctccctccaccgcgccacccatccatcgccagccatgcacaccctcgctctgacgaccctgtcacgttgagctacgctcggaggaggacgccacgacggcgaccgggaagaagatgaacccgctccctcccccggccagccggctgtgggaggcgagcatccgcaagctcaagtactccaccatcctccgcggctccgtcgtcccctccggcgccgccttcgatggtgcggcggcggcggccaccggaggtgaccccgtcacgctcaccccaagcctctccgtcagctcctccacctccaacaccatctaccagtacgaagacggcgacgacgacatcgactccgtcctcgacgacgtcgacaccgacgacgacgacgtcgacgaggcgtccctcggcgagcccagccactccgaccagctgctgcccagcggagacttctaccagggcgacctgcgcggcgacctcccccacggcgccggcaagtatctctggacggacggcagcatgtacgaggggtcgtggcgcggcggccgcgcggccgggcgcggcaagttctcgtggtcgtcgggcgccatctacgagggcgacctcgccggcgggtacatgcacggccaaggaacctacatcggcgagctcggggacacgttcgccgggctgtgggcgaacaacctccggcacggccgcggcacgcaggcgtacgtcaacggcgacgtgtacgacggccactggcgcgacgggctgcaggatgggcacggccggtacatctggcgcggcggccacgagtacatcgggacgtggaaggccggcgagatgcacggccgcgggacggtgatatgggcggacggcgaccggtacgacggcgcgtgggaggacgccaagcccaaggggcagggcacgttccggtggtccgacggcgggatgtacatcggcctgtggtgccaggagtccggcgagacgcagggcaagggcgtgtactacccgccgtccggtggcccggcggtgccgttgccccgggaacccaaggaggtgatcacgaagctgctcgaggagctggagatgtccgaggggaagacggtgtcgctgctgccgtcgcagaaggtgctgacatggcccggggtggagcccgtgacgaagaagccggtgtggcggccgccggaggtcgccgctgaccaagggatgtggcggccgccggaggtcggagctgaccaagggaggaggtcgagcaggaggaacagcatgtcgtccgacattgacagcctggttgagggggaggacggcggcgaggagactcgcaacgacaggtcatgggtgcggacaccgtcgtgtatgcgcgcgcccacgctgccgaagccggggaagaagcagggggagaccatctccaagggccacaagaactacgaactgatgctcaacttgcagctgggtatcaggtgagatgatttgcttcatgtccactaatgttattacacatgttgactaattgacacttttaagatatggtaattaagaatttgcaatttgttgtctatgacatgtgagtccaatagcaagaatcacttgtaagaatgacaaatagttaattattctgtcattggtgttttctgaatgctgatgcattggtcttctaaattcgatgcattgacatttgctgttcatattatttggggatacagacatgctgtaggaaggcagtcagctcctgcttcattggatcttaaatcatcagcatttgatccgaaagagaaggtgtggacaagatttcctcctgaaggatcaaagcatactcctcctcaccagtcatgtgatttccggtggaaggactactgtccattggttttcaggtcagtatattaagatactgtaatatatggtcattcttttagatttataatatattgacgtgcaaagattttgagatactgtaatatatggtcattcttatagatttctaatatattgacgtgcaaagattttgagtgttcaaaaaaaaattgataagttttttagataaggaaggtaaattacatccccagcctctacatccaggatgcaatatgtcattaaatgtaccgttcaaaaaaatgtgtcattaaatgttccttctttattttgtcctacagagagtaacttcattctcttaactgttgctgg

SEQ ID NO: 74530 - DNA, 18035 bp, Oryza sativa
  unsure (1)..(18035): unsure at all n locations
ctctgctaatctagtcttagcatatcaatttagctctatcggctgcttcttgttttagggtttctactagtatcggctaaatcgcgttgctagattagattagcttagatatctaccaccctgaaaactcagtcaacggcttaattgtctagatattattttttttcatacttagtgctgtatcagttaagtttgatctactaagtcgtgcttataaccataatctctagcctacatcttgattgccaataagggtttcattagggtttcagccggtgagttatctggacgttgcatcagctcataaggattgcatatacatataagttggatttatccgatgacaacaaaggtttcactgtttaatctaatcttgtggatttcatgacatcggacctccagccgatgtgtgctttaaccttcggatcgatgcttatttatcacatcattgctagtcgattggtttatactagattatattgttattttattacatcatcatcaaccgattgcctttatattattatctacattggacatatagccgattgcttaaaccctatcgatatcggctggtatcggcatcggctattatcgctatcatctggaactactccatcggcttgtcagccgattggctgttttgatctactatttgcatatcttgtcaactgcaggatcaaactaactggcacgcccgcatcttaccaagatttcgacctgcacaggagctaagcagatctcctaggccagtgtgttcgaatttttcgtcaacacaaattggcacgcctggtgggacatgagttttgcacctaacaagtctgaagaagaagtcaattccaagaaggggcaatctactaagccgatattttaagattaagttgatgaagcagctcattgcaccttgattgaacagtctgaagttttggtggttacattgtaaattttgatcaagagaacagttgatgagttaattgttcagagacaccagctcgggggcagattgaagagcaataacaatatcggctcggggggggggcaagcacatcagtatcggctcatgaaagccgattgcaagaagcaacagaggatcaattttggagtaatcaacgcgagacagaagataattttgaagcatgagtcctcatactccaaaattggggggcatgtgtgaacagtgaaatttggtaagcccagagtagtcatcggcttagagtcagcatcggctttgaagtcctgagattagccgatgagagttgtcaagtcgtcagttgtcggattcgtgctatattcggttaaggaaattgatctactaaaggaagcttatccagaagggaccgagttcaaatagaatgcggcatgacaagttatctattaattaggaatagcttgttagtttccttttatctttaggaaagtgtgtttagtgtcctataaggactttatcttttccttttatctttaggaaggtttctttcttgtccgacaaggacttgtatcaacccatgggtataaatatgtacacccggggtctatgtaatctatcgctacgatcaatacaattcggcgcatcgccaccttttaccttttctactttattttatcgtccggtgggacttggcacctgatgcggagctgcatcggtgttcgatctccggctaagggataagtccaatgttccgctggcccaagcaattctatcgtttacgtcggcgtcgttcaaggctgcatcagtacattcgacctcttggattgctttggtttggatgatatatttgcctacctatttatcatatgtctctgttaatctagtcttagcacatcaatttagctttatcggctccttctcgttttagggtttctgcctgtatcggctaaatcgcgttactagattagattagcttagacatctaccaccctgaaaactcagtcaacgacttgattgtctagatattatgtttcttttcatacttagtgctgcatcagttaagtttgatctactaagtcgtgcttataaccctaatctctagcatgcttcttgattgccaataagggttttatcggggtttcagccggtgagttatctggacgttgcatcggctcataaggattgcatatacatataagttggatttagccgatgacaacaaaggtttcactatttaatctaatcttgtggatttcatgacatcggacctctagtcgatgtgtgctttaaccttcgaatcggtgcttatttatcacatcattgctagccgattggtttatactggattatattgttattttattacatcatcatcagccgatttcctttatattattatctacattggacatatagccgattgcttaaaccctatcgatatcagctggtatcggcatctgctattatcgctatcggctggaactactccatcgacttgtcagtcgatcggctgttttgatctactatttgcatatttgtcagttgcaggagcaaactgactgggatgcgagccgcatctcaccaagatttggacctgcacaggagctaagcagatctcccaggccagtgtgttcgattttacgtcaacagcacgaaaaagaattattaggccgaaatgcccaattttgtgggctcgtggcctatgtcctcctcccagacttcactgactcggtcaccccaagtccacagccaccagaggcgaagcccccaaatccccctccccccaccctagcacggcgacggcgtgactggcgggcggcggaggcggcattgcgggcttgcggcagtgttgcagtcgaaactcctaatgggcgatcaatcgctgggctacaggagtagcgatcgatttctctttcctttctaatccaaacgcgtgcgtccgccacttaccttttttggctttctcagcctagtccttttttctttcctattgggcttggcccacgagagcccatccgcagccacattactttcctattttagtaaatttatgcatctaaagtctgtacacctcaagtttacacatttaaagtttatacacctaaagtttagagacccaaagtttataagtcaaaattttatatatccgattcaaatttgaatttgaattcaaatatttttatatatagtatttctataaatctaaagtttatacacctaaagtttatagacccaaagtttataagtcaaaagtttatatattcgattcaaatttgaatttgaattcatatattttttatatatagtatttctatacatctaaagtttatacacctaaagtttataaacccaaactttaaaagtcaaaagtttatataccctattcaaatttaaacttttgacttataaacttgggtgaatagctaatttagtccctcaagtttcaccgaaggctcaatttagtccttcacgtttcattttgtccacatagctcctttaaatatttgctttggcttgaaatcatccttgggcccacttaatatgccttatggctatttctagtcaatatttctattagaaaatatcccttttgcccttaatttgtatacaactatgaaaccaagatgaataaacaacattacaaatatactttccattatttcaacatgtgcacatgaaacttaagcaattgctatcgtatacacttgctagtacataatttattttttgttttatataatttactatgcattatctatataaaaaattcaagcatgcaatttttctcttatatatgtgaatgataagggggtataagtgtcatttatcaagagaattgttggttattgataagtttgaactaaaataaaaacttgaaggactaatatgcatagattgaaatattagagagtagagtaaactgagcctcaaataaaacttggaggaccaccttagctattcaccctataaactttgggtctataacctaatatttgaattcaaattcaaatttgaatcgggtatgtaaacttttggctatataaactattagctattcacccaagtttataagtcaaaagtttaaatttgaatagggtatataaacttttgacttttaaactttgggtttataaactttaggtgtataaactttagatgtatagaaatactatatataaaaaatatttgaattcaaattcaaatttgaatctaatatataaacttttgacttataaactttggtctataaattttagatttataaactttagatgtatagaaatactatatataaaaaatatttgaattcaaatttaaatttgaatcaaatataattcaaattcaaatttgaatcgggtatgtaaacttttgacttataaactttgggtctataaactttaggtgcattaactttagatgtatagacatactatatataaaaaaatatttgaattcaaattcaaatttgaatcggatatataaacttttgatttataaactttgggtctctaaactttagatgtgtaaaattaaagtatacaaactttaggtatataaatttactaaaatatgaaagtaatacggtgctttaaaaaaaaaagaaagagaggagggaggaaaacgcgtgaaggcgcaagtgggtccttccctgatcgctcgccgcatgcgccagcgatcaatcgcgcaatagtggccccccacggcgtgggcaggccgtaggacgcaggcagcgatgcgaccgtgcgctgtagacggtagacccatagtgccgagtgggcgagcagagtagacgagcagcagcaaagtcagcaactagcagagcaagctccaaatgcaaaggcagccaagccgtgagtcctcactccatgttttattcttttttatttcagcagcaatagctagaatgctagttgatgagatttacaagaattgagcttcattgtctcatagatttgatttattcatagattagtagctatggagaagaaaacaacattgttaaattattttaaaatgattcaagtggcacccttccaactgatgagaatataaatcagccagaaaggtttggagatcatttcaatggaattcgttcgataaatttgattggttgaatatagtgtggaaaatgatctcttaatattcttagatggttgatgcaaatatgcaatcactcacttcctagtggcaatgtacttttttttatggtttctttttcaatcatatatgtgtgaataactaccttaatgtggtttttttaatcatatatgtgtgaataactaccttaatgctttgaagttgagcctatcctttattcctatcctggattcgccattggggttactgacgtgtgggcctaatctttatgggtctcacataacagtggtaaagtccctctgactttacgtgagaggagactcatccctcgtagacggtgaccagcaactcagcaagaaccggagaacacgaggctgcgctcggaggcccaataaggtggcgaccaatatatctggtagtagatcggtatgggcggcgaaacatataggtgtaggaataagttcatcataggtcccttaacttgtcaacgaatccgattttcatccctcaaccgaaaaaccaaatataacgaatccctcaactatcaaaaccggtgcagattgggtccctcggcggttttgagggtggttttggctgacgtggcgtctacatggctgatttgactcggtcttcatctgacgtggcattgacgtgtcgcctacgtggacccacgtgtctgtttcacacacaaattaattaaaaatggtggagtccacatgggccccacatgtcatcctcacccctcccctcctctccttcctcctctcttccccatatcccctctcttcatcccactctcctctcctctctctccaggtgacggagaggcagcggcacacacggcggctcccggtcgtcgctggccgacttgcgcagcggcgccggaagcaggaggaggtggcggccgcgacgccaactgcgacacgctcgtgccgtccttcgtgcgcactgacggctgcggccgtggcgaccactccccgccggtccacacgttcggcttcggcaaggaccacgacgcggtggcgatgcacaccatcgccgaggtcaccggcgggacgttctccttcattgagaacgaggcggccatccaggacgggttcgcgcagtgcatcggtggcctcctctccgtcgccgtgcaggagctccacttcgacgccgagacatggagaggaccggacagaccacgagcgtggccggcgacgaggaggcggagtccggcgtcgccgagcgctccgtggaggtggaccgggagctggtccgggtggaagccatcgacgacatcgcgctggagtagggattagttatcgttttttctgtttcggtagtagaagagatcgagcagggatcggattgtgggatggcacggttagtcgttgatccggcaagatcgcacatgtaacaacctcctgtgtggagaagaataaaaggaagaagagaactcagaaaagctgcgcagttttgcagcaccaaaacgttgttcttctctggttttctacattgtcgtttttcgtcagacactgttcatcattctgaaaccgtcagacaagctaggatagccactgaaatcgcgtgtgtttgctgatagctccgtcgtggtctccttcatgcagcggccggtgggaagctaccaccatgtcacctgccacgacggcttcaaggtgctccacctgccgtagaaggcggcaacgagcgacgacacccacaacgacctctagctccgacgccgtgggcaggagttcgacgatgatctcgggttcacgctgtgcaatgattactactcgccgccgccgaagttggtggacttcgtcgccgaccatccgttcatctccttctagctactccacgccacgaccccttcccgtgcggccgctcctcggcgctgctgcgaccggccgcctcgccgcgcgacgccctgcgaagacgatggattgcgacctctcctcgacgatgaagccctgcaagggcgaggagctcgcccgccaccgctcctcctctgctccgccagcccgcttcgcccgctcgtccacgcctcgccgccgaggtgctgtcctgctcgtcggcctccacgcgcgctcgtaggcctccctccgtcgcctgtagagaaaggagaggagagagtgatgaagagaggggagatggggagagatgaggaagaagaggaggggtgaggataaaatgtggggcccacgtgggccccaccattttttattaaatttgtgtgtgaaactgacacgtgggtcccatgggttttattattatttttggatcgaattgccatgtaggcgccacgtcaatgccacgtcagatgaagaccgagtcaaattggccacgtaggcaccacgtgagccaaaaccaccctcaaaaccgccgagggatctaatctgcactagttttgatagttaagggagatattgtatctggtttttctgttgagggacgaaaatcggattcgttgacaaattaagggaactcagatgaacttattcctataggcgtatagccaatatttggtgggccacaagggttagcgctgaatgtggcccatgtaaattaagccagaatggaacaattaggaataagttcaccggaggtccctcaacttaatagcgagatttttttaagatcccttaaccataaaaccagaaatgtgaacccctaaactctcacaaaccattcactggaggtccctcggcagtatttttacccggttttgctgacgtggcatcctagtcagtaaaaaaaaagtacgtgggatccacatgtcagctgcacatcttgttttcttgtcttttcttacccttctcttctctccggcggatgcgggaggctggcagcgagcgagcgcggcagcggtctgcgagtggcaggcggaccggtggcgggcagagcggtggagggcgagcacagcagctgccggccgcctttcccctcccccatctggccatatcccgtcgaccacctctccctctcccatcctctccacgtacgcgtcgcgccggcgggagagggggtggagcgccgcatcgtcggccgcgtgtcgtgaggaagaaggcggcggccggcggcggaggtggaggtggaggtggagggaagggcgtggtggcgacgacgacggcgccgacctgctcgtctgcttcccagcgaggcagcacctggcgctgatgcccaagccgatctgcagcccgtcgaggaccaccgtggacaaggcggtggccgcgcggcggtggcggcaacagcagctcccggcggcgcgctccggagcctccttgaacagggagccagatgtaccagtcgacgtacacgtgaggcctccttgaagggcgcgccgtacgcgccattaacgacgcactggacgaacacgtgaggcctcatgtcgcggttgttgttgagcaccacatctctggggctcgggctgtccctgtccatgaccacgctctcgtcctgcaggttgttcaagccgtggaggcagttcaccacgagcacctcttcttcttctcggtcaaggtggaggtcctcgcggcggaccgtctcctactttgcggcaatggcgcggaacttgaatggcacaccgaactggcgcgcgcgcgcagatgctcagccggcggcctgtctcctcgatctggtcggctggccggaagcccggctgcgggacgtcgatgccggtcatcctcacctccggtggtccgccttccctggttcccagcaaaaagaacaaagctggccactggaatccgtagctgaggccgtagtcgacgatgtgcagcttgcgcttcccggcgacggcgttgtagatggtcttgttggagaagatcagaagatgacgctcaccttcttgacgcagcaggccgccgtgaacagcttgtacgccttgaggaagtccaccgtcgatgtgcgcttcgcaacgagcgactggtacatctggctccccgttccggcgagacgcgcctcgagcgtgttctccaagtggctcatggtgctggaagggagcgaagagacacgacacgccggcctcatctccgccctctccggccagcaccagctgctgccgcgccaccgccgccgcccctccgcctgttcctcctgagcctggagccgccactcacccgccgccgccgccgccgttctgccgccgcgctcaccgcagtcgcactcacgaaccgccgctcgcccgccgcgccccgctcagccttccggacccctatgcgccaaagaaaaaagcaattaagaatatcagtgctgactaggattattgacctaacattttttttgtcacttacacgtgggccccacatatttattttttatttttttctaactaggatgccacgtcagcaaaaccgggcaaaaatactgccgagggacctccagtgaacggtttgtgagagtttaggggtacacatttcttttttttttttgaacgactcgcatgagacagtgcgaagttctattgatagagcaggaaaaaaatacaagattacaaccctgaagagtcgtaaccaggtaaaggaaaaaatataccaccacccacacgccgacatcgccaacacacacgaccaggagaaggttagcaccggatcggccgccgctaagcgtgaccgaccgccactagaccaacaaagggcaccgacgagattgcccctgcgaagccacgactgatgcaccgatgctccaccaccacacaagctttgccgacatgtgggacccctgcaccggcgtccctcgccggccagccttcgtgcgccgaagaccgcgccacacctaccggcagctcctcctcacacctaggtcgcctcctccaccgccggccgcgcctttctgcgccaagccggtctcctctaccggacgcgcctctcacgctaatccggcctccctccattggccgcgcctctcgcgccgagccagcctccgctgccattggctgcgcttctctgcgccaagccggtctccgacccctccaccaaacggtgccgcgctggtcggatgcggcagtctcccacgccctcggctagtcaaccgaggccgccatgcctccggtgaccgcgaacacagtcaccaccaccacagccgttgctgccgaacacccagccaccttgncgtcatcattcccaccttgcacccgactccttccccgccgccgacgttgccaccgtcttcagagtcacagtcgccgtcggcgttgtcaccgacgccaaccaccggcttcacaaaaccgtcactgtgccgtcgccctccaccatcaagcagcttggatgcccacgccatggcttccaccgccattgccagttgacacggcagccaccatgttgccgtcgacccactaccgccgccgcggccatcaccacacagccgccgtcgtcgccaactgccgccggcatccagatccggccgagaccgtcgccaactgccgccggccgtcatcgtcgtcgtcgccaactgccgccgccgtcgtcgccacactgtcgccgccgttgccaactgcctccaccctccagatctggctgagaggggcggatctggggggcaccgccgccgtcgccgccaggtttcgcgctgtcgccgccacgggagcaccaccgccgccttcgcgccatcggccaactctgtccccgacgccatcgccatccccgccgccttcagccaccgccgcccagcgtcgcgcgcccttagcatcgccgtcgccctccccgccgccttcagccaccgcagcccagcgtcgcgcgcccttagcatcgacgtcgccatccccgccgtcttcagccaccgccaccctcgccgccgccagccgccgtcccaccagatccagccggagcgggccggatctagcggtcaccgccgctctgcctagggcggccccctgcccgcccggaagagaggatgcgagaagccccgccgccgccgtccttgcggccggccggctttgccggcggcctctcgggcggcggccgctcgggtggcggcaaggtggagggggaggaggggagggagaggggcggccgggtcgccgcctcccgtgccgcccccagggaggacgacgcgagagcttctcaacagaagaactgaagatgggggtacatatttctgattttatggttaagagatcttagaaaaatctcgctgtcaaattaagggacctccggtgaacttattccaatggaattaccgtgaatttgttgcccatagcatagatttggtggtcgagcaacttatcgatgctgcgcgtgtgtctgctgcgtattcaacatggtatacgatcgatacatttccttcttattttttctcaaaaaatactaagatacattattgttctttcaaccttatattattggccttcatatgccgctagcctctcttttcaatggagacatgctagcatggtggacagcttgcaggagagagatggtgaaagaacagagaagaaattttgacggcctcttcatctacacagtttggggcatttggcttcaaagaaatgctagaatcttcaagggtgcttatggcacagtggtgcaagtcgttgagtcaataatcgacatgtgcaaggcctatgatggagctcacaatttagatgagtagttctcgcatcctcctgctagttgctctgcactatataaaaattcctgtcaactcctctgtcaacacctcggaaggggtccccatgggatcctttgtaaccgtacagactcggtttccctctcttctccttttatgaaataggcagagctcctgcttttacctaaaaaaaaaaaaaacttcaaccacaactgcagaagcataatacaagaaagatgcgtatgccaaatatttagtgatctcatttgatgatttaggctctattgtgctcctaggttagttattactcagaatttttactttcaacccaaccgcccccagtcccaattgcactactctcttatatatacaaaagtacatgaattaattaccagcagtactaagtaatgaactacattggcgcttacaacaaataaatcaacacaggactagctttcctgttttttttttcccctcaaacaaagaaatgttgtgtaataatcgcctcggcattcaaatctagtctttggtcagccacagccgctgctgatcctgatcctccaacaccaccatcagctttgtcatcgcgacctgcctccacggcagggtgttctatcacatcgggtttgatgagttcatctgcctggaccagctgggcggctgctggggctattgtgccatcgcaggaagcacggtcgtccaggacaagagcgctgtgagctgcacatagaccagaccttccccgagcaattctatcacacttgtcctcgccaccaccaacgcttgattcccctcctcgccatgagcacagagtatcatctgcacctcctgatccaccgtgcgtcttgcagaaatcggtgcttcgccttgtgctcttggtgcagcccagaaacttacatctcttgccggctccgtggcgtacacagtgtgcactcggcccccatgccatcttggtgcagcctggaaatgagcaggccattttcatgcgatgcttctcgcagagcatggtgactccgtctgcggttcctgtgcatcctggagacttgcaatttttacctgaactcacgtgagtgatggtggctccagagcgagattctgcactcctggacgacttcttatgggtctcagtctcaccctttttgccgcctccatgcttgctgcagaagtcagttttccggcgtgcaaaccggaaacaaccctcgtgcatgcagcggcgactaatatgagctaagcagaagtctgtgtgctcttcggcgctctttgtacagccaggatagtagcacctcttgcctccgccatgggccctgcagaagatggtttttcctccggctttctcctcgcagccttgtttcttgcatttcccgctaccacttgcacccgccacacttccaccactggattttacagtgttagctgcgagcatttctgaagcatcgcttactaccgaagcgcacagggaatgcgaggagctttccttctgatccgacccatctacacatcttggaaactgactggattctgcatcaactgcgcacttttcagggtttcttactcccaataacaacgaaagtgaagagctttctttctgatccgacacatctatacatcctgggaactggttggattctgtatcaactacgcactttccggggtttcttactcccaataacaacgaaagtgaagagctttccgtctgatccgacacatctatacatcctgggaactgactggattctgtatcaactgcgcactttccagggtttcttactcccaaggacaatgaaagtgaagagttttctttctgatccgacacatctatacatcctgggaactgactggattctgtatcaactgcgcactttccagggtttcttactcccaaggacaatgaaagtgaagagttttctttctgatccgacacatctatacatcctgggaactgactggattctgtatcaactgcgcactttccagggtttcttactcccaaggacaatgaaagtgaagagttttctttctgatccgacacatctacacatcccgggaactgactaaattctgttttagtaaatatgaacttttcaaggctacttactcctggagcagacaaggaaagtgaagagctttctgtctgatccaaaatttggggttcccagttactgcaaagcatcaagaaattaatcttcaatcaaaagttaaagcacgatataaataaaactttacaggagacaataaaagagaggtaattaataaggctttgcacttaattcatctttagataaccgagtcaattattttatagttgacttaagtgtataacccaaatggcaaatgacatttgcaaacgaaaagtaatttgtgaataaaatttttatatacatgttcttagcgatctaaaagcaaaggttgaaaaataaacttcgataaaaaaaatcccaaaatcagctccaaatttaaggttaaaaattggtttattgtgcaattagtttcactgaaacagtctttcagccgaggaatagcatgagcttccaggataagctatatgtgttataatttgacagtcataaacaggagagtccatctgatgacttctagcttctcttgctaacttgtcagacaaacatttcacttctcttgggatccaaacaactcttcaagatttctgcaaaattaaatctcgcatttgacttacgattggtctaagactctaggatcttcttgaggatttatagttcttgcatatacaaggccactctcaacgttccataataccatagaaattaataatcttgttattgtatcagaaatctttcttcatactaatttgaagctctcatatagaagtgtccacattattattatcctactccatacattttttttactccctccttccaaaagtctaagtcctatttcattctttggttttccaaaagtctaagtcctatttgtaggcactatgtgctatattaattttttttatcgaaactcaagaagtcattttagtacttattggttgcatgttcattggttttgtcacataatgaatgagtagacgagaaattacctagcatttccttcattaagagaagaagtaagcaattctcacattaatataaataaaatcatatgcatccttatattctatggccaaaatattcaccacacaacaattactgaattcaaaataaataaatgctatttagttgtaattggctttagagtctttactttattttttgatgatttcataattcaaaatctgaattaatacgtaccaaattatttatactccatttggagttcgaattaaatcattatctttatttaataaatctaaatttaggaattaataaaatttagtactcccttaggttccataattgttgatgttttgaacaataatatggttttcaaaacatatcttaactataattttctattataatatatgcaataaataaataaatacttacttttattatagtaccttttaagaccaatttatacatgttattctattatctccaaacttaatattttgagacttattgatagccaaagttctaaagtttgaccataaccttgtctaaaacgtcaagaattatgaaaccagagggaacagtaaattaataaattttgaaatacatagtctcagtatcaattagtttttcagcgaattaataattgtaaaattcaaatatagtaatgccaagtagtgctcagtttgaaatctcaattataatatttccatgatttagtaaattataaaataaaaattaataaataccaagttggcttataatatttccacgatttagtaaattataaaataaaaattaataaataccaagttggctagagcttttcacttgcacgtgaaacggggcaagacattagtgtatcactatttgagtattaactattacaaaattaaaagattaatttatttgattttttaaagaaacttttataagtaaactaggaaggaagtcagtgcagatgcacgggcaattcattttttgtttcgatgacatgcgcctaatttgaatacaattcaaaatagcatatatttttacaacttaaagcatagttaatatgttttttgattattagtttggttttccatctaatctaaatgagaagaaaaaaaaaaaggatgtaggacccgacgcgtgtatgtaccgtaaatacatacattttttcttaaggtggaatacctacgtatctacatgcatgtatattgtccggtagtggcatgacgacgtgagatgttcggatgtttttttttcttataatttctatgattaactagagcgccacatagaggtttagaagcgtttatagggtactatgtgatggattagaagcgtttgtaggaagtttatcctcttgattactttttctccctttttctctttatgaaaatatttgcaacaataaattttaaataaccacaaccttctaaattatgtatatttatttgtaacaatatattttagatcatcataatttttacttttaaatcatatatattttagatcatcataatttttacttttaaatcatgcgttcatttcttttatctatttggacaattagaatttatgacgtatgttttctacttcactcgtaaaatgtatattcttctaagttctatttattatcctttgcatgtcattcaaacatatatgaaaaattataaaaagaaagtgactatgtattatgtcatcctgtaccacttcacaggcattccttaataaaatagaaagtgatatattgttagatcgactttttaaagcctcaccaataagaagaatgcctgtgtgctaaaaacatatattttttcctgtagtgcaactgaaatcatatatgtttacatcatgtattttttattctacattttttaccatatttgtggatgaataaattttgtttttctacaatagaaaacactattttaaaacccatctattttttctacccacgtacatatatttttctgatcttatagcttttcttttttacttgcatatataagtccgtattttttttaaagtaaacagtaccttttaatagttttctatcgtacatacgtacgtttttttaaatgaacagtaccaaaagttttttttttcaactgtgcgtacgtacgtcagatttttccttctttttccattgtgcgtaggtaactaggattttctggtataaacagttcactcgtatacacatgatatgatatcaagaggaagcaaagagatctaacctaatggtctagataatgggttcaccaatttaaatgaaaatcgacggtgagattataaatgccacgtggcaacctaagagcgtttataggaacaccacgtggcggtttagaagcgtttgtaggaagattaatggacatttagtatataatagatagatagatgtactgtttagcggcctgaaaacatgctcgctaaaaatgagggagtaggtaagcccttaagctattcagaactatgccttagttgttcaactttgcagtacatgcagatgaatgttggacttggatgtttaatagataataatgtgttaaaaattaaagaaaggttgagtaagcaattgtgttgcacgagatattgctcaaacgcagaacataagaacatagatatatattgtgaccctgcttgagggagctagagattattgatccttagagtagatgcgggcatgcggctagtaaaatttcagctccctcaagcagtggaaatgctctctagattatgtgaccaagtagttgtagaattcataaatgaactagcagacagaagctagattactcacaaggtgcttgtcagcaacaactcctcaccagagcgcctatattaagggaatgcaatgtcaacacaatttataagaaaaaaaattaattatgagaaggaagaagaaatgtcatcaacaccgaaaacaatgctaagaaaaatgagtaattgtgaaaaacgaaagaaagtgagaggtaggaccccactaattcacagtaagcaataataataagaatgttaatagaatcaatttagatcgttcatattttataatctaatacatcatatctatctatgctatcgcctcaactattggttgcaaaataaaattttctattaacagtagaaattataaatcaactattaagattatttttgctgatgataatattaataatagagtactactaccagtagggaccaccgtaaactttatactatgtattttgcacgccagatcggatttaaacgcattcagtaatatctctaccttttaataggttgaaaaaagaagtatgaacaggaaataattatttctataggttgaaaaaagaagtaggaacaggaaataattatttctctattactgaatgttctattagagaaaagaaaaagacccttactcttcatcaacaccaccaactcttcgtatattg

SEQ ID NO: 74531 - DNA, 3789 bp, Oryza sativa
cctgcagcccatcatacttgcataccaaagttgatttagcctttcctacaacaatagaagcataaaagtgaataatactagataggggaacaaaacaaacagtccatatacttatacatatcaatatcaggtaggagtgcatctccagtttattgttcaatgtggcatacttgaattcaagcattcaccaactagcccatttgtataaattgttctgctccgcagtccatagagaacactttcgttgaacaaaatcagcaacaagtgtggttcgttttttcagatctttctccagtaactaacacaagctatgatgcagccagtggaaaaccagatttgtcaggcctcaggtgtgatcattatacatgtgatcaaatgctaactgcttcatccatataaccattcagctatatccagtcaatactagcatgctgctacagaaaaggacaaagcaatttcttaaacgcctatatgccaggtttttttgtgtccatgctcaaagttcaacaagttactttggcatatcgatgctaacccattacatgccaaaggaatggaaactataggtttaaacatcatcacaggaatatgaaggataatgcgaccatcaacacaagaataacaccactaatcaaactattttatccacagtgcgtttagctacaatttccaatatcaacaactagacaactcgcaatgcatgaacaactgaatatgtgataaaataatgatgtatgagtgactggccacaaccgacaacaccaaaaacagatgaaactatttgaaattataaggatacaacataataaaataggaggatgcttgcttctatggttttcagcctgcacctctgtcttatgcaacataaaaaagctaatgtaagtacaataactgaacagcaaaacttgcaaatcagatttttttttccagtactgaatgtaccggctaccaggattttcctttcctggacatcatatttatggcacatggttacatacttacatgttcattcatattaatcataactagccaacaaaccaagacaaccctatactaactcaggtcccaagagattctcaaattacaccctaattaacctgccaatctcgatattctaatgcattcaaacaagaaacaaatgctatgcattggaaaatgcactaaatgactgaattagtgaaatctctaaatacaggctgggagggggaaggcaccacacggtgttgagcatatcctcacaaatttctaaagccacaaagctaaaacccaaccaacagttgacaaagataacaagaggggaaattggggacaccaatgaatacaacacaatttgccaggggtcattacaaacatgaaacatcataaaataatctagacccattttgtagctaacagtaccagcaaatatccagtcatcaatgtctagttgattgacccacaacttacattggaaccaaagaatgtagaattacaggagcgcacaattaatcctcctaattacgtcgccagtaatcagtcagcatgcgagaattcatcatatccctctattcgacaaatgatgaggacacgaatgactacaacaccagaaagaatcatcctaatcaattggccaaagcggaacatttgatacccaaataaaggccgcccaattcatgattcctagtcaaaattaagcgtacctagtcctcaattctcaatccacaacactatttgatcaaccaagaaccttacctagcatcaaaggaagggccaaacaagaactgaaaaattgaaattaccagaggcacggtgtctagttgtagtagagctcgaggcccatcccgtcgtggatctcgtagtccctgagggtgatgtggtccttgtagatgttgtaccacttctggatgcggatcttctcgggcctcgtcccggtctgcgccgccaccagcttcttgaggtcgccgatggtgtcgtcctcgttgcacttcacccgcaccttcttccccagccggtcgttcagcaccacctcgatcatcttctcctcctcctcctcctcctcgaactctctcctgctccctcctcccgaagatcacgcaaaccctagctcagtcctggccacggcgagacttggtgttggaagcggcaagggagaggagaatcgtgtggcctcgcctgctcgccccgctctcggtggaggagcagaagaatcgagaaggagatgagggagcaccggagcagtagcagtgtagcacgaatttttttcatttttagattttttttaatatttacagaaataatctatcggccaaaaaaaatacaaaaatagaccctgccgccccagtggtgggcggcaagctgacgtggcagacggcgggtcgaccgtgccgtctgccgccgtcggccaaaattgcaattcccccagagggcggcaaggggctaattgcaatttttgccgcccataaagaggttgcgctcgtactttttgcatttgggccccttgctgccccagtagagggcggcaagggacccagatgcaaaaagtacggccaaacgatttttctattttatgttaataataaataaagaagtatttattggtaaaacttgttaatattgttataaaaatgtattgaagttggttgtttcgcaatttcatatgttaaggaaggtattattttgtaacttattcgacgtattagtactcggataattaataggcctatcgcagtctcggttgtagaaacattatatggacttaaacaaggagaattatgtaacatgaagaaatagtagtacaatttgaacatgatacaactatttccattgcggttacatatatgatattagatttgaactaggagggaggtagtgcaatagttgaacacaacgacgatgtagtaatgggacaaggaagcatgacagtagaaatttcaatatgccaagttgtccgataatagctaacccctacgtgagtatccctctcctctctcaaaacgcgctttagtaaccctgtattgctctggtagttcaagctacacaacacggcaaggtggagttagaacccttctggtgtctatccattctttgtattgacatctccttggtggttcctaggaggaaagaatagatgtaaagcgagcaaagttagtaaatattgtgagaaaataaggattcatgtaatcaaaatattcttaccatgaaatcgtcgtcaagaatatttggacaaacaaagaaccttcgacccaatgttgtaggctttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgaaaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgctaggcagagaggacgctggcaccaatgtggtagtaggtatacacaagaatcgctacgccagtttcggatcctcaacaccccggggtctaacctttgacgaaagccggttggatttgtaatgaagcaagt

SEQ ID NO: 74532 - DNA, 598 bp, Oryza sativa
ccgattgatttatcgtttgtgttgatgtcgattctcctccactttattgtcattctctgcaaaatggttagtaaacctaatactagtggaatattattgttctatcatatttatgcattggaagcatcactagttctctcctattttagtaatattgacggtcgaaactgattgataacgaccgtcaacagccacttcaacgagtactgcgccgagctcggactgcgtcgagaactcacggcgccgtattcgccacagcagaacggcgtcgtcgagcaccggaatcaatcggtggtgggcacgacgaggagcatgttaaaggcaaaagggctcccaggtatgttctggggagaggcagtaaatacggcagtctatttgctgaataggtcgtcgtcgaagagcattggcggaaaaactccatacgagctatggaacggcggtgcgccggcggttcatcatcttcgtacatttgggtgtgtgggacatgtgaagaacaccatgccaaatgtgaagaaactcgatgacaggaggtaacacatgattttcgtgggctacaagctaggatcaaaggcgtaccgggcctaccaccccgtgacgc

SEQ ID NO: 74533 - DNA, 19751 bp, Oryza sativa
cggcaaccgacggacgggattcggggtgccctaagaaaggagaagagagagattagagggagggagatgaaccacggcgaccggcatttatggccgaagtcagcggtataggtttaactcaccggagcacgaggggatgcgaattccggcgatgaatccggacggggaaggggtggccggggtggagcttagcctcgcaaacccgacggtgccgacggcgcggtgcggcggcgaccctagcggcggctagcggcggcgggagtagcggaaacggcagcaacgggtggttgcacggcgcgggagcgatggggagcacgagggagttcggcgagatggggaaaaagcgagagggggcgacggggaagcttaaataggggaggggagtcccggacgtggccggtaggggcgagattttgctggccaacgtggggagtgggggaggagagagaggcgggattcgaaaattgaatcccggccttctcgggcgcgggcgcgagcgcgagagagggggaagtgggtgcgggagatgcggcgcacgcgcgggcgtggccgacgcggcccggagaaggcggaggcgtgggcgtggcggaggttgcgggcgcggcggcgccggctaaaggaaggagacgggcccgacaggtggggcccacctgtcggcgtcccgaggagagagggaggggcggcttgggctggcccacaaggaggagggcgcgcgcgcggcggggtggactgggccgacggcccaagaagaggaaaaggagggaaaaggaaaaagaaaaggaggaaaagaatttccctgggatttaaaatattgcatgctcgattttaattggttaaaattatttcgagagctctgaaaattccactaaaaatcttgttagtgaatttcgacatgtagaactcaagaaaaattccacatgccaattccgattattatttgcattgatttaatagggttaactcttgctttgcaccggtattttcttagggtctcttattaattcgattttaggctaaggaggagaactcagggtgtgacaaacctaccccccttaaacggaatctcggccccgagattcggaggagctggcgaagaggtgcggatgggcggctttcaactcatcttccctttcccaggttgcttcctcttctgaatggtgactccactgaactcggcaaaacctggtgaccttgtttctggttcttctttcgctggtatcaagtatacgaatcagcttctccacatatgtcaggtcctcctggatatcaatgtgttccgaatcagcctgttcttcaagtactcttaagcacttctttaattgggacacgtggaatacatcatggatgccgatcatattggatggaagttctaactgataagcaacttctccccttcgttccaagattttgtagggtcccacgaaacatggtgccaacttgcctttggtttgaaaacggtgcactccccggagcggagtaacccaaagatacacataatcccctgcttcaaaagtgagctctcttcggcggttatccgcgtagctcttctgtcgagactgggcaattctcaacctttccctgatggttctgactttctcttctgcttccgttaatacctctgtcccgaacaattgacgctcgcctgtctgatcccagaagagaggtgtgtggcacttccggccgtataaagcttcgaacggtgccatctgtagactggcttggtagctgttgttgtacgagaattccgcatatggcaaacatctgtcccaagctccaccaaagtcaagagcgcaagctctcaacatgtcttccaaaatttgattgactcgctcggtctgaccatctgtctacggatggtaggcggtactgaaatttaaacgggtccccaattcttcttgcagtttctgccaaaattttgaggtgaactgactacctcggtcagatactatcttcttgggtaccccatgcaaacacatgatccttgcgaggtacaattctgccaatctctttcccgtataggtggtatgtactggtataaagtgagccaccttggtgagtcgatccacgactacccagattgaatcgtgacccgatgatgtccggggcagtcctgttataaagtccattccaatttcctcccatttctattccgggatttgaagaggttagagtaagcctgctggcctttgatgctctgccttcactcgctggcaaacatcgcagagtgcgacgaattcggctatttcccttctcatgctgacccaccaaaatttttctttaaggtcttggtacatcttggtgctgcctgggtgaatgtaatactgtgtctgatgggcctcggtgagtaccagatccttcagctccttgttgtcaggtacacacaatctttcccccatccagattgtgccatgctcatcctcaaggaaatcccgagcctttccgactctcatgttctttttcagctctgctatttccggatcatttacttgagtggctctaacttgatcgacgagcgtaggccgtgcttccagagcggctacgaacccgtgttcaacaattcccacgttgagatgctccaactcctgccgcaattcctcacacatgccctcgatgcatagagcagtgcagtaacttttcctgcttaatgcgtctgccaccacattggctttccccgggtggtagtgaatgctcatatcatagtctttgattaattccaaccatcttcgttgtaggagatttaggtccggttgggtgaagatgtatttcagactcttgtgatccgtatatacttcacaacggttgccaatcaaatagtgcctccagatcttcaaggcatgaaccactgctgccagttccagatcatgggttggataattcccttcgtgtggacgcagctgtcgtgaggcatacgccaccactctgccttcctgcattagaacacacccaagcccgtggcgggatgtgtcgcaatagacttggaagtctttcatctggttgggcagaatcaaaactggtgcggatactaatttcttcttgagctcctcaaagctcttatcgcactcagctgtccatttgaacttctcatctttcttaagcaactgagtcatgggtcgggcgatcctagagaagttctcgatgaaacggcggtaataacccgcaagtccaagaaaacttcgaatctgcgacacggtcttcggtggggtccatttggtaaccgactccatgttggatgggtcgacggccacaccctgagctgtaataacatggcccagaaatttgacttccgtcaaccagaagtcacacttgctgaacttggcgtataactggtgctccttcaacttctcgagtaccagacggagatgatgctcatgttcttcttcggactttgagtagataagtatgtcgtcgatgaataccacaacaaacttgtccagaaactccatgaacactttgttcattagattcatgaagaatgcgggtgcgttggtaagtccaaaagacataaccgtgcactcatacagcccgtaccgagtggtgaaagccgtctttggaatatcctcttcccggattcttaactggtggtagcctgatcgcaggtctatcttagagaacaccttagctcccttcagttgatcaaacaaatcatcgatccgcggtaaaggatatttattcttgattgtgacctcattgagtgcgcgataatcaacgcacatcctcttcgtcttatcctttttctccacaaaaatgaccggagcaccccaaggtgaagtacttggtcgtatgtaccctttctgcagctgctcatcaacctgcttcttgacctttgctagttcgttggccgccatcctgtacggtctcttgtaaattggtgcggttcccggtgccaaatcaatccggaattcaatctctcgcttgggtggcatggtagtgaggtcttcgggaaacacttctggttactcgcaaactatgggaatctcttccaatttcctcgaactcttctccttagtgaccactgggatttccgcctcaatctgattcaaggagaccccttgctttggtgagactaatgatttgtacactacggtttctcccttctcgttggtcaaagtgactgtgcgattcgcacaatcaatgactcccttgaacttggtcagccaatccatccccagaatgacatctaggtctttggaatcaagaagaatgaggttggctaggaatggtgatttttgaatttctattgttatagaagggctgaattgtaccgaagtggagctattccctggggtatgaacccgcatgggtgtgctaagttcctctcttattaacccatgcaccccgacaaacttctttgaaatgaacgaatgcgttgcaccagaatcaaaaagtactgttgcagggattgagttaacaggaaacgtacccagtacgacctctggtgctgcttgtgcctcctctgcggacgcatggttgacgcgagcctggacaaaccttggcccggtatgcctgggcttcgggcatttgtcagcgaagtggccaagctcgccacagttgaagcaggaccctggttttgtgccagtctccttcttggcttgcgcggacggggctgactgtgttggtgccattggtgggcgtggagctgcaccgcggttgggctgacctccatggtgctgactgccactggcgccctggtggaagttgcttgagttgaacgggcggtgctgcggacgatcatggtggtaggtccaccctgctatccgggagtgaagcgcggtcggtgctgactaccttggttggaccggagctgcgccgcctttctcttcccgtccattttgttgcgctgatcctcctgacggattgccttgtcaaccagcctttcaaaatcagcgtagtccccagatatcagttggttggtcagctcgtcatccagacctgccatgaacttttcctgtttctcggcgtcagtgcggacatcctccagtgcatatcgcgcgagacgattgaactcgtgaagatactcggtcactgtcctgttgccctgatggagtgcccggaattccctcttcttttgtgccacgaccccgtctggcacctgcgccttcctgaagctacgacagaactccgcccaagtgacttcagtgcctagcgggcgggtggccatgtgattgtcccaccaagctgacgcgggaccttgaagctggtgtgtggcgaaagcgaccttctcctgatcattgcactgcaggagattcaacttcttctctatggcatggagccagtcattcgcctccatggggttggtgatgctggagaaggtaggtggcctgacgcgtagaaactctggcaacttggactgagggggagggggaccaaactgctggtgctgttgttcggcatgctgcagcatcctctgatgcatctgctggtgctgctgctgcatttgctgcatcatggctgccatcatctgagtctgatgtgccataacttgggccagtgtcggattctcgggaagtggtggcggaccattgccggaatcactgttggggtgcacaccatcagcgcgttcttcgccgttgctgccctcgccagtcgtgcgggtgccagttctggtgtagaccatctggaggaagggcagacggggaaacggagaaaaacagatgctcaggaactaagctttattatatagaaatttaaactgcaattgttctgatctgaattaaaacactttaaacagcaagcaaaaatccttattgggacagccatatcataggcacatgatatcgaccatcgactgaccccaagcaagcaacctaaacacacaaactaacaagcagaaactagacagtcgataagctaatggaaaacgagcctaatgctcggaacggctcctgcggtcggtggagtcgaaggcgtcctcctgctcatcaccaggtccctctgagcgactcctagagcctggcagataagtctcgccgctgcctggctctgagccactggagctgctgctgctgcggtcacggctgccactgggagtagctggcaaccaacctccgttgccactggcggggcccctgacggctgatgcaggtgcgaaggagagcgcggatgctagagctgacatgggaacgggagctggagctggcgctggagctgcaggaactgctggagctgcgggtggaactggaggagctgctgacggaggtgggttcctgggcgcaagctggacgtgcacgggtgccgttgtcgacttgcgaggcgtagtgcggatccggactccccttggcgcgggaagacccttcaactgagcattctccctcttcaggcgcgctatctcgtccttcagagcgacgatcctcatgagcttcccatcattcaaggccttggacgccttgtgcaggtccgagtgcatcctgtccatccccctcatcacagcgcacatgtgaccgaaggtggtgtcgttctcaccggctgtcggacggaaagaactgacatcgctgccgctggctcgacgagggtggaagcggtacgccgtgtcgtggaagatgtagttgtggcgctcccatagtctggccatcatcaggtaggctgcctcctgacatgcgtgatctgctgtgcctcctgacgcctcaaccgccatgttagcgaggcaagtccccacgtagccatggacctccaagcggacacggtgaggaagctcgccactgagcggtggaatagtcgtgtactccggtgcgttggggtagcccaccaccagtgtcatgcgtgccaactctgccacgaagtcatccatgccttctccgtggtggttgggtgggtgctcggccatctggagaagacaaaggggtaggatcaatgcatgctcaaatccaaattaaataaagcaataaaggactcaaataacagaatcgaataagagcgaaattttatgcatagatcattttgcatgagagcgaataaataagacggacttacatagaggtaaaataatggggaaattagatacatacttataataacaataaaagcataaataccttacaacccatattcctgagctaaaacctagtgcattcgcccatcaaatcccaactgacggtcaaaaacatctcaaataatttttactaaaaccctagaccgacttgttttgacaaatctcacttaaacgagcgacacgatttttcccttgaaccacaagaacagatcccaaattttcccggaacaattccaattgcaaagaacttatgcaatgaaaaggattcagagggctcttaggtttccatttggcttgtcctacggtcaaggtcggctctgataccaacttgtcacgcccagaaattcccaaatagaattccaagcagaatgtgcattaaaacccccgtccaggaccggccggggtacacaaacgacaatgttgacatacagatccacgtcttacaaacattataaaagtcttacataaatgcagcgaaaaaacaaaagataaccggagctaatccttgacttgaactgcagcgggaacaccactccacaggcatcctcgacggcacggacgaagcctactcctcggagaatccgccatcggatacacactcgacattgtcgttcataagccgcttttctctgtaagtattgctcagtactttcggatgcaaaataccagtgaccttcttgtaaacaagtggttaggtcgaaaacgggattttctttatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgtcttcctcgaatatcaggattcctcgaagccattagttggcatcgatcaccgcataggcagagaggacgctggcaccaatgtggtagtaggtatacacaagaatcgctacgctagttcggatcctcaacaccccgacgtctagccattgacgaaagccggtaggatttgtaatgaagcaagtggggaagagagtactgaatgtgactgagttctgaaagactgtgaggcctcactcgttaaggtgacttatataggcgcaaaaaatcgagtgatatccctgacatgtgaacgtggcggggcatggtgggtacgcctgatcggcgccgaaagttacattggtcgtatgcggcaaatggcgggcaaatactcgtatcgcacgcgaataaaagaggctgcatcggtgcggcagaaagtagtcgtgcatgcgccgaaaggtatcgtgcacatataatgtcacgcccagaaattcccgaatagaattccaagcagaatgtgcattaaaacccccgtccaggaccggccggggtacacaaacgacaatgttgacatacagatccacgtcttacaaacattataaaagtcttacataaatgcagcggaaaaacaaaagataaccggagctaatccttgacttgaactgtagcgggaacaccactccacaggcatcctcgacggcacggacgaagcctactcctcggagaacccgccatcggatacacactcgagctctgggattgggggaaaatagagcaaggctgagtactatccactgtactcagcaagtcataccggaaaggggggtatgatgcagggattcaacaagggatagctaaacaggttcatttgcataaatactggcatttataaacaggaattgaatgcgaaaacagttgtaataattaagcagtattaatcatccactgtccaacgttacaccacgttgcaacaggcccaaccatccacctataccatccaatttcattagactaaactaaggtgagtctaatcacggtgagtctggttgaccgcccataaccgcgggcacggctattcgaatagttttactctgatcagaggtgtacaactgtacccacaagacacagccccacgacacgtttccgtgcgtcgacatgccaccacgacataccggaaagaggccgtgacaggacccttcgcataaccccctctagccaagcacaccacacctcaggtttcacccccgttcccagcgggcaacgggcagtcccctctcgtgcctagatgaatctggaagcgacagaggccgtcgcagggcccgccccgctccatcacgcccacccttgcctggatgcgtcagctagagaaaagctacactacaagcccagccgttgcccacgctggcttgtggtaagtacgataagttcttccagggtttcccgcgaaccggtccttaattgccatgggcgcgactagcaaaaccatgcacccacagcccaccatgtgattcattttatttaaccaacaccagagcggtggtactaatccaacattatcatataaacctatagtctaggttttaaatgagatttccccattgtgtgctagttgaactaagcatggctaagcaattcctagtccaaagtctaatcatgttataacccaagctaacaaaggagcatggtatccaaaaagcatggctgtaacaataggtaatcatcccatagtataattgcaaaacaaatgcggtatttgaaagaaaacattaggacatttgcaatataggatcaacatgatcaagtgacaagcatgacttgccttgctctgctgctggaggaacctcggcgactatttcaaaatacaccggagcgtcggaagagccggaatctagcgacatacaaggcaaacaatgcaaacaggctataagactactgaaacagagaacaaaaccatttttaatggattctacacatttttcttgatttactgagacttgaatgggcttaaacggagctcggatgaattagttatgaattttagaagattcactgtgtttattactataacaaaaatccttaaataatttattgcgcaatattttccagggctgacgtcagcacggggggaggcgcggcgccgacaggcgggccccactggtcagcgactcaagggggggcggttcaccgtggaccgggaccacacgggtggtccaccgccggtccacgggaccgatggcccagatcgccctcggggccgatcggacgggcggcgataaaggcggccgccgggctcggctcggcatcaaagccaaccggccggccagggctagcggcgacgcacgcggccgacggcggcggcgaccggcggcacgggaggcggcggcaaccgacggacgggattcggggtgccctaagaaaggagaagagagagattagagggagggagatgaaccacggcgaccggcatttatggccgaaggcagcggtagaggttgaactcaccggagcacgaggggatgcgaattccggcgatgaatccggacggggaaggggtggccggggtggagcttagcctcgcaaacccgacggtggcgacggcgcggtgcggcggcgaccctagcggcggctagcggcggcgggagtagcggaaacggcagcaacgggtggttgcacggcgcgggagcgatggggagcacgagggagttcggcgagatggggaaaaagcgagaggggccgacggggaagcttaaataggggaggggagtcccggacgtggccggtaggggcgagattttgccggccaacgtggggagtgggggaggagagagaggcgggattcgaaaatcgaatcccggccatctcgggcgcgggcgcgagcgctagagagggggaagtgggtgcgggagatgcggcgcacgcgcgggcgtggccaacgcggcccggagaaggtggaggcgtgggcgcggtggcggttgcgggcgcggcggcgccagctggaggaaggagacgggcccgacaggtggggcccacctgtcggcgtcccggggagagagggaggggcggcttgggccggcccacaaggaggagggcgcgcgcgcggcggggtggactgggccgacggcccaaggagaggaaaaggagggaaaaggaaaaagaaaaggaggaaaagaatttccctgggatttaaaatattgcatgctcgattttaattggttaaaattatttcgagagctctgaaaattccactaaaaatcttgttagtgaatttcgacatgtagaactcaagaaaaattccacatgccaattccgattattatttgcattgatttaatagggttaactcttgcgttgcaccggtattttcttagggtctcttattaattcgattttaggctaaggaggagaacttcagggtgtgacatataacaacaacgtagtcattacacaagcatacagtactggaaagtgaagcaaataaacaaagagaagactgctctactggccctgccccgcgccgcgaccacgcttggtcctccgggcatgtgctcgcacgtggtcctgggagcaggtgaaacgatccggtggcacagcacgggtagcacgagagggaagaactgcctggaaccgatccctaaaatacctacatgtcccatgtaaaatgaactccactatgccaactagtggcagtccacggacacccagttgtaaacttctgccaaatttgttgtcattattccatatctagcaccacctgtgtcatacgccttggcccatttctcttttggttcatgcagaatccattgaaaaaatttccgaatctccaatccagttcttctaaccaatgttggactatccgttgggagaggtccaagagcttgaggagggtcagcatcggcggtcgatggagccgctgcacgctgatcactgcatttggctgtcaactcatcgaatctcttccaaagctcattgaattttttctcctggttctgattgcatagcctcttaaacatgttcataagctccttgttcttgaattgcttgaagaaattagctcccatatgacgcatgcaccacctgctctgtacatcttcccactcaccagggtatcctcattccatactcccaaactgcaactcttctatcgctcgcagaatgccagcgtgcctatcatgtatcaggcacacatttggcctcataccaacaactattgttttaaccaatttcaggaaccaataccagctgtcggtattctcactctcaacaaaagcaaatgccaagggcaatacctgattgttcccatctacccctattgctgttagtatctggccccgatactttcctgtcatgaatgtcccatcaatgcagagaacaggacgatagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcagattattgacattggtttatatgtgagattatcgatgacatgcgcatacatctcagatgcaacaaatgcacatgtaatgttcctgtggtatttctgaacactaggtagaaaacatgtatgcttggtaacgactgacaatgttcaataatccttccatttccccttgtacgcgtgcattctccagggacaaccatctttttccttaacacaccgaacttcatattgcgaccggttggacttggcaacccaaaactctctatgaagtgacactgcaaaatgttttaccgcctccttcatatcttctgctctactataaatcgctccctgaataacctcattttctttgtactcccatctcacactatcctcttcagagacgactagcccagaaaaatcctcactagcccattctgttggattaatatccgtctcatcatctgacaaatcaccttcctctacacgctcgttgtcagaatccttcctctccatttcatccacaatggcaccgacagtctccccctcgtcggccactccacctggttgaatgcccactggagctactacacccctgtcctctcgtgcgttgacctcctccacagaagtctcatttacttcagcacttggtccctcaccatcatccatgttcatctgcacacatggatccttcgggtgaacaaacgaaaccatagctagaggccacccgcgttgcaatgcattttccacataccatctccacactcgagagttttgaactggcattagttcccaataaaaaccctcagctgcccgacttactataacattgattgttatgtcacttgtctgtagatcaactctcaagcccctcattaaccatccttttatagaaggtacactctcctcagccggtctatcaattcccctttctgatacaataaaatctgacagatctacccagttggcccgtaacggacgtttcctgggccatggtaaacttggaatatttgtttgttcgacatatctgtcaacgaaataactagatcatattactctttcatgcaataaacatctacaacgtaatatcttcttgtgtatgccaatgcaacggtaaagtattgattccaaactagcagatctacatagttaccgatatctacaatacgcacttctagattagtacaactaaaaccctaaaaatataatgcatttattcaaacaaagttttaaaaaatacacactatttaactcaatagtcacatataggatctatgaatattacctgaaatcggcgtctgaatccggcagggcttcgccccttcttctcttctcctcccctttcttctttttttttcactagatttgagggggaggaatgagggctgggggctgggcagcaggccttttataggcagcgaggcttgccgcccgaccagagggcggcaaggggccgcctgcaaaatggtcggccccgactggcttttttgcattcgggccccttgctgccccaacagagggcggcaagggctttactgcaaaaaaccctccctccgtcaccgtccgtccctcccccgttcgccacatcagcttgccgccccagaggtgggcggcagggtctatttttgcaatttttttggccgatagattatttctgtaattttttttaaaaaaaaaatctaaaaatgaaaaaaattcagtgtagcactgctagattgtgatggccgatgggctgtatgggccttgtctacttaatggactatagtagacagttctgaataagttcacttgacgttcctcatttttccgtcgagtttatatggaatccctaaattgcaatatcgaaaatcttggaataagttcactttgactctctgttcgtatcttattggtatctctcaaccataataccggatatctcaacctcctaactattaaaattggtgtaatttgactcactcagcggttttggagggcgctttcccttatgtggcacctacgtgaagtttatactttttaattctaataatgccacgtaagcgtcacatcaacgtcatgtgaaacgaagaccaagtaacaccgccatgtaaccaccacatgagctaaacaaacgggatgcgaaggcacatagtcggattggggatttagggtggatccgagtcggaaccaacagactgcgagaggcgctcgcaccagaagcgcgaggcggcgcgggccggggaacggccacgttcaggcagcggggccaggggggacacgacgctgcccatggagcaagtcggcgcgcccatgaagcagcggtgcaactgttgcagcgctcgccacggggacggtttaggttgtgttcttaagggtgtgtttggttgcaagccacactttgccacagtttgccacgcctaaggttaggcaaatttgacaggtgtttggttgtagccatagttgtagcaagattcccctccaataaattgggtcccacgtgtcaatggctcaaaaaagtgtggcaagattctcttaggcttagtaagttgtggctaacaatttgatcacctcaccttaggcaagatgtggcaacttttgttggcaagtaatggtaaagtgtggctgggaaccaaaaagcccctaagtccatgatcccaacctcactctctcgtttaccgcgcgcacgcttttcaaactgctaaacggtgcgtgttttgtaaaaaaaaatttatagaaaagttgttttaaaaaataatattaattcatttttaaagtttttaagctaataattaattatccacgcattaatcaaaaatgcttctatccggacgtccgatcgaacataaaaaaatcggatgcctgcgcgcatgtccttaaaccgtgtaataagattaataatagtgcccatcgcaatccctcatcattctccctctcatatttatattgcgtaggcatttttctcttgaagtagcctatgtaactgctctgacataaagtagcccatattctctctctcgtatgcctctaccgctttgacataaagtagtctatattctctctcgtatgcctctactaccacacatgcttctactccttaatgaataactccaaataatcttatttcacaaattatttatctaatccgtaatctaaatataccattgtattcaccgcaattaaatcttcataacaagatctcacttaactatattttggtaattttttaaaaaagtttttttgttgtaatggattttttagttgttgcaataggtatttaataacgtttcaataggtcatttgggaatgttgcacgaggtgtttttttatgtttcaagaggtattttgtgatgtcttcgattgatgtttcactgtatcattttttaatgttgcacgtggtgttctttaaatgttacatgaggtattttgtgatgtttcagctaatattttactaggtcattttaaagtgtttcacatggtattattttgatgttataccaggtactttctgatgtttcattaggtattttgtggtgtttcagcagttacaactcattgttttcatatataatataaaaatgtttcagttatgaatgtaattaaaaatatataatttattaaaaatataattatgtgggatctctttgaaaagatttaattgcaacgaattcaatggggcaatcagattaaaaatcggataaataatttgtaagaaaaataatttatagtttgttaataaaatgcacacgataagatatttgcattcacaagaataaatgagagagaaataatgcgtgtatatgaaggctgatagataaaaagtgatacgtacatggtgcatgttggggatgcatgatgcgtgccgaggagtggccgtccgattttttctcataattcggacgtccgatttgcagtggctttccgcattaatccattgctccgttttccgttttccatagaactccagtaaatccgtgtgattggggatttggggtggatccgagtcggattctctctcgattccgatcggccgggacgcggagtccgatcggtttcttcatctataaagtctgcaggtaggggcgcgtttatctcctgatccattccccccaactcaaccgctgcggcgttccgcccttgtcgatctcttgtgcagggagggcggcgtgttgctgctgcagatggaggaggccgctgcggtcgcaagagggctaccaagggatttccctcccatcgagagctacgtcgatcgtcacggcttcttccataatagctggacggttggcagccgtagctactccagcatcatgtttcgtccaagaagtacgccgccattaacgctcgcagaagttcacgagagcactcgcgaggacgtgagggaggccatcagtgagggggtgatacgattggacagagccttcttccaacagcttcacgatcatatccagcgccagccccgtggcactggcactgccatggatggagtagtagattgtcaggatctcaagaaatcaacaagagaaacaagaacacacaaggattcaggcaactagtttggattgatctgctccaacccaacaggattgagccttccgccgccaccgccaccgagatgccaaatcatagttgtcttcctcgagttcatcttatttatacagtagcatctccctactcacacgacacacacagtagccagctgtacaacagatagctgggctacgcaacccactcggacccatggtaacgaggattgggctttggccctcttgtgggtcttgctcttcctggagtagtagtctgtatctcctctcctggacttcagcttctgcttcatcaggttctccttcttcaggttccttctctccctgttcagcttctgcttcatcaggttctccttcttcagtacccatagtgacaggcaggttcctgacaatcccctccccatgaaatttggcttgtccccaagccaaggctccagggaaacgcatcttcaaatcttccagatcctcccatatggcttgttcatgctgtaaataagatcgccaatgatcaattgccaataaaatagccatacattccttttcatatgtagaaagtccaatagttctgggccctagggctctgctaatgtaagctataggatgcttatcttgagataatacagctcctatcccacattcactggcatcagtctccactgtgaaagttttctgaaaatctggaagggcaaaaactggagctgaggctaatgcttgtttgagggtgttgaaagccttgtcagcttcatgtgaccagacatatgggattcccttcctcagcatctgtgtgagaggtttactaatgattccaaagttctttacaaactttctgtaatagcctgccaatcccagaaaacccctcaatttcttaactgacacaggtacagcccaatctaatacatcctgtattttagagggatcagtggaaacaccatgtactcctataatatggccaaggtaagatagctgctgttgtgcaaatgaacatttactgattttaactctccactgatgttccttcagaagttgcagcacttgtctgatgtgatccaggtggctagaaaaatctttactgtagatgagaatatcatcaaagaacaccaagacaaacttcctgagtactgacttcagagtgtcattcatagctttgagaaatgtggctggagccccagtcaatccaaaggacatcaccttatactcatagtgtcctgagtgagtctgaaaagcagttttgtactcttctccggccgccatcctgatttggtggtacccagaccagagatctagtttggtaaaccactgagcaccagtgagttcgtcaagtaattcctctatcacaggaacaggatatttggttttcacagttatggcattgagctgcctgtaatcaatgactaacctccatgtgccatttttctttttgacaagtattgcaggagaagcaaagggactttggctatgctgtatgacaccagaactgagcatgtcagaaatctgcttctcaatttcatccttgagagctgggttgtgtctatagggtctgaggttgattggtttagctcctgggacaagggtaattatatggtcacatgttctccttggtggtaatccctcaggttcctgaaaaatctccttataatcctgaataatgtgttgtacctggtctggaatgttaatatcttcctgtctagttataggctgcagttgaaccaggtactgagtgatccccttctactcattccattcaattgatggcatgtaacaggtgaacattgcacaggagtggacagcagtccttgtaccctgatgctggcacgttgatgattgaattccatccacttgtttgcccaatcaacctgcatagggctgatagattcaagccaatccattccaaggacgatatcatagtttcccaagggcaacattctgaaattgttgcagaactgatacccctgcatccaccatttgcagttagtaatttcatgtgtgcaactcatagttcctccatcagcaatcctaacaatgagaggttgttttagtttctgaattcctgataacttcagacctacttccttatcaataaatgagtgtgtgctaccagagtccaccaacattagtaattccatatcctgaacccaacccctgagtttgatagatcttgtggactcagttccccaaactgcttgctgtgaaatggccagtaagactccctgctgttggatctcactatcttcaggactggaatcagggtcagcttctgaattaacagttagagcttccaataattcctccaccacatgtaactgtatagaactggcacatttatgttccttgccccatctttctccacatgtaaagcacagacccttagctcttctataggacctcagagcagccaatttttcatctctggctctagctgcctctatacctctcctgtcttcagcactggtattgctggactttgtattgagcggattactgtaattactgatgggtctactgcccttaattccaagtactgagtctgatcttttaggagctggtgatttaatcccttcaattgcctcttcctgcaacagagcaatagcacaagctgtatcaagatcctggggtctttggaccattaccaccaccctaatttcatctctgagcccttcaacgaacttggtaataaagtatactggaatcagggaggagtcatatgccatcagttggtgcattaaaccatcaaacttctccacatactcagctacagtaccagtctgatttaagtgaatccattgtctaatgagggcc

SEQ ID NO: 74534 - DNA, 1950 bp, Oryza sativa
cccggttcaggaagcaggccccacacgccatggccccaccaccactgacacgcgacgaaaacattggtctcgctctcacgcgcccacctgcccatgttagcggagcagacattttacctcgaacatgccgcggagacagctcatccatgatttcctcccccccctcccccccgattctccatcggattctaaaaaaaaaaattctctccacagattgatcgatttctccccccaccgaatccacgagatttcggagatttcttcgcggcgcggtcggttcatcgtctcttacgttcgtcggcctcagcctcgctcgccgccgccatttgggaggggagtgcgtctcgaggtcgtctggttgacggattcgtcctgtggatttgaaactttttttttggcttctccacccccgcaaataagcttcgatgcttttccctcgcgaatcgaatcgctcggttttttttcctcctgtgtgctcggtttgatggcgacgtgaagaggtgggcgtcgccgtcgaggttgagagcagccgcgctggcgatcgcgggcgagccatttgggttttttttttcggtcgtttggtttccgccaccgccgctgccgctaccgccgccgcgtcgtcgtgggtgtggttttgctttgctgcagcagctagtgctgtgtcgtcgtgcggcttgggcattgcggtgcccaaacacatcgccttcgtgggcgcctcttcctcaggccgccaccccggcgcttccgccgttgtcgtcaaaacctttttccactccccaccgccggggctaccggggtgtcctcggtctgcgccaccacgctgccgaggggaattgttgatctgaactatcgccggtggggcggcttcattcattctgagtcaccaccgaggggcgccatagatatgctccatcaccggtccttgatctgtgccgctaccgacgtgtcctctatctggacgacacgattgatcatagtggctgcgaagcacatcggtggctcggtaggtgaagaatatgaggatttccagcttgagtcagttgtttattttgtgtgtgaattttggggactccggcaataatcgagctattggctgacagatcctcgtttatactcacgctactctttgaatggttggaataaggcatcaacttgacgttctgttctgaaattttgatgaacaatgagattcaatctgaatatatttgtttatcaaattttgtagttccagattgatcctatgaactgaaatttctgttagacacaaatgtccatacacattgctatggccatgtaggattcagttcttacaaacagatgaagtagatcctagagggggtttcactgttatttttgggtaatccaaatttacaggtgttttacttaaaaaaaaactaaactcccaagcaggcccttaatgtgtcacaaaattttggttccactaccattctactagtacagtatttagcgatttgttttatgttttgagtttactgttgtgatttttttgttgcattcattgcttgttttggttgtttctgttaacttgcattatattccagctcttattctgatctgtccttagtgaccttttgaatgtgttcccctaatttctttttatttttatccgttttacatgccaccttgagagcttatagtttactatacattggggttacattccagtggaagttgttacttcataatatatcataccttaaaataaggatcccaccttgggttccctagaatttttgatggagtcgttgttgatggtgaccttattaattcctttctcatgtcaccaatagcacgaaggactacgtggaaatatcggctaacagtttcaccggacctatcaaaattagtgccaactaccttgtttctaacattgtgcccgattgtatgtaagaacatagcaacttgctcttcaacagacatatatatagt

SEQ ID NO: 74535 - DNA, 2692 bp, Oryza sativa
aagtagtatcctttgcatgatcaaattaatcggtactgtagcatatgttgtaaactctgttaagagcatgttaatgagttgtccctgtgtactctagtctatgtgtatcttcaattgttatttcttttatacggaactatgagcattccataaaatctgcaacacaactaaattgcagaccacccttaggctaaaccaatcacataatgcaactagtgaggttagaagtccccctgaatgttgttatatttgctgcagtgtaataacaagagtagtcttagttatcatagtatatttattatgtctattttagggcataatatgttgcgatttgtagatctttttttatttggtctcatttaaattagagtactgtatcatgacactgggttgttaccagattatcactccctcctgcagaggggcatgggcatgaatatggtgaagagcaagcaagcactgctactcctggaagactcttgttgtcaaatgatagccacatagcaggttttcaacaagtatgtcaaccgcaaatcaaaataaacatgcctgctggaagagaatccatctataagtgtgagcccattattgagatacctccaagtccagaacatgaatatgaagaatcaccttatgagcaagaattatatgaagatgatctttgtgatattgaagataccataccagaattacagtatgattttgaaatagatctgtgttcactaaagcacacggtgaataatggctcttggacaccaaactctggaaaagacttggccttgattaattcacagcatgcctctgttcaaaacaaaaggttgaaaaacatagggcgtcttagaacagaacacaacgcgtatgtaaccctgttttttttatatactgctatattatcctgaaaaatcaaacggtatcttgctaagcttgataagttgttgtcacaggtacgtcctcccagatgatcatgcaatcttggaagaggtatgttgtatgccatgagcctgtaagttcaatttttactacaatgatgaaatatatttagtgaccggtttgcaatgtctaccagtttgaagatagagttccagaagatccatgtccttatcttctagttgttatttcttgttctgatgaacacacagtgaaaggcacaattctggtgagcaaccacttgtttggaacataactgtaaggtgcagtgtaaaagataatattgtgctctcgattctcaagtaacatgggctcattattaaacagagtcaaaactcagattcagaattttggggatatgcatatctatataaaacaatgttgatatttgtaccaaaagttaccgaaattgaagttaatatcaaaattaacaaaattttcatttgaacttatgagaccatatcacattgttgaacttacagaaattcaattgtagatatttcttacaaggtagaatgagaggtttttcaactgtaaattctgtcataaacatcttatgcaaattcaaaatcataagaaacaagtgatagtttcttatcttctgtgttctcagtttggaggaaattagtacgagttgatccacaaccctcactattctaaggacaatattttttgtttctatatgtaaccttaaattagttttcacttaataaagattataatatgagtaatttttttctcctttttgattagtttttgcactcactattgaacagataccctgtcggacagcaaccagaggaaactttccattgaatggtacctactttcaggatcatgaggtttgcagcatttggtcctcttcactccaatttcatcttatgtacatttactagttataaataagatgaagaccatattggctagacattgatctgttatatatattatcctttacaggtttttgcagatcattcatctagccgttccccgattaccatccctagagaatgcatctggaacctagatagatgcattgtatattttggctcgtcgatacaatcgatcatgaaaggtattgtttgctgaaaggcgaacctgagattcatgaaataattgctttgactgatactaagttgaagtaatcatcaattccaggtcaaacaaggcaagacattgaggactgctacaagaaaggtaccaagtggttgtaagatttatttcctctttgatgtttctgtcttcgacagtccgacagaatttagatactgaataagctaggtatcttacaattaaaaataaacatagctagaacataagggcctgtttggataggggtgactggcattaagtagattaagatatagtttgaagttgagccatatcccacaaatttcgaaagctatttcagctcaaacagctgaaggccagggataaatcagtgaacctcagaaaattcctactgaaagtgcatccgcttatgcgtagcataatgataccctgttaggtattgttgggtttgaaggggattgaagaggattggggggattgagagggaataatttcaccccccgataggtgtggaataaatcccctccaatccctctcatggggattaaccgaacaggccttaggtggagtcaacccacaactccaccagtacactacaaatataccaatacactacaaatatgattccctttaagaaattgtatatgattcattttcttgaatcagttaaacacaattaagttgcaattttttt

SEQ ID NO: 74536 - DNA, 1327 bp, Oryza sativa
gttcatcaaaatttcagaacagaacgtcaagttgatgccttattccaaccattcaaagagtagcgtgagtataaacgaggatctgtcagccaatagctcgattattgccggagtccccaaaattcacacacaaaataaacaactgactcaagctggaaatcctcatattcttcacctaccgagccaccgatgtgtttcgcagctactatgatcaatcgtgtcgtccagatagaggacacgtcggtagtggcggcggcggcagctcagatcgaggaccggtgacggagcttatctatggcgcccctcggcggcgactcataatgaatgaagccgccccaccggcgacagttcagatcaacaactcccctcggcagcgcggtggcgcagactgaggacaaccccggcggtggggagtggaaaaaggttttgacgacaacggcggaagcgccggggtggtggcttgaggaagaggcgcccacgaaggcgatgtgtttgggcaccgcaatgcccaagccgcacgacgacacagcactagctgctgcagcaaagcaaaaccacacccacgacgacgcggcggcggtagcggcagcggcggtggcggaaaccaaacgaccgaaaaaaaaaacccaaatggctcgcccgcgatcgccagcgcggctgctctcaacctcgacggcgacgcccacctcttcacgtcgccatcaaaccgagcacacaggaggaaaaaaaaccgagcgattcgattcgcgagggaaaagcatcgaagcttatttgcgggggtgaagccaaaaaaaaaatgttccaaatccacaggacgaatctctcaaccagacgacctcgagacgcaagcctcccctcccaaatggcggcggctgaggcgtaggcggcggcgagcgaggccaacgaacggaagggacgatgaaccgaccgcgccgcgaagaaatctctgaaatctcgtggattcggtggggggagaaatcgatcaatctgtggagacaacgtgtcagagaaagagaaaaaaaaactggtaaccacagcgtgtagctgtagcataccacctcctccttcgacaccagccaaatcatacactgcagcgcacgatccatctcattcacacaaagcaaagcaaatccccggttcaggaagcaggccccacacgccatggccccaccaccactgacacgcgacgaaaacattggtctcgctctcacgcgcccacctgcccatgttagcggagcagacattttacctcgaacatgccgcggagacagctcatccatgatttcctcccccccctcccccccgatttctccatcggattctaaaa

SEQ ID NO: 74537 - DNA, 22220 bp, Oryza sativa
cagcgtcatctattaaaaaacgaagggagtagaatatatatagattcattagcatctatatgaatatgaacaatgctaaaaagtttacattgtgaaacggagggagtaaacgttacactaactatatatattaatccatgtcgacactccatgtgcatgcatgtacgttgtttaataatgctttaatcaacaaatcaatcacattcatcaaggcatccaacaggagaaatagttacatactaaatacaacgaacaccaactcgcgtcgcgatcttcctgtataattggtcttcaataattgtatatatatacacccgatctagttagtcaaaagagtaattgattattgccttattgtcttaataaagaaaaagtctaaatacccttaaaactttaataaaagtccatcttacctaaattgtaatcattcatatgaccttaagatgattttacaaagtggtttttatttaattcttttcagaaataaagtacaaatgcattcactaataagagatgcgcactttccctgtaagtacacacgtacactgtaccctacccttatgagcaactccaaaagactaggttaatatatcttgatattgataaagtaaccacgcagttgtttgtgtcagcggccacgtcacaaaccattgaatgaataaatcgcataaatactagcacgcatgccaaatctagtacttcaacccacataagtatgttgcgccacaagaaacccaattatgttggatcaatttgactatttgacatatgcattagatatatgttaaaatctctacctaaatatttctgtttagtcatatgtttgctctctcttaatatcaatataatactagaataacatcactgtaagcataaattgagaatcgaggattgactatgtgtaaataaatatgttatattcattatttaaaaccgtccgtttaagtgtccaaatccacaaaaccgccgttcaaaaccaacttaaggtgtaatataaacaatactataaagtttagagattggatgtccagttctaacgtacgttcagtgtactaggtagattttcatccaaaatttatggagtatatggacttattcctctcaataattaatgcaacgttcttgctgtaattcccattatttatagaaaataatttggactacaaaaagaaataattgagggtaattaatataatcgtccggacatcgtgcgtacgcctacaaaagaagactctagctaattaagagctgtccacaccatgcatccgtccgcatataccctgtcaacaatgtcagacttaatttttgactttattttttcagaacactctatatatatatgacaccgatgatcgatggctttgggtgcctccctttgcctgccttcattcgtgaattaaaagctttgggtgcacattgccttcaaagttcaaacggtgcaagggcagggcaggtacgtagctctctggcctgtgggctgctggtttcttcctccacacctctaaaaagtactactttttttctactgtattgcttaggccatttcttgtaagcacttaggttgtgttattccccttctttcccaactcaactatctttttcttccatgtaagcttttcaaactgctaatggtacgttcttggtaaaagttttctgaagttgctttaaaaaatcatattaatttattttttattttttttgctaatacttaattaattacgtgttaatctcagccttagtatttgttaacaggttgtagcatgtaggatttaattctttcataattaaataaataatctatcagtttccatttagaatgctggctaattctttaattcttatgtttctcttgatccatgcttcattactactagctattgttatttgggttcatctgttgctcggtcgaggctactctcactggtcagaaatctaagcttcattgaggaagcaccggtggtaagtgtacaactaacccaacacaagtcggttactaattattatattaaccgcctaaatttctcctaaaaaataagcaccattttaaaactctaataaataaacaccttaatttggctatttgcaggaccaaagagaggcatgtcgacgatggtggtgagcgcatacaagggggtgattgactctgttcttgcaaagctcagagagctgatgggaggggacatgtgtgccaacctcataggcgtgtccagcagggacattttgttcctcagggatgagctgcctgccatgagtgctctcctggagaagctggatgatgccgaagaactcgattcggaggcgaaaaattggaggaaccaagtgagggagatgacctacgacatcgaggactgcatcgatgatttcagtaacaacatcacaagcgtagacgctaagacggggttcctctacaaggcttcccaatttctcaagacttgcagggctcatcttgaggctgcctggcaaatcaaagagctcaagactcgtctacaggagataaacgagcggcgtaagaggtacaaggttggacattacatctctaatactacctcagtgacagttgaccctcgcatctcggcattctataaggagacagccggccttgtaggcattgacagcccaaagagagagctcactaaattggtgatggacgaagagacgcaattgaaggttatgtcaatagttggatttggaggcctaggcaagaccaccctagctagtcaggtgtatcgtgaagttggagtgcagttcaactgtaaggcatttgtatctgtttctcaaaaaccagacatggtaaggctactcacaagtttgctgttacaactcaagcaacatccctctcatgcttgtggggtgcaagaactcatcgacaatctcagggaatatctaatggataaaaggtagatattcacattatttattcagtttctaggaataaattaacgtcttatcatactagttctttctttaactaaataataaaacttctaggaaattaatttcttttcctcctaagtattaggtcaaaatatgcgtgcacacctttagatttccacaaaagcttggatttcttgtttcaaaaaatttaagacccgttaacacatacttaatttgactagttttaggaacagaggacacaaatgaaattaaattttacttactaaggatcatctataaatggtgcacattcatgctactacctccatccaaaaaaactagcaaatttcagatagattagtactcaacacaaattaccgttgtacccctgtttaatgttgtttctaatgactcaacatcactctcaattcaccatgcatgcaaataaaaagaaaaggttcagccaattagtccacctaattagcattctcaaattaactagttgggtcctaccttgctagaaacacaaatttttggtgcacattttgaatggtagaaatacatttaaagatattaattgatgattttagtgtctatgtatttatatggtcacatttgactttgatggtttttctgtccatcaataaggtaaagctcgaattaattaattgctcaattatttcctacatactgtacatttgtatatttgaaaaatagttgcatatttaatacaagtattcgcttcaaatataaagatgaatataatgtactcctctccatccaaaaaaaataaggatttctaggttgtttagcaaatattaaagtaaaggataatagagtttagtattcctcttaaatgagggatggattggagtgggagggtgtttgaggttaaagatggtgaaaattgattgagatgattgatgggatacatagtagaatgcttatatttgtagataaatttcaaaatctgggaatttttatatttatggacagaggaaatagaatctagtttccaattgcacgagctttgattttgctaaatctatttaaaagcgagtgtttaattattccttgcaatttaatatgtaccgcacgtgaaatgtttttgtaggtacttcattgtagttgatgatttgtgggatgttccttcatggaatattattacatgtgcttttccacaaaataatcaacatagcagagttataataactacaagacacggggatgtggctaggacatgttccagtgaccatggaagcattaacaatatgaagcccctaagtgcccaaaactcaagagaactattcttcaacagaatatttgggtctaaagattattgtccctcttacttggaagaagtctcatgtaaaatactgaagaagtgtggtggcctaccgcttgcaattgttactgtagctagtattttagcttgccaacccacaagactgaaggaggaatgggagtacattcaaagttctctagccactaacaaatttgcaaggaagtccaccttggaagacatgatgcaaatcttggagctcagctacaagagtctgccacatcatctcaaagcatgctttctttatcttggtgcttacccagaggattgtgtgattagcaaggttgatcttattaaaaggtgggtagcagaaggttttgtgagtcactctcctgggcaagatgcatgggttgttgcagagagctatttcaatgagctggtgaatagaagcatgattcaacttccatatcagggctactacaatgaagtatctcattgcaaggttcatgatatgatgctagacatgattctaatgaggtgcaaggaagataatttcatcagtgtgatacaagatccacgagcggcgatagaagttcaagacaagattcgtcggctcaccattgacttgaatggtgccatgggtgacacaatggatatgaacattactaggaaagtgtcacaagttcgttctcttggtgtatttggaggatcaaagtggatacctcctttgttggagtttaagtttctgcgggtgttattccttgaattctttctacgagagatgataattgacctcactggtatcaaccaactgtcccagctgagatatttaaaggttgaatgcaaggaatgcctaatggatggtgacataccatcacaagtttccatagtgttaccaagtcaaatccgaaggctacaacatttggaaaccttggagttaccctgggtatcaaaatgcagcatcccatcaatatcaggcatcattgatttgccgcgcttgacccatctagtgttgcgacagcataaggggggattaccggatgggattagaaaattgaagtcattgcgcactttgcatggctttaatctaccagtaagctcattggaaaatattgatgccctgggtgagctcactagtctagcagatatgtcactccattgtggcaaacaagacacaaaatctactactccaggatggatgactgctctgagttgttccatcgagaaactcggtaatctcaaaggtctttatgtgaggtctaatagtcctagctgttgcgccgatgcgatgagcagctggttttcacctccatttctcaaccttgagaagcttgatctgctagattggacattctccaaagttcctagatggattggccaactccatagcctccgtgagttggcacttgggggcaagaagatactccaggaagatgttagtatgatcggcacaatgctacccttcctcacccatctaagcctacgtattgttacatgcaatatcgcggtgaaggaaagcaggatcatgatagaaggctccataggattcgctgctctccggtttttctgttttgactctaataggatgtcacacctagagtttggggtaggtgctatgccccagctcaagaggctgctattagcacttgatccatgggaatgggatgaggccacacctgttggacttaaacacctcttgtacctcgaggaaatacgagtattgacagcatcaacagctgttgcttctgcaggatctgaatcaatgaatggcaagtctgcactagtcaagggtgtgttccatgatgccgctaatgctctccagagtcgcccagcatttaccgtgctcccaaggatccgttctctctctgatcacgtaaattgttgtaaaattaatatggaaacagttgcatgtaagtaggatttttagggaatgtatatgtaattgttgtagcaagatttgttcttgttccaactgaacatggttgttaatgttcttacttgtaattgtaagttctaatcttacatcaaaaggatgcttagcctaacacatgatcaccaagataatctaatgtggaatttggtgcactggccggtgtcaattggagccacaagggtatcgtcttcctctgttcttctggctcatgagatgttgatgttcttagctacctgtgtacttgaggtacctcgaacatgatatcgtctgcttgaagcaaagatgttgcaggtgattgtcctccgtggggccgaaggggttgcggttgattgatgtccttcgctactacagatcaatgatgccgaaggcattctagtgatcggtgttcctcccaatgtcactacctacatgggacaagagtctgatcaccatggaatcttcttccacggtttcgtaggattgaatgtttcagggtttatgggagagaacgtgcaagagtgaccactatccatgggaactcacttaaatatcatagtggataactacgggaaactccatttagaaagattttaacacgtttctaatcattccgtgtttgcgaatgtcattgatcatgttcatgttttccagccagttaggcccaattgatgagcatatgtcactaattgcctagcctaccactataccatagtgtcggccatgctcccacccaatcccttccctaagctcactccaaccagtagcgttgtctcgtcctttcctctcctctcctctcctctcctctcctctcctggctgaattcaagtcagtggcaagcgattggcttcccaaaccctctttagcccaccacaaccaacaacctacatatgggccaaagtaccaaagctcaactacacgaagcattaaggcctattatggcctgaagttaccgggacaacgaaccaagacctactccgcaaagacttcaagcccacgataaggtaggctcaaccgctacctccatctttccccatgcactagggctagggcaccacattttcttgttggaaataagtctattttgcatcccttaaatatttcccttggtccaatcacatctctcaaccgcaaaaccacaacctccctcattgccccttcatctgtgtcgctggccctccatgtcacatgtcgccgtcggcccttcacgccctgtgacgtgaaacataagcatgcatagtgccactgccgccgtggagcagtgaggagagccactgccgccatggaagagtgagaagagggattcggcaccgacgaagtcagagacgagaagcttctcgagacacgcccgctcctctcggtcgacggctaacgcaagcgcctccgatccaaccgctgcgacatccgcacggggaggaggacgcccacagcaaccactgttgtgttcaccgtaaggtcctgcatcgcaccaccaccaccgagcacacagcacggggatctggtcatgtgtaatgggaatggtgctcgtcgggtagagcgggtgaccggtgcaaccgcgtgacagcgacgaggcacgaccgctcctctcagtcagccgctagcgccaacgcctctgccgcctccacctcctccaccgctggccatgccgacatcgatcggcgtcacggcatcacctccttgaccaacccatctaccatgtcaaacgttgctacttccaccatggacgccgtgccatccacatggggagtatgacgtccccgccacccacaacagccgcggtcccaccgcatctcggactacgagcagtgccgccatgtccaccatgaggttcaccatcaccgatcatgccagatgggaagttggttgttgatatttcttaatgatattactagaatataatttccagtaatggcgcagaaatactcctggtatattatggttacagagttcatccgcaaacatgcagatatatcattgtagcatttcacccaagagtattccaagggtatcgtatttatgtaatcccgtgggaagatcatagtagagagaaccgtactaataatttatatgttacttgtaataatcatagtctaagcaggggttaagataaatcaaagggtacagtgacacacaagcagggagctactcattcacatactaaaacatctaagctaagtggaaagaaaatagaaagagaatctattcctatacttctaatatacatagtatacatacacttatatgattaactagctaataccctctttccgatgccctcctagtacttcgagaagccacccctgactgtcgagtttcttacgacagcccgccatgaccatacaaccagggctaaatacggaggagtaccctcccaggaaactaacttaggactatatacacgtgcggaggaatacccgtactgagctgtcaccatcagcggcccacctctcatccgcagcatataaccccaaataatgatatctcgtaatctagacaccatgcctaaactaccagatactactctaatatcatcgtcatgacatagagtaattgcataagcaaacattatacccgtacctatgcttctcccagataagctaccagtataatcagtataacatgaacataatgtaaagttggcattcatatactcgaaaagtatttcaataccagaaatgtataaagaagagtattctaaacaaagtacaaagcttacaaaagaagaaaggaaagctactagagccatacccgatctcttccgaaggcttccggactccgatttctattctattcctactccactagcataagactactaaactaaacttgagagaatatgagagagctttgcttggagtgtgtggaggaagtgagagtgagagctacttttatagcttgagaatgacagttgtggcggttggaatggtcggaaataccctccaaccgccatagggagtcgatctcagccgtccagaagaaccctggatcgagtggtgccgtggtgggttagaccgaaccatgggttgggccggcctagcccaaaatcggcaggtggccttctctgctgctctcatacgcagacttgtgaattttgccacagttcattgtgtcaattctgagttcttggcccattcatgcataagtctaatcctcgacatcgtccgattgatttatcgtctggtttgatgccgattctcctccactttatggttattctctacaacaggttagtaaacctaatactagtggagtattattatttctaacacaaatatgcattgcaagcataactagttctcctctattttggtaatattgacagtcgaaactgatcgctaacgaccataaacattggtcagcgatgtcatggacagggagctcgttgggcacggtggttgaccgacacagtcgcacgacaacgtcgaggcacgctagctctctcagtcagccaccggcgcatccgtcgcctccacctcctccagcgtcggtcgtgccggcttcggccggcattggcgcatcgcaaacaacgtgccatctgcacgaggaggacgcccacaccgtcctcggcaaccttggtcccgcacaaggccgaggagctgccatcgagggtggccaagtgtgactatgcggcgctcgctgagggcgtcagcgcatgcgggaaaagagggaagacgagagagagggcgtggagaggtgaggatgaaatgtggtgagagtcgttgacacgtgggttgcacctgctaactcagcaagtcaaccacaatcaacctgcctatatcaacagaaaccgcttcctaaaccactaaggagatagtttgcaccagttttcaaaaataggggtggtgttataccgggttttgtagtggaataacttcacccgaggtctctcaactttacgtcgagtctgtttaagatccctaatcctcaataccagaaatgtctacctctcaaatatttaaaaccatgcaaaataggttctatggcagtatataggggtggcaatctaagcccacatatttttcttttttctctattctattatctttcttctcttctctttcagcgagcctggctgcctagggagagcagtgggcggagagcatggcggcggctggggcgcatcgggcacctcgtaacgccgcggttgttcttctcatggcctccgttggtgaagcggggctcatcgccgtcgccaccatcggagttaataccgagggagaaggagggcgcgttgggagcctcgtaacttcatcgttgctcctcccggcggcgctcctcatcgtcgtcattgtccgagtcgatgccgagagagaaggatggtgcatcaggagcctcataacgcttatgttcctcccctccattgccgccgtcggtgaggtgggattcgtcaccgtcgccctcgaaatcgatttcaagagagaaggatgaagtccatccgccagtgacgacgagggaggcatttggtggagaactgagtaggccggcaaaggggggatcagtggtcgacggagcagagcagcggaggccggagtaggccgagagaggggagacgaaggcaggcgacgtcggcaaagggggcggagcggagtggctgcggccgaagtaggccctggccctcccctccttcttcctcgtctcaagctccagctttgcttctcaagcggtagccgccgcacgcttctcaagctccacctccacgagctccggccctcgatctcctccaccaacggtggtgcctccgccacactccgcgactgaccctgctctgcccaccgctaaccccgcaccgagtcgagcgtgcagcatgcgaacggcggcagcggcgcctgatgcaacctccccctccctcccctgccggccgcttcctccctctcccggccgcttctcccaccggccatctgccccactcccaagcttgggaagaaaaaagaaaggaagaagatgatgctgacacgtgggcccacatttttccttctcacttacagatgggcctcacatatttattattttattttttgataactaggatgttacatcaacaaaaccaaatatctatactgtctcgggacttttttttggacagttttacatagtttaggggtacacatttctagtattacgattaggggagcctagacagattctacgtacaattgagggacgtcaggtgaacttattcattttgcagttgagggagactattcagtaaggagcaaaagaggacgggaagtaaagtagacttattcctttcttgtagctatgaattttcatgttttcaactaaccagtccaaagttctaagcattcagagggctaatccatttagtggacctgcagataatatttttttctactgaaaaatttacatgcgtaaatatttgtataaaatttaagctttgcatgacaccagactgaattctagccattcaaagtatagagtagtagactcactcgagagccaactgttatctacctggtgaaagacctgcagcaagcaacactaaggttgccccatgtagttccaatttgcaaagggcttgcaaaatgatattttgaatcaaatccacaaagaggcctggaatgtcaaataatattgaacaggaataaattaaaatttctaaatttaaatactacagcttcaacagcccaagtattctgctgccttttggaagctagcttctgggctgaaattgtaagctggcgatagcagtcacaagaagcagctttctttacggtaataatcacaaagaatacggtaatgaacaagattcacagtttcacataatgattgttacagctaacctgaggtgtattcctcatatatctacctatcgaaaacttttcaggagatgggacgaaggaataggggagctcaaagatcttcccagactgctgccagcttttttatctgatgatcttataggtgtggcacattcgttgaaatccaggattttcccctcggtctgcaaaatatgcattcatattatgatcattgctaataatacagttaaacactggcagtctggaatgggtaatgatgttaatttatgctcaacgtggatgcaaatctatcaaaaccatttacagttgatggattacagaaaaacaactgccaccgttttggactcacaaaccaagatttgccagacagcatgagctacatagctaaataatattaacgcaagaggaactactaaaatgacaaacaataaaaccagggtcctccttttgttacaacgcaagaccttttgtttcaacaacacgggaatatgaaaataagcagttcaatacgcaccttgatttttgcttgcaatttggttgttgctcctggttccttcttggcatctggattctccaggttttccttatcagaatttatgttctcagattggccaccacttgccagcacctcacgggcttctgccaaagcagcagcagtctgcacatttatctgcttcaccaatcctagcgcatcgtaacttccattagctgggctgacgaagtatgaaccctgggaggaacatatggccacaagaagttcagcagagtaaacagcaagcaatatccccagtgcgtgacaacatcagtaattaatgaaaaaaaatactctcaggcacgactcaataatatttatttccatccgcttagatttagccatagtccaccaagttatattcttgttccaaacacttgagctctgcatttcaaatatataaattttacaaagtgctaaatgtacctgaaattgcatatctacaaaccaaggggacttccatgctgaaggagattctagtcctcttttgatgcctggggtatcagccaatctaacaatagcaaggctttagaattcagaattacatattaaaaggaacaaggatcaagtaatctcttcacacttcagtagttggagacaagcggagtttaattccctattgtagtatcttaaatgtattcgtcagtaggattcaagtgttcttcaacattctggatgaaatagcatgtgctaatcccagtaagatggtggctaaaaggcttatgataatacattagataataaaatgtttttcagtttctgactaatgatggaagctcttgaatggatatttcagttacatagataagaatgggtagtaacttaattttgtactggattaagtatctaaatagagacatgaggttgaacatgaaaaccagctaatcacagtttaggtcttcagaagcatgccggactacaaattcaataggttgatgcttgcaatagcaagaaaaggaggaaatgatcattcactagagatcagtttccataaaacttaacgacttaatattcatgtaacctgagaagattactatacaaaagaatctgctgtaaaacaacaaaggaacatgtgaaattagtggtcttacatgttcacatattcataatccacatttatgcatgctgaagatttctccacaataagttccgcaggctttttagcagacactccctccttacagactgacaaagattccatatttgtgttttgcttctgtttcatggtgtttttaccataatctggggaaacaagatcatcaccgttgtgctcaataagaatacctgcaggttgctgcatcaaacaacatataggtaagaacaagatcattggaaaaattcattttccattttgatccagtctcccagcccccatatttcatagatgctaacatgttaaagactaaagagcacctgctacactcagggcattaacttggttatttgaagatgcataaggccactcccagtgggagtttcatttaaatagggctccatgtcaacaatttagatgatgtgggcatgtggcaaagaattaataaagtgagagatgaaatgagtgtcatctagatgaaactgtctacatcgtttccaatacagcttatctcttgcatgtattgcctatgaaacagcaaaaatgaaacaatgcattgtaagagatatttcaatcatccattaaataccttgttgcttatgtggcacccactgggactggcctaatgctaaatttaattgtgttactggacccactctgattggttcacctcacaaactatacaggtgctaccttttatcctcaacgaaatatgatacacatactaactggctaaatatcatcaaaaactggaagtacttactaaattgcctggcagatcatcataagtagtagttatatttgttgcagtacgccgttccccccttgcctgctcgtcaatgtgtttgtaatttcctgcactctgtccatcttttgcctgttcaattgtgttgtccaaattttccttgttctcatcagagaactcaagtttcttttccagaggtttagaagaagcagatcgctcaatacgcaaaactgatttagttataacagcatcatctttagtggcattaataaaacatgtttgaatgccgatggaggatgtgtctgataccccacaatccttttcagtcccagatttcttctcgattcttttatccggaataggagacacgaggtctctgtgacgtttctttagtattgatggtgtgcatatgaagcttttggcagcactcttcagcaaaatgtcagggctttcatcatgtgtaggggagccccacaatctcattggagtgcagacattcatggtcgaccgcattaactgccgaataccaaggggactatactcttggagatcaccagaagttacaaggtcgcaactgacaaatggaacatccatgcttggaaaacgaggaggttcatagaatagggctccctcatcctgcttttcatctgctgtagcactcggtgtaaccgatggttctttctctatactggcttcaggttcttccgcattagtaacatgttggtccgcacattcaggtatcctttccatcattgaaggaatatcactgccattactactaccagggttagcagacatttcagcgtcacctgaagaactggaagattgtgtgaccatttctgcctgagaaactgtcatttcttttggttctgatctattatcagaaggtacatcagtcataacatttgaacagataagagatggtggtactgacatctgtggactctgtccataagtagcctccatcacactggaagaatttgatgtctgtaataggtagggtggtgctaaaaattcattatctgcttgagaggaatatacatccgattgatgatttgatcttgaaaaagaatcagtttcaactgcatcaggtccagaaagaaggctttgcaaggaaatatcctgccaaagttcagatttcagacaattaggactattgaagtcagcctccgacataaaatgtagtttttgctcagctccagaatcacttggtaacatagagagaggcatctccattgctacatcatatggttccaatgacctttcatgattttctatactacagatagttgggttgtctgcaaaactagaattacttggcacttcatccatactcatatgcaaattcaatccttgagcaaactcctcttgcaagtgttgatctggatcgaagttagaggaagaaacgtggtagtgcacctcaggtatagcagttgcaacagcccccacagaagtatagcatgcttcgtgacccacagaagattgagaatcatgcgcttcattattgtcaacattcgcatttacttgcaaatcacagcccaatgccacattagcattgtgcacttgggagcaagaaaccttggcaagtgatgattgactacacactgatgaattttcaacctctcgaacagcatagctaccactgtcttcgctgttttgttgggtcaacgcaggtgaggaattacagtgtgcagagtattcatttagagggagacacgagacttgggtaagtaaacctgatgacatgtatgagtcgactttcttctttactgaactgttccagtgatttttaattgcattgtccgtcctgataagggaaatagaatgttacaggttcaatcatttcagtagtccaaaaagggcatatttttataataacaagcgttaattgagcagaagtacatatagatcattgtgcattaggtcataaacatttagagaagacaagaatgttaaacatcaatagatgtgtcaaaatggcagtaaaacataaatttcgcatctattttcacttcatagaaaataacagattgattttaaatttcgcttgctgaaaataaaggaacgatattgcagttaagcagtggcatctctatttcacattcggtggaagtatggacccgcgtcctcattctattctcccaaagcaaaaacgatttaagtttcttttttaggttaccatcttccctaaatttatacaacaccatagattccaaatgatgtctgaaaggaaggtggaaagaatgctgagctaaacagtttgggaacttaccacagaaaaaaaaatagaatttggaacaaaaattagaggaaagatttcccccataatagcagtcatcatgacaatatcagatcaaaactagaggtctgcaaacagctcttaggttaaaaataaaaatcattaccttcctggtaaaaattttgtcagctcagcccatttatttccatacattcgatgagcatgtatgagggtaatttcctcttcttgtgtccatgcctccttgtttatgccagggttaagatggttgtgccacctaaatgcagattagatagtccatctttaagacgtagaatccacagtaatgatactcgattaaaaataatggcatgcacattaagaaataaattagcatagtttacaaaatactgcattgtgaaaataaatcttattaacaatctaacacatgttttgccagacatcattgtacaacatatatggtctatgcgaaaactatgtccaaagaaaacctgcattcaccagcagaacaacgggctagaagaaatcagttgttgctagcacaaagaagttgctctgttgagccccacaaaacttcttgttatatcatttttcttcagtgcaagctagatgaaataaaataaaatgaataagtaattttcatagcattaccgttcccgacattgctttcctatacgtccaggcaaagcttgagcaatggttgaccatttctttggtccaagtttgtttaccatctgaacaatgatgtcatcttcctgaaaaagggaacaagtcattgtgagcgtattatgactaatcaatactatctaagaaatgaaaataaatggaatagcatcctacttctttggaccatggccctttgaccaattcagggtttagaaccttttgccacctgtgcaagcattgtacatcggttctatccggaaaacattccgctggaaaattagaaggatctctgtcaaagcttggatttttaacgatatacaagaatctcatcaacaaagtaggaaaaacaatgccagaagagcatgacttgagtgtaagttaatgaaacagcacaatgctttcctgcacacgagttcccataacatcgaagaaaaaatataaaatatgctgcatggtttatgatatcctactgcactaaacaattgtaggacaaaagaggcttgagaacaatatggtaaaaatgaattgtaaaccctggatagtggataatattgtgaaataatatattgttcctgttacaacctgacatgcattgccgtacaacagtatgtaatcaaagagcaaatgtgaccaaaagaaaaaccaaagggaagcagacatgcataatacaccctctatttcaggttataagactttttgactttggtcaaagtcaaactaatctaaatttgactaactctatagaaaaatgtagtaatatttacaatgccagcatagtttcattaaatctataattgaataaattttcataatacattggtcttgggttaaaaatattactacttttttctataaaattagtcaaacttaaaatagtttgactttgaccaaagtcaaaatgtcttataacctgaaacggagggagtaggctataaaatgtagagtaatgtagataccaaaggacacacttttgaaggtgcttccctatgttatttcctctctcaaaaaaatagtgcaatgggtggggattggattttagaaggctctttcgtttatatgttccatcataaaaaaaataactatattgaagataaagaaaaagaaaagtatgacagctaaaggatattgtagaaatgcaatgataaagagtaaggactcgccgggcaagagtaaggactaaggtaaagagtaggactaagcaaatagaaaaatagaatcattgcatgactttccacatataagcatcaatccaaagaacgtacctatttttttccaattcttccctttatatgtctgaacagctctggacaatatggaatcctacatttgaatagcacataagtgcaacgttaaacagtgtaagtagataataagcacaaaaaaaaatatgcatctaagaaatttgaaattttgcattgtgtggatgataatatggatcttggctcacatttcattgagacatacaaaatagaaccaaaatgctgctgttacaattttgtacaaagcatggaactagaacagaattgcacatgactatatgacagaaacagaacaaagaaggtaatcccaaggtagaaaagtgaagtttatgattcgcctcagaatacatgcatttgttgacttttaaagagttaaagttgcccatggctcccttggatgctagagaaattagtaaattatcagattcaactttgtttgtaggaggaataaaacaccaaatgaagtgaaatatttttttcatattaaacaagtccagtctttaccagtaaacacattagatgtttcacagttacataaaacaagatttttcaatcatcatttaattatgtgtacatgaaaggactcttcatcaacagaaacacaagctgacattcacatgttatacctcttcaggggtccaatttcctttcgtggaacgccgtgttggaccagtggtcctcctaaagttacaaggacaaagaagcataataaaatttagtagaatatacattagcatggttagaagagcttagaattttacccactgagcggccggcgcctttgtggttcattgctgatttcaccttcttggggagctgatgaaggtccagaagcttctccacccttctctggagcctttccgttgtcgcttgtcatcatgactgaagacattcaatcctcactttgcaatagaaacctctaagggatataaaaatcattatacggtcaagcctgagtaaggccttcagggagttgcttcaaggaataagcgatcataggctgcaatagaaatggaggaatgaagttcttgtcacaagatgtaacaatagaagtgttcaggaatgcatagagggcattgactacactcataaggacattaatttactcatttaaaaggaatggggagtagaactcatgtcactttggctttcttaaaaagatggattttacaatcttctatcaaaaagaaggagccgaggtgatagtgtatctacaccagtacaccatcccttcactgtacatctttcgtaaaaactaaaaattgcatcattcacacagatgtatcatgtatatggaggcaatcgattgatatccagccaagcgtacaacttatagattgggaaaaaaaatagtccatctttgcttttctaaaactattctgcaggatcaattaaccagcaaaactatttgttggctcattctaccctccgagctaccaaagaagctaatttcacaccctaatggtttgtgtgtgggtgggtgtgggtgatatgcactgccatatggacctctaatgcttgcattgtctgaatttcagctttatttagtaccaaagagagtttgatttttgccatggaatttaccgaacaaaaatgtataatatacagatctcactgagacaaattcatcacacatacaaaagcacctcctcctcctcctcctcctccagctccaaattcgaagcggacatcccaaacaacaatcaagcaagcaagcagatatacataccaatcgccctggcgacggcgaccctggccgccctggtcccgcggagcgccgtccccagccgcacgattcctggatgctggatctgcgggtgggagcccgacggccacggcagcggcgcgatttgcggcgcaccgaccaccggcccacggcggcggcggcggcggctccaactgagagattcggcgcggcagaggtggaggcggcggggggtgcgagatcgggggcgagacgaggtgggggatccgatctgcgggcggagcaaatcgcctcctcctaaccctagctcttgctcttcctcttcgtcttcgtctcgcctcgtctgcgatttcaaatttcagagcgtgggagaaatgaagcggatgggatatttgacaactttgttttttcttctcttttttaagttttgggttttgggttcggggtggtttctgcaaaatggacgggaaggaggcgcggagagggattccggtacgaaatggacggtggggagatggcttcgcgtgagatcgggcggatctgggccgtcgcttcattcgcagagctcgtggagtcgttgacattcgaatattgccgtaccgggagtatccaaagcaagggatgcttggctgtgttcgttaagagaagggaacaaatatccagtgcatgaaaaacagagcgatttattactacgtgattaattaagtattagctatttaaaaaaaatgatcaatatgattgtttaaagaaactttcgtatagaaattttttataaaatacgtaccgtttagcaatttaaaaaacatgcgcgtggaacacgaaggataggagttgagaacacaggccgccgaacacagccagttgcttacctccaatggccatcgtcgacaatgaaaatttgctctcacaaaacatgagaggctattccctcgataaaaacaagaggggtaagttgaaaaaattattaagcggattattgttacggtcatttggttcattataaagataaattaaatattttaaaaaatactagctaaatacccgtagtttgctactggaaagttgaattatacatgtggtaaacttatgtttggaacaagttaattataaggtttttaagaacaatttcattcccagttctctatagaggtctttacatgataaacttaaatcatagagatgaaataagatattaaaaatttgtaaaaggatatttttttacaacattaaagtacgtacagtagttggtaagaaaatagagttggtgattggcagatttattgccaccatcatttttttataaaaaaaaaaagagtatagaaacttaataattagcttaaaacaagtctaagcagtataactaaagaaagtcttgagaaaatacctttttaatcatggagcaaataatttgttagacataaaaagataacataatcaactggaacgattacactgaaaacaacagaactttggagcatttgtgaggaaaaaaaaatctaagccaggatggaatgcttgtcatatttttatatccttttggtgccgggatcagttgactcatgaagtgatgcaagctttgaagatgctatcaagctggaatgaagctacaattgttcataccaaaagtaaaagatttttccatcaataaagcacatgaacagggcttataatagggtggattcgattattttcttaagcaatgttacccggactagtcctctttccacgttgggttgatctcatccagggttttcaatttcgatttgcacagaaattttggaatttcggtgcaactaacacttttgggaatttttgaacttttttacccaaaatcatttgaaaatttaataaattttgaccaatattcaaaaaagtttgcagaaaaccaaaaatcttgtgcaacatttttagttgctagaggggagcgaaatttccaactgaaattgaaaaccctgattttatcatgtagcatgtcattcaaatttttagattaaatgcactaggcccaatttaatcctaataaattcttaatcctaataaattccaaaagccaacaattaatgttaaaggaatctcaacataaagtgttagggtaccgagctcgaattcgccctatag

SEQ ID NO: 74538 - DNA, 41765 bp, Oryza sativa
  unsure (1)..(41765): unsure at all n locations
gcgtcaaatatttagaaacggagggagtattttatttattttgtgcgcaacaacttagacatggttttattttttagttgattaccccgtgccttaccatctttgcaaaattgtaatggaggtattagaaaattaaagaatcaagatccctcattttgtggatctactcatgtagaaacatcccttctaagttccatgttcaatgtccattgaattagtagtgtgctttggagcaaatggttgttgtgatgaccttcatagtgtctattgatcctagtgaggcactgttcataattttcttgcaatttttgctatagtatttaataacactattctgaccagatcattgatacaatcttcttccagagctgtttgaaaaggcagtgtattttaaattataattttctttccagatatcagttctattgaagagaatgcttttgagtggcgctcactaatatactggtctgtcttctatgttttccaaatgatgcaacttccttttaattctctgttcttaacatgctataccagttattgatgatgagacttgtgaagaaaggcttgaggacatgagaaggcgtggagataagaatttctacatgtgtaaagtcaaaaaggactttgtaattgatgcaacattcaaaggaaatgattgccgcttttttaaccacagttgtgaacctaattgccagttacagaaatggttagagtgctctttactcgctgatgcattatatcaatttcacattttgcttagggttgttttcttgttaaattggtcatttggtagctaagctttctgcttaaacaaattaagattgtttcaattacttttttttttgtttttccaggcaagtcaatggcaagacaaggctaggtgtgtttgcttcaaaagctatagaagtgggggaacccttgacctacgactacaggtacctgttcttatcaccatgaagggtttttgtcctttacagcacgagaattttaacctgatttttataacctatctttttaccatcaaagatttttcttattctcgcattattcagttttcgcctgctgaagtgcataactcagaactgttagctcagcctacaaaatattatgaccataaaaatatatgttgagacttctattcaattatatgtgtaatactaattactccctccgtttcacaatgtaagtcattctagtatttttcacattcatattgattttaatgaatctagatagatatatatgtctagattcattaatatcaatatgaatgtgggaaatgttagaatgacttacattgtgaaacggagggagtactaagtattggtaattatgtttcatagttctttttgcatgtttatcccagtttcatttgagtacttggtaaatccttgaaaagtactacctccatttcagattataagactttctagcattgcccacattcatatatgtatgcctagattcgttaacatctatatgaatgtgggcaatgctagaaagtcttataatatgaaacggaggaagtatatattacctatcactatatgacaattgaatctgctttctttggcctcaaatatatatatcttttgtacggagtacatacacgcaaccgagattttcaaaacttagtatcaatatcttattttaatattttgattggtaaatatgagaatcatatgatatttgcatatttctcttgaaaaacactatcagaatagaatattatttctactccctctggttattaatatcacttttgggcataaatgcaatgcaaccaaaattcgaaattttgagtatcaacattttttttccttatttggattgcatatatgaaaatcgtctgctcatttgtcatgaaaattactttcataggattttttttatttgggtcgtacatccccttgtgtgaaagtaatttcttagtatatatttatactccaaaggaatttttcatgacaattactttcttatttgagtatatatttaatacactcattagtgaccatcaaagagatttttccataaacaaaataaaaaaaacagttgtcatattactttggttcaaaaggtgttgaacagaatcacaaagagatcctctatttgcttgaaaaaggatatgcatgatgcagttgatgaccacagtattctggcttctgttttgtagattcgagcaacattatggtcctgaaatagaatgtttttgcggggctcaaaactgccaagggaatatgtctgtgagtggtaaagattgatttaagttgtatgctgttaggaggtacatagaaggtccaaggccatggcaaatggcagtaaattcaacatatagtgaatattgattgggaagcacattctattcctgtctttacaatgtgtcatagacaatttgttcgtactcatccttctggtttaggcttgcaatagtgttatacaatagggtaccctatacaccattctttgatgtgttcaaattttactactatgtaagtacgacaaacgcatagtgtaaatattgatacagtgctatatactattctttagactccatatatcctaaactttgagtgaacgtctgtctagcaccctacactataaaaccatatgcatctgaatttgttctgagtatactccatttccctctagatagttggagggtgtttttatacctagcaaggacaagtattggaggagattagaatttgcagtaactatttactgaatgtttttgcaagtgtttgttattagtatgtctgaagttagggctatcaaccaagcaagcttgagctggatagaagctcaggtcgagcctaaattggcctacaagctagctttcatgtcaggaggctcaatgaagcgctcgataccagcattttttagcatgaaacctcttattgaagatgggagatcagcttttaataaatcaacagctatattttaatacagtttgtaaagaaagcctcagtgaaatcaattataagttgcaaccataaaacaatctgaagcattgtgtgtcatcgttttgattatcatagctcatagatgggcactccgccactccgtagttcagttgtaccatacagattcctcatgaatgacccactggcccagacggctccccaagaaatcaatcgcctgggccatgaccatgacactgccaagcatgcatagcatagtactccttttgcagattaaggaaagtgacaatgctgcaccctagattttcgtgagaacaatgcatccaacattcccactatcagattcgatcatttactgttgcacatacaaaaagaaatggagtgattatctttacaggtcacaaagcagtcaaaatgactccatgtctctctcaaggctctatcaacatccctccccttacatacagtgatacagataaggagttcagaattcagaagaagcccatacatatatgaacaggggtgtactgcaaaagtttgctcgagatcagggccagaatgcaaaccaaaggtcttctgcagcgctgcatgtgccatgtccgtccccaaatcaacaaaagaaagagagaaaagaaagcagcagcagcaaaagataaagaagcctgtgaaaagaagcaaaagagaaaccggagaggaggagcccctttttctttacatctttctcggggaaagggcctctctttgatcagacagaaactacacactgtggtctaaaactaaaaagcatctcaatcactttgaaactactcgtactactccagctagcaacaaatccaatcccttccctctgtaatatatttttcttctctttttttcctgaagtactctccctgaatatctgattctctgaatttctttttcagtgctctgaatgctctgctgcattctgctgctaccttggccctgacagctccatctcctctaccatgtcgatggaccgcacctcgtcgctgctaaggctgctgtcgttgtcgtggaagtcgttgaagaagacggagccgttggagtcgttgcggtggtcgtagccgagctcatggggcgccgccgccgccgccatcgccgccggccggtggttggcctcccatttctcggcgagcccgtctccctccagcatccggaccacctccgacatcctcggccggtgagacggctggaactgggtgcagagcagcgccacctgcaccatctccgccacctctatcctgtcgtagtgaggccccaaatcttggtccactagcaagtcatgcagcttctcttggtgcaccttcctcaccttcattttgataacacgatcgaacgaaaacaaaaaagaagaaaattttcagatcatttacacatggagattaagtagttgaagacattgtcatttttcagaagcaagtcatttgcatgccatatgcagagtgaacagtacgtgggaggacgatcagcattcaaacatgcagtggcaatgcttgcaggattgcgttagtatgtcaggttcatagtactcgcaattaatcttagactgacagttggggcgcctactgactactgtcattcgagcatcagattcactagaagttgctattgaatgagcagcgcctcaaagtgcagtgagccagtgaccgcgcgcgcaatgaacgcacatgctagtgtactggatggatctttcgcaaaagatttgcgaactttaccaaagacattcacgtacgggctcgatcaaagcaaccgaggcttttaattcgtcaaacaagaactagtgcaacatcttttcgatcacggctcaaacagcagctaaaaaaagctgaaaattggagaagaaatgtggaagtgcatgcttacccaatcgagcatgacgcccttctggtgctggatgacgccggagcccttgccgacctcgagcgcgcgctggccggtgacgagctcgagcagcaggatgccgaagccgaacacgtcggtcttctccgacgactgccccgtggagaggtactccggcgcgatgtgccccaccgtgccgcgcaccgccgtggtgacgtgggagtcgccgtggtcgagcagcttggcgagcccgaagtcgccgacgacggcctcgtggcactcgtccagcagcacgttcgcggccttcacgtcgcggtggatgatctttgggtcgcactgctcgtgcaggtacagcaatcccctcgccgtccccaccgcgatccgcttcctcgtctgccagtccagcggcggcttcccttcataaattttttgcgtaacaaatgtttcaacaaaatttgctccaaacaatttcagttctcaatgcgcagcacaagacaacaaaacgccaattgcttgtgagtataaatgctgcatacagttgctatgtttgaaccagcaaggtacgtagggtatacagaacccgtacgtccccctgcatcgtgaacaaaaaccacgaacgcggccaacgtacgtactactgaaataacgacgtgtacagtatgccacaaacttgttggcacatgcgagcacgcagcaacaagccggcaacagcgaccagacacacgggctcgtagcgtagctggggcacgtatagcctgtgctgccgctggctgcctcccctgcaacagctgcggctagggagaggaggaggccggccccctgccggaataaaagaagaaacaaacgtttccctgcaactcccctgaccggtggccccctcccacccggaccaccacaccgatctccaaaaaccccaagcaccgtggcagcactactcctactgttactccctctgttccaaaataagtacaattatggttttccgcgtctaactttaaccgttcgtcttatttaaaaactttttgaaaaaattaaaaacataagccatgaataaagtactattcatgttttatcatctcataacaacaaaaatactaattataaaaaaatttcaaataaaacggataatcaaagttgggtacagaaacttatggctacacttattttgggacggaggtagtactgtataaaaaccatcgcaatgatcgcgttacacccagacctcaaccctgagcccctgatgaccactcgtcatcatgtttgcccaatttactgctacagccgcggcggccggtgaaccagccgcacgccgttgttgcgccgcgcagcgaggaaggacgcgcacgccggtgaagcggacaaaacgtgagtgcggtggcgcctggcgagtggggcccgtgggggaggaggcaaagtacaggacggggtggaggcgcgaccacgcctgaccacgctgacacacagggggacggggactacgactgatccatccccatgactcctgcgtgcaccccaacgcgcacgcgggacccacacaccacgcacccacgaaatcgacactaccactgtgttgcgtgtgtcacgttaagcgtacgtaacgtacctcgaaggcgggaggcgacgctgccgttgggcatgtaggggtagacgaggaggcgctcgccggaggccgcggcgcagaagccgacgaggcggaggaggtggcggtgcacggcgaggctgatcatctccacctccgtccggaactgcgcctccccggacgcggtcgggtccttgagccgcttcaccgccacgaccgtgccgtcggagagcctcccccggtacacgtccccgaaccctcctttccccagtatgttcctcgcgctgaacccgtccgtcgccgcgtgcagctccctcagcccgaactgcctcacgttccccagcctcgccatcacctcccctcctcccccatcctccacgtctctccccttctctgaaatcaccaattacactcacatattaactaactgatcgatcgtgcattttagtactggtgttgatggggacgtggcgtaccgaggatgccgaggacggaggaggggcccgagaggaggcagcggtgccggcgcctgcgcctccagagaaagcaggagacggcgaggagcacaagcgcggaggcgccaaggcttgtccctactccgatcggcaaccgcgcggcgcctcctccaccctttgacctccccaccgctgccgctgccgcccctgcagtgcacacgtacaccgcgcatgcatgcacatacgcccaaacgaacacgattaaactccctccgatcccccaaaccgatcgatcccaagaatgcaaagacaagacgagaggaggttggactcactgctgctgctgctcggagtggagtccagcgggaatggcacggtgaccggggcgaccacggtggcgcactccgctgcgttcgcgttccccgcatggctgccgctgctgctcccgcatatcattggattgcccacgacgctgcatgcgtgcacgcataacatgattgaaaaaggaaaaaaaaacacggcatcagattcgaaaacatccaagggatatttctatagtattttataagttgtaacagagctatagctagtggcggctggaatagaataagaagacgaatgcacgagcagtggtactagggaggagtagtccatacttgaatgttcttgtggggaagtgaggaacagggccagtgaggttgttgtaggacaagtccctgcaaaatcgcatgcacaccaaaccataccaagatcaatcacatcgatccgttcatcggctatgcaagacaaaaagaattgagacgatttgacagagttggattaattagcgtacaggaaggagagctgtgggatcttggccagcgacgacgggaacgccccggacaagctgttgttgtttagcctcctgcggcaagattaacacgcaagtgagacaaccatgaagaacttaaactattttagctttagtgtagagtagtaaagtatggaatggaatggaatgtgttggggggagagaagtgactgacaggtatcggagggtggagaggcggccgagcgtgtcggggacgcggccggagaagcggttgttggagaggtcgagcgtctgcagcctcggcagcgcgcccagctccggcggcagccggccggtgatgttgttgttctgcagcagcctgaaaacaaagtcgaagacaaacgacgtcatcatcaccatttgatgctctgctctgcttcttcctcctccatttctcccaagaacacgagatgaatcgattggaatctctaacagaagcaattaaacaagaaaacaaaagtttctttctcttgcttacacttgttcaagattggtgaggttggcgatcctgccggacagggtccccgacaatccctggctgggcgctcccctgagacgaggtacacaagcacgcattagtggagctgatcgagccggtcggctgccatttccggtctctcgctaagttgctcaaaacaagcaaaagctagacgacgacgacgaagactgagagagagagagagagagagagagagcgagcttacaggccgatgacgaggttgtgggcggagcaggtgaccatggcccagctgcaggggtcgacggagtcctcgtcccagttgttcagcacgccgtgcgggtcgaccagcccctgcctgatggcgatcagcgcctccactgcacgcgcattcgccgcgccaaatacaaccaacatgcggtctcatcagccgcagccatcttcggttccaagaaacgtcagacaagggcacgtaccttcagggttgaggggctcggaggagaaggcgaggaacggcgcgtaggagacgacgaggaagaagaggaggaggaagaggttggaggccattggaatgggggagcggagcagtgggaggaatgatggagaggagaggcgcccgagaggaagaaaagtgagaaggagggagaaggagaagcaggggtgaggggaggcaggcaggcaatcagccgtcgagcgagtggagtagtggctctgctttttctcgtgtgatggaggagggaaaggagaccgggggcggggagtgatgtgactgaatgccatggcaatattgggcatcttttggatgaagatgaaatgatcatgccatggaagctgacaggtggggcccactttgcagtgatcaattttggcctattggggtgagaggggagagggggagagaagaggctttgttttgatcttccaaagggggcccatgatgcagtgagtatgtatgtatgagcttctgaggtgaacattgttttgttttatctttcttctttggcattttatatgggagaattgtagggtttgtggatatacaagagaaggaggcccgtgaaatcgataagcaataatgctattgttatggatatgagtattttcaacacttcattataacgtgttgattcgcacggtacattagggatgagcctccgggggagagagagagcgaggatgaagtctagcggtttgtttggcagagctacaacttccaaatttagctttaggaggttggtctgcagtgaagctgtggaggagcctaaacctagcactctctagttcattttgtgagagagctccatccagctccgctcctattttaggtggagctgaaactgtttggctaagctccagcttccagagagatagagctggagttgagccaaacagacccctaggtgtctttcaatgcatgggttcctaagtgaagagagaatgttgtttatgatcgaaggcgaagagaattgaacaaaaaagttcaaaaattgaaccaagaaagaatttaagagatgttaccaccaagcaggaggtcaccatgggcagcagcgccacaacagggatagatggatcataggtacacaatgccagggacggagatagagtatgggagggggtgcctaggaacccagtcaaaaaaagttataactaccgattttcaccatatatgcacccccctaatacaaatttagacacacccatcagcttaaacttgatataaagtagagtaaattaagcaagaggcaccctcttccatttcgttctagctccgctccagtgccaaattaaagctctcatgctcgaaccaaacactattgtctaaggggtgatcaggggaacaagaggggtttcaacccgtactacccgtacaaaccagtggataccttttttttataaagacatgttcatatttgctaggtataggagaatgtatcgaaactctattcttctaatatattgacgtgcaattcttttgtgcgttcgtgaaaaaaaaggtataggagaagcttaatgatcgtagcataattagttcttttagttttctgaatagatacttataatatattcatgaatttgtttgacttctcttatatttaatccacttaattatatatattagtttgcttcgtttcattggcacctcctaaagtttggttatgcattcgctattggttgtctccttgaccacattcactgtggctacattttcccgagaccgaaatgtattggaggtaaccgaggagagatagagataaaggatcaaggttgatgtcttatgttaaattttcatagacaactctgtcaccactaggatagtgagctagcatcaccatatgttgggtttcaaattgcttattgctgaggacataagaagggtttcaaattattgtttgaccgttgacgagaacacgaggggtgaaaattagttagtatgtctgataagagcaagtttaataatatagtcaactactagctccaagtcaactatagtcaatataatagccaattcatacaatagttatctataagagcagatataatagcagactattagccgactataaacatattttaatgagataaaatatgagagagaaaagcagcagactccaagacgcagcgtgtgtagacaggtgggaccatatattaataatatagtaagcaactattgtatgaattggctattagattgactgtagatgaattggagctactaatgagctatactattaaacttgatttaaacatatactacactattaatacatggtctcacctatcatacacatattgtgtcttggagtccgtgctgcagctggctacagacttgtagctcgctgcttatctctcttcttttatcttctcgatgtgtgtttatagttggcttatattctgctattgtatctgctctaaatgatagtatcctgaggcaaattacacggcacaaaaaaaagtgatcaagtcgatgtatatgaacatacttgatgaaaattctaaagtgtagaaaaatctaattgttgtattatgttattttgtaatctattagattgaccctctcatggggtatatataggagtataaaggagatagagacttggagtataatacaaataagggtagatttatctctaggattctatctctaggactctattttatctctaggattctatctatataatttgtatttggctcttatctctaaccaacatatttgtacttctaacattccccctcagtcgtaacggaagcgaagcgaacaattacgactggatttgaaattttctatttcttcatcttctttgactcaccatcatcgattgcatctctcatggacggtcctccacctggtacctgcgtccccttatgtttcgtcccttgactctcctctattctccctcccgcaatcatagctagagtggcatggacgatagcgatgacatggacgctttgactgaagtttccgtcaatgatttttgttgtggacgttcatcgatgttgccgatcatgaagtagccatggttctaggtgtagccgcatgtagccgaaggcgaaaatttttttacgttgttgtgaagacgaaactgcaattgttaacatcttgcaccttgtagatgtcagaggatgtcattggggacgtcttgcatatgtcaggggatgtcgttggcgatgaggccaccacttttgcttggtccttctgtgccgtgtagtagtgatcacaatagtgataccgagttgatgcagtcgttgtcatcgtaaatgacgtgatcgatgtcgtcgtcgttgatgcggtcgttgtcgtcgtagaggacgcggtcgatgtcgtcgaagaagcgccatgctgatgtatctgtcagatgacgtgaggtgtccatctatatggacgagttggcggcaggaagttgatgaagaccactggtgacgtagaatcggcgaagacgatcgcgtagtcgtacaggttatcgatgcagcggctggcccgatcttgctgtagacttggcgatgatcgataggtgacgttggtcttaaagtagatcagtagatgtacatgctcgtagctgattagatcagtacaatacaagagtatatttatctctaaaattttatctttaggactttattttatctttagaattttatctctagtattatatctctataatttgtatttgacttttatctctaaccaacgcatctgtacttgtaacgtgaagtactaatgatagttccaacttccatgcatgtacttattcattagttagccaattagattccgttgccgaggggagcaatggaattcagaatcagtggcgttttgattcgtttgtcagggatacagagctgccgaacctggcccagggtatctcatgaaaaaaagaagggaataaaagccgttcattcaaaaaagaacgggaaggaaaaaaatcatattaccaaatgacatgtcgaccccgaaaagtgctgggcccacatgccagtgagacacggtccgtagtcgcgtgaagcaacaggtcaggtcaaaggtcagaagcgggtacactgggcgctactggccgtaggagttgtctgcctctccgagtccgggcagttgtacaattgtactataagccaatgtgctagtataccactagtctactctagatcagtacaggcagcgcactcacacacacatactagaacgcacatacatggaaaatgcattgctgatccagatacattctccggttgcgaaacacatggtgtactacgctacgcgaacgtgatgatctctttttcacgtagtactacacatacacccctctctgacaaagccaaagatgcaaaagatgacaagagtgaaaaaagaagcaaaagaaagacagaggagggggaaaggagagagaaacgtttgctgggaaagagaagcaaaagcaaccccccaaagatgagtgaagagaaaaagagacatgcatgcagatgcagtagtaggacatgcatgcagaggggaggcactctggtctctgccgctgctgctgctgctgctgccgctatctcgatccgtggctctcgtcttcctggccggccggccggccagccggtcgggggtctctctgtccctcactccctctctcgttctcttcccttgcattctctcgggccaaaagccgtgcgatccgctgggacaccggcgtgtggagcagggccctgccggctggccgcggcgagaaggggaatcatggccggatggaatggacgtgtagtagtagaatgatgcgtgttcgatcgagaggcgcgcgaacgcgagcttgtcatgatatgttccgcaaccgcgcgtgtcgcatggagtgttcgcggggtctgagttgttcgatcgtgtcggccgcgctagccctgcttcgcggctgctcctgcgtgccaatggcagccgcgaccggtgcacggcgaccgggctgatcggctaaagcgagctagcgagagcgcgactggtgctcatgcataaggtgacaagattaaaggtgcggtttcactagaagttgtgtcgtaccgggtgtatggctgtgtgcactgatcgaatttgtcactggttcctccctgaaaccgacagggtttcaggtgctgatcgagatgaaccaaaatgaacatatatgggttgcagtgtttggtctggctaccgtgttgcttagaagtaaccttgcatcaaccagcatcggtatacatacagacatgccacttgctgactttcatgcgggcaaccagcatcggtatacatacatacatacatattctcgttaactagtattcatcgaaccgagtaactttaagttagagcaaattaatactttaaattggacaaatgaaaaaaaaacatacatgtagattttctccaaaaattctttttttttaaaacaatcagaacaagatgagggcacgatgattcattgaatagtgtattaaaaaattgcaaggtcagtaccttagaaggcagtaataccaggaaaaaataccaccaccacacatcgagagcacctacacaaagtcaaagagaaggctagcacctgatcgaccatcactaaacgtgatcggtcaccgctagaccaataaaggaaggtatagccaggacggctcaaaaccaatccctagactgaactcaactctagccacgcctttgaaattgaggaggagagggtgagagaaaaaaaatggatccgctctccccctatggcccgtcaacgtggccaacttgcataagctaggacacagttgcaagaggataaaacaactagaaagagcttgcatcagctgccagagggaagttttggcaagggacctagatgatgtctccagcgagatgaacgatgatgagcaccaccgtcgccgtctattgaggtctcaaggaggaccaagataaggttttcacctggtagtcctaccagagtaagccatgttcttttttctaacaagagttggatgaagattaaaattttcgtggcacgtttttcaaactgctaaacggtgcgttttgtgtgaaaactttctatatgaaagttgctctaaaatgtcatattaatttatttttcaagtttgtaataattaaaactcaaccaatcatacgttaataccacctcgttttgcgtaaaaaaacttaattttcatctttatttttaagagaaaagaacctgctttaagttgccatatcttggacgatcgctacttaaaaaaagaagaattttcataggccctaccttggaggcttggactactaatatgatgctaaaagaaaacaacgtacattaatttcgcctacaatgatttacacaggcaaaatgtcttaggcaacaactcacattaatgtctaatagcataggtgtgccacaggcaaaatgtcttaggcaacaactcacattaatgtctaatagcataggtgtgccacttaaggtaatgcacgtgaaaattacacataagatggtcataaagaggcccgcctagacaaatgtgtatctgtgtatctttagacaatgctcctaattgtccgtccatgacttacacctttttattttcctcatgccactacttccactacctacacttccatcagtgatcacgactgggcttctcaaaattcgaatcacccgactcctctattgccacgccacacctcctcgcctccaactctttgcctattttccaatacatagagtgtaatgcaagtttttcgccgcaatatctccctctctctgcattctcttctatctctgccatattgggttcgagatgccaacactagtatgtcaccgttagcaaatacttttctctgtctcaaattatagagcactcctgtttctatgaaaatcaaactcgttaaattttgactaacaattacactagcaatatttatactaagtattatgcatactatatatttcaaaatattttatattatactaattttatagttattgataacataatattaaataattaataatcaaattatatcgttgaaaaccatgtaaaaaaatagatcttataatgtgatataatgtgagatagaggaagtagaatgtaaagacagagttgaacacaagaggaccgcctcgccccaacaccatcaccatcacacagaacatcgaacggggaactgacgagtatttcttcaacgggtcgcatatgctcaacttggtgtcacaattcaacaagctgaaggtgctagcaaatcatcaacacaaagttcgtttgaggcaaagacatgtgtcttttggttttcctcggttcatttccttgtggatgtaatgttcgtctgaattcacatatgaaaagagagaaaaattacaccgttggtgtaatttttagttgaagttagttcgttgttctctatgttcaggaggggtactgcccctgttgaatgatgcccaataaaatgtgattaacaactgagaagacatgaccaacagattaaccactacttttcttttagttattttgcatgatgtttgtagttcagtagattgttactgattgcttggtatagttatcaactcacaggggtacatcttcagataattcaaaaatcatacaaccatatccacaatttcatatatatgcataaacaaattctatacataaaaataaaattctattatgaattattcatccacataaatgtgtacatcgataggcaagcgcgtagcgcttattaattagtcattcatcaacacctacacacttatttatgcatacatgaataaggtgatctgaacacatagaacacaaactacacaagctaggaacacacaacaatataatctttggtaagcttcacgcgggtcgtgacgagcttacttgccatggccactgcccgcgtatgagccggctctggaccctgcatacgagccggagccggcaccagagcctccatgcgggccagcaccggagcccgcgtacgagccggcttccgagccagcgtacgaccctgcgcctccgccgttggagccggcatacgagcctgcactggaaccagcgtacgagcctgcgccggagccgccatctccaccattcgagccagcatacgagccagccctggagccggcgtatgaccccgcaccacctggccccgcgttcgagccggctcctgactcagcgctcgagccggccgatgagcctcctccacctgacctcgagctcgaacccgagcttgagccagaccacgaacctgacccagaccctgaaccggagcccgagcctgagccagagtaagacccggagcctgagccagagtaagacccggagccagagccgccgccaccaccaccaccaccaccaccaccgatgcccactccaatccccgagccgagtcccaggccaccgccggtgccgacgcccaatccgccgccaccgccaactccgaggccaccgccgaggttgacgcccaggtccttccttgcagcgcggccctcagccgcgagaacggccgccgcgaccaccgcgacgcccaacacgacgccggccttcacggaagccatatcgcgcaaacgcagacactctagccgtgcacacgcaggtgtctcaacctccggtgaccagtgctcctctgctgtactgctgtgtgtggtgtgatgaactgatggcttgatggattgatgagttcgtggtgggatttagcggtgaaatttatagggagcgcgcgcggttgtggtggtacgcatgcgtgcggtagctagcgcggctcgtcgtgtcgtaaggttttagtgggatttgcgtcggtgtcgcgaggttgtggccgcggccggcggagggcgtcgcgtagtggagcaatccggcctgtcccgcagatttgggcgcgctctcctcagcaatccgagcgacacgtacgtaaggcagaccggaccgagctgatcaacccatgtacgtaccgatcgatcaatcgtacgtcgatcattcgatccactaaacacggctagctagcttccaatcgattgaacgcacgagtgtgacgtattcgatcatgttggggcgtgtgagccaatgtaggtaaatctgtaggatggaatgcatgcagagatgagtccatgcagagcacttcagtttggattacggaagcttcgagagaaggcaatcgatctgaggactcgtgtcttttcatctctggttgaccactggcgctcgtactgcatgattagatttggtggtctccagctagctggtgcgccttgtcgttttctcttgttgtcaacgaaatccatgccacctggagtagttttgatttgacgaacaacgaccaaaccattagttctgcatatgggccgccaagaagcaagcagtgggccgagcttcaacttgacgggaaaaggtataccggaggtccctcatcttaccgccgagttacaaaatcgttcataaaccgaaaaaaacagatatatatatatatatgcatctcttaacttacaaaaccagatcactctaagtcgttagacggttttatccttggttttacctgacgtggcagttgagtcagcgtgtgacccacgtggaccccttcccctcctctcttcacctatctaactactgggtcccacaccattgttcacgctcagttgccacattcacatgccacgtgggcaaaagtagaaaccatctctttagagtggtaaaaaagagagcaaatctaaagggacatttggataactgccaaacttattagtgatgaaaattaaatttcctgtaaaaattagtcgccaacagctcatacacactaaaatgttactattccccaagaaaaaaggttatcgtcgaacacaaattgtgaatcaataataaaaagtttttataacatggccctggcataacccacaagttttttactccctccgtctcataatataagggattttgaatttttgtttgcactgtttgaccaatcgtcttatttaaaaaattttgaaattattattattattattttgacttactttattattcaaattattttaagcacaactttttatttttatatttgcataatttttttaaataagacgaggatggagggagtataacatggcattcatgaaaggaatttttttggcggggcatgaaaggacttcaatcttgacttacaaggacaatcttaaaaattgtagtaggtggtacgttcagaagaggtagatctctggtctctgacacgtaggtggtacttaaaaattgacgggatataaagaaacacgtatgaaacacgtatggatgagtcgatgcatgagcagagtattataaattgagataatttattgtatcggttttaccccgttatataatagacaaaatttaccacaggacacgtaaaaaaacgtgtaattggctgagagacaccgcgaaaatataatacggctgatggacactaaaaaagtataattagccataggacatcggtcgtattattttattatttccaggtcaaaagaggtgagatattttttaaatgcccatattgccccttctctttccttcttttcaccttcccgttgacttcgccgggaacgacacaacagccacagagagcgcggtggggtgaggtcagcacgacgagttgcgacgacattggcggccagggcggttgatggcatggcgccaccttggaggtgtggcgtctggccagatcgatggcgggcggttgacggtagtgccgatgtggcggggcgtggccgagtggaggaggagcttggccgggcagcggcaccaagcgcagggggaggcgccgacgcacggtggcctggcggcggtgccagtcgagctattctctcgcgtgcgctagctagagaggcggttggatcggagggagagcacccagaggccgcgtgcgccgacgagctgtgggcgacgagcccccatctccaactcccttatggccgtcctcgatgaccccttgtcagcagtgtcttcgccgaggccggattccgtagtggggacatcaagctcgccatcctccgcccagctccacccatgccgctcctcggccgcctccccacgcgcacccacccgccgtctctcttcctctgcagcttcgccaccgtggacgaccgacgtcccttcacatgttgtgaatctcgccagcgccggggaggactacgaagccgtcgacactcggtgggcaatccgagcatttcaaaaaaaatatcaccagtttcatcccaaaaatgataaaacaatgtttctagtatcttacagccaattacacaacttttgcagtgtccatgagcagtgtcacgtttttgcgatgtcccgaagccaattatacgtttttttgcgtgtcttgtagcaaaattttcctatataatatgtcacgatagtgtatcaatcatttctgtaatgtatcacatgaccaaattctttctcaaaatatacctaaaacatccttagaaatatagaaggctaacaattaatttatcctacaagaacttaaaaaaatgatatttttaaggcctccttgcacaacataaggatttgtatttgtttgtaagtttcaatatttttacaactataacttatcttttataatctacatacaatactttgtgctcattttttttaatgtaaatcatcatacatgtgctatacgcaatatttgcatggtactatcttttgagtaaacaattcctcgttcatatgtcacacacaaataactttaaaaaataaaacatgaaaacaaatcttaacccatatgctaaaaattctatgcaagaaggctaaaaaattcatatttttaaaaaacttctaacgggattaatcaatctacaatcttctatagtgcattttggccatgtttgagaaagtatccaatcagacgatacattgtagaaacaattaataaacttgatcaatggcatattataaagaaggcaaagttgatggtaaattattaaaccaatacaatgtcagtaatatcctacttcacttcttcttacagtttcttaggacacagtggctcgcaactggctccaaatgttggagatacataaaactttttaagagatagctacaacctactaattcttcatatccttcagcacgaaatttggatctatttgttgtcgctacgttggagtattataatgtcactatactgcaaagcacaaccatgcctacaagcaacttaggcgaagaaaacaaagagctataatctagcttaccttgttaaccacgatcaactggtcagtcgagttactaattgctatcttcccggagtatcttccatgcttagaatttgaggtgtttaggagggagctaggatggcacaatgaataacatattgcacaaaatttccaatgtttgcattttggttctccacatttcaagaatgcatgggatcggaccttcaccaaattagtcaattttatcacagattcagtgttaatcagaaaaatatatggtgaaaccacatgtagggtgaaaattttgaactttcttataaagttttcaaaagaatcacacatatgtcggaaatatgtaaatagacaaccatgcaaaattgcagcaacaaactcaacttcatcagctatataatactagaattatcttagataaatgtgataatttttttaggcgtcactacaaattagaccatcatgggtgtattaggtacagtagtatttaataattggtgctaaccaaagaatttctttttaaaaaagagtcagttttttaggctccaccccaaatgtacaacaaatatacacacggtctccaacccaaataatcaatacttgattttttttatatataaacatcttgtattatattatgatgaagatattttctacgaaaaatctattcattttcataaaaaataaatacccttaatttatatactgttggcatatataattaaatatataattaaggaagaaagttccactgaaaccgtacatttccaaacaagtaaattgcattagcggtaaacgaatttgttaggtgggtgcaatctagcgcatgaacttgaaaaacgcttgttttaatgcacaaacttgtttggtgcgtgcgaaccaaggccaaaatcacacgacaaggtttgatcttgctgatttttttatttgaatgctatgtaaacatgtatcttagaaggattcaaggatatcatgtagacaaagatctgtttagcaaaacatacaataaaggcatagtgattgtataaagaatgaaataaaaaaacaagtaataatgcaaggggtagaaacaaagaaagataaaatagaaaccaagtttacaaatatagcctttctaccatatgtgcatgcacatgatgtactaatttatgatgttcaacttagaagaattagccttttgtgtcgttttggccttagtagtgacgcaccacataagttcatataccaaaacaagcgttttataagtttatgcattaaattgcacccatctaataagttcataaaccgctgatgcaatttactctttccatacaaatcgttaaattaatctattatctctctataatacatctctcctattcatatatcatgaatgaaaatctacttgaatcttctttacatgatttaatcaaatgtatcactttttatttcacagacagcaatggaggcatggagcagtggacactctgaatttttatggcgattggcgacaactctccatgaacagtatcaactgggacatttaatttctgtcttaaatttcttttccaaatacgttactcttatggtgttattggtcacttcggactgtttgtctaacgagctttgttaccgtccatcatcctttttaagtacctcccggtacttgcaattggggctatccgttgagcctgatccaacggttcagaagcctcggtaccacaaggtacaagaatttggaagcctcggtactgcatgcacttgaacaggtggaagggcaaatttggatttttgacatagtgcatccgttttagtagagtccgtacggccgccggcaaccagctcctcccgatcccctccctggagcatcatctgcacagcggcgcggccaagctcgccggttgatccaagttagctggacacctctccgcctcccttattgcaacttgccgccgccacccaaccaacctagctccattttctgatgttgggcccaaaaaatcggtccgtcttcctcctgatgcagatggccattgaagatgatacaaactgctgaatttgtatcgtcaccatgagtcccgagggacaacccagaagacacttcatgcgagccttatgttttcaattttttacgcactctttcttttcttcctcttttttcattcctcccaagcaaaatctctagggagggtttgttttcttactcaccgtatcttttctacaagcaagatctgggccggggttgccgcaccaccacaactgaccggcgaacaacgtcaacgtccctgtgcgaaggccaccgcgtcggggtcactacgccaccgcagccgctgaacgaaatcggtgtcgccgttcgctgacgcgacacgcgtgagtgggaggataggaacgaatcgactagcagtcgccaccccgcccacactagtaactcgtttccttctttggaataccgatcatgaccctgatgacttaatggcttgatttcatttggtacctggcagtactagtaccttgaggtaccacttgatgatggaccgtagaaactctcctctaacatcttgacaacagaaactagaaagcaaacggcaaatgacaattagaacatttttatgatagtatggtaacgtccagaagaatcaacctttttttaagggaaaattgctctagacacacacttgagtgtccatctctccactttagcacaaagttgattgcaattgttattttgccacacactcgcggagtcatcgttttgcggaataagcaaaatgacatatttgcaaacgaaaagtaatttatgaataaaacttttatacacgtgttcttagtaatttaaaagcaaaggttgaaaaataaacttcgatgaaaaaacctcaaaattagctccaaatttaaaatttaaaatttaaattttggctgataagtataagcataagagcaggtacaatagcaggctataagccagctataaacatattttaaagagataaaggaagagagagaagagcagcgggctacagatctgtagccagctgcagcacggactccaagatgtaatgtgtgtatgacatgtgggaccaggtattaatagtatagtaaacaactattatatgaattggctatagatgatttggagttaatactattaagcgaaaagatgaggcaggtggtactcggtacatcataccattttttaaccggaaggtaacattagcaccgactctaccgcccatatatataaccacatgtgtcgggtaacaacaggcgtagctaccctttgccccctctctcacacaatttgactaaacagtggctcatcgtcagtcatcaccatccgcgcgcctagcttagctccaccggtgggctaacggccgtgccactcatgtccctcgcattcactgccgctatatgggctgcggcggccggtctcgccggccacgacgacgacgagcttcctgatcaggcggctgcggaaaccacgccgctcctcctgctgatcctgtctatcacttacttcctagcggtcgccgtgatgtaccgcgagctggccggcggcggcggcgtcaccgtcaccgatcagaagcaggacacggtggtaagacgagacgcttgctagctctcggttgctccttagtacgtgagtgtgtgcacgccggccgatcgacgtcgcggcgacgcgtatagctatatatgtgtactgacgcgtataggtatgtatgtttgattgtatatgctagagtgagatttcgcgcgcggtagaggttacttcgtttttcttttattttcgtggcttgtctgaatgtgaatcggttgtgagacgatgatgtattcgcccgtttgtatatgtttggcccaattgcgcgtttgagtgtgtgcaactgaaatattattttcgttttcatgggttgattgtgaaccgtgatgctttattttgtattccatccatccacaaaagttacacatatttcacatttaagtttttccaaataagttgtttctatttataatctttatgcattcaagacttagatgaagagataaattaaatgtttgattagaacccaaaaagtcatctaaatatttattggttgcatggttacattcactctttaaatttataacatccaagatgatttaatttctttttgattttggtgacaaaagtaatatgtgtaacttttgtggatgtggatggagagagtacaattgtaattctactggttaaaggatttgcaattataccgaatagtagatctagggacgagtataattactagcgtaatacgagtgtcaagcgacaagaaataaagacaaacactcgaaaagttggaacacatagtaaaaaaatcagaagaagcaacgatcgattgcttaatggctgacctgaagtacgtatcattgatttgatcggttacttatgggccaggcaatagctaatgtaacaacttagtactgtatattgaaacgaattccaggtgtcaggcaacacgggtcatagctggtctggctagcccaccctacctaatgggtaggtccgcctagatgcggagctaaaacgagatggagaggatgccacttgtttaatttactatgttttatattaaatttaaactaatatagatgtctaaatttatattgggagagatgtacacatgataaaaaatatgtcagatataggactggttcctaggcatcccctaaatactctagctccccctaggtccacatcatgttattttgtggcaacttactctccggtaattcaaagaacaacacaataattatgatactcgttttcaataataaacggacatttatcctgctaatatcgtcaaaccagcacaatgttcagtaatgagttttcatcagagacttcttctactctctctgtcccataatataaaaacatatgaccagataaaacatttcctaatactatgaatctggacatgttacatgttcagattcctagtaatagtaaatgttccatttgattctagattcttatattttataacgaagggagtatacttttaaaatgtttttgtcggaatagttttctagaaaaagcacaactatttttgtttctttatagttttctagaaaaagcacaactatgtttacattttcaagaaaattatagccgtgaaaatttaaggctgtttaccgacccgtcttcaccccctacttccacaaataattgagagcaaaatggactgatggcaaacatcattcgagtattccagtagattggaaaatgtgagagctatgaagctaggaatatatatatagtattaatattacggatttgctgaaaaagtgtctccatattttgtggctgagtacagtcgaattttaacggctggaatgcgctgtgctggacatcgtgtgcacgatgcacatccgtttctccacctgtttatccctttgtaatttttttactttatttgttgatccggaattgctatgggtttgtagcagtcaattttgttgttgtaattatgtatttatacaaatttacatactagttacaccccacttacaaatcacttatatatgtaattttgagatttacatatgtaattttaagacttacatatgtaattatatgtaattttaggacttacattgtaaatatactaaaattacatatgtaatttagagatttacaatgtaaatacataccgaatattttttgataaaaaatatggtgtcataaatatagctagtcccttaatattatccctcttgctgtccaaatcaagcttaattagctcggacaagagtcccgcggttaccagtagctttcgtgattattattcttattccatccagctcgacgttacatcatttttctaactgaattggttgcgttggtaaattacccgatactgactaattgactacgaacacttgttcttttgctatctaacgtgtactacaatctgctgtgaggttaagttagcaaccaaataccaagggggggtgcgcactgcgcagtgatgctggcccgttttgacagatcgggccaacatgacagcattgaccgaaacctaaaaggaataagttcactttgagtccctctatttgccaccaggacgattttcgtcccttgaccacaaaaccgggtatgacccgtcccccaacttacgaaaaccgtacagacgagatccctcagcagttttgaaggtggttttggctgatgtgacgcctacgtggcttgtttgactagatattcgtcacacgtggcattggcgtgacgtttacgtggcaattatatctcgaaaaaataataaaaaacatgggacccacatgtcagctaaaaataataattttaaaatggtggccccacatgtcagctactcctcccttcttccccctcccttctctctcatattcatcgtcctctcttcttcatgtgcgcagggggaaggaggcgaggcgaggcgacgggaccatcccccacaccgacaccacccccagcgcgccgccaccgccggcatcttcgtcttcctcctcgccgccgccgctgccgctgccgccagcatcttcgtcttcctcctccgccgtcaccgcctacatcttcgtcttcctcctcgccgccgccgccgccgcagcaaccgcagcaagcaggccggcgacgacgacgtggagatggccgaggggaggaacaacaaggtcgccgacggcggcagcaccgatgactcgacgaccagcggcaaggcggacaccaaggtgtagctctggcgtctcaatcgatccatgagcgatcgagtagctcagtagcatgcaatcggctaagatttcctgcatgtgttctagtactacaagtaataatattagctagcctaaaaggctaaaacacataacgtgcatgaaaggaaagtactatcctaactgaataaaacagcttttgcaggcacaagtttaacataatatgtctgctttgatctttatttggaagttgtaattaaccatgtttgtaataacgagataattaaacgagagtatccatgtgtcaagaggtcaagcgtgacctctcccacaccgtccatggcttccccgccgatgagcaccacgtccgggaggtgattgcgctcacgctccactcctgcgcctgcgtcgcgtcgctgtcgcgctgcctgggcgtcacgctcaagatgctggtgctcgtccaccgtctcctcgccgacggcgacccggcgttcgagcaggaggtgttctacgccatgcgccggggcacccgttccgtccacccccgccccccagcgccgccacgatgtcgcccgctccagccggcctcctcgttgctcggccgccgtgcgccgttccagccggcctcctcgtcgctccgccgcccatgagcgggagagagacaagagggagagagaggggacagagagaagaggttgtgaggatgacgtttgggtccacatgggcccacctttttttattaatttgtgtgtgcaactgacatgtgggcccccacaagttttttcggatttaattgccacatcagcgccatgtcaataacacgttggacaaaaatctagtcaaaagaagccacgtcggcgccacctcagccaaaaccggagtcaaatactgacgagggaccttatttaaacggtttcgtaagttgggggatccgtcgtacccggttttgtgattaagggacgaaaatcggactgggcaacaaataaaggaacccaaagtaaacttattctaacctaaaatggccgccctggcgccaatcgcggatcacagcccaaggcctagtgcccacacgatactgggccgagctttgccggattccacagcccaccattagcacctacccaagaacaccgtttacaaaaagaacaaaaaaaaaacacacacacacacacaaacttacaaaataatcgattttatgatataggagttagggaggaggaagaagagaagaactagaaatagtgttctcttaactcttaagcatgaatgttagtaaatttgggctgttggcccaggtgacacctttagctagtagacaatccatttaattgaagacgtcatcacgttccatgtattcactaagtagagaaggatcaaatcaatagttcaatataactggaagttacaaatcatacaaggacagcctcatcgtcaaaatcgttctagctaaccaggcacgaagcatgcgcctggggcacaatacaaacaaccatgccaacctctacaacctgaacacacatatgtcggactcaagcagagcattctctgcgacagcaagcacactctagcgacagcgagccaacaagaaggtgggcacgggaagcatgctcgggtccggagcagagaagtaggcggcaggaccagcgaacggcagcagcgccggcggcggcttcaccactgtctccgtgtgaggcttgctgatcatctgcgcactcgtcgtcgtcttcatcgtgcggcttgtggagttgctcttcccgctgcagagagcgtagtcttcctctgggcgaggcttcttgttgatgtcccagcgctcggccgacgacgcgcggctcagcggccgcttgctgctgtcccagcgctcgacggagtcggagcggcaggcgctcccgttgctgccggtcgacgacgcagggctgccgggtgtcttgtgcgcgtcccagcgttcgcaggagtcggcgcgcccggggctaccgccgctggctctcgacgacgtcgacgacgaggctgccgagccgccggctttcttgttcttgtgcgcgtcccagcgttcgcaagcgtcggcgcggcaggggatcgcgctgccggagctagacgacgacgacgacgctgccgaaccgccggctttcttgcgcgcgtcccacctctcgacggcgtcggcgcggccgggcttgggatcggagaccggcggcgcgcggaaggaggcggggaggatgatgaggcacggcgtcgggagcagcggcagcatctggctcctcagcggggtcgggagcagcgccggcaacttgctcgcgggcggcgtcgggagcagcgaagggagaaccgctgccgccatggctagctgctcgaaatgtcacgaagagggagatagttgtacgtgccgcgacgcgaagcgatcgaagcaattaaccggagacgagagcgcgcgctggaatcgcacgtcgaattgatgggctgcgtcatccacgcgcgcgcgccttatatcctcgcgaatcaattcgactcccattctgattcggagttcgcaccgccgatctccgatcccttcggaagtcggaataccgcagaagaggtgactccgtgactgggattcggactggaaaacaatgggtcgaactcgggccgctgtggcatccaggcccatcttatcacgggccgttccttcgacaggccactctttaggcccagtccgtgccggcccacatttgccagaccagcggatcgagttgctgacatccagtccaacatcggaaaattgaaatgctctcttttttttttctttgtagtgcattgaactgaatcagccaatatgaatatgcatattgggaatgctatttgacgcacgtttgctacttatgattctagtgcacacttagaaaaaagagagaaagaagccgcataccaccccctcgtgcggcaggcaggcgttccccatcaatcgattccaaccgtgactccgcgtgagtcttcacaagtggtccgaagtggtttttccttaaatctgatggtaactttcaacccaaaagtcctgaaatttttaatttggattggaaaaactttcaatccgaaagtatagaaacttccattttgaattggaagaactcccaaatcgaacttcaaaagactttttaattgaagatctgaaacttgaactaaaaattcaaaaacttcacatccaaatccttaaaattttgaatgaaaattctcccaattttcattccaattctcccaattctcccaatggagatggagtgcacccccggagactatacaatatcctgaatccctgactgcacctgactttcgcagaggtgctccctggaacggtggtccaggaagagggaggagaggaggacgatctggtaggggaaggggaggacgtggttggactcccacagaaaataaatgggaaacggacgatgagctgatggatactgcatcgagtccagtaaagattaatcatggaccgaccagatcttcgtcttcaagcaagagaagacttgatcttgaggaggaacaccaaaaagatgcaaccagtgatattctgcttctggaatcatctgagatggtggagaagaggacccaaggggtacaggagtctggtgacgagatccaaaagatggaagagttcggggcaacaagtagagatgtcaagaaacaaaagatggagggttcaagtaataattctgatttggcaacatcggcgggctccttggaggagcatcgccgggcctaatgtgtttttaagctggaactgtcggggccttgggcgaccccgagcagttcaagagcttgtctgcatggtgcagactcatcgcccaaaggtggtgtttttatcagaaacacgacagaatcaaggttttgtggagaatattaaatggcaaattggccttcgaggatgtctggctgtcaatggtataggaaaaggaggaggaattgccctgttctgggatgaaagcgtaaatgtgactatcaagtcctacaatttgagacatatcgatgcagttatcacagagcagaatcaggatccttggagagctacctttgtttatggtgaaccaaaggctcaagatagacacctgatgtggacacttctaagaagaatcaagcaaaatacaagtgatccttggttaatgattagggatttcaacgaggcaatgtggcagtctgaacacttgtcacaaaaccgaagatctgaaacccaaatgagagagttccgatctgttctatcagattgtgatcttcatgatcttggtttccatgggataccttggacttatgataacatgcaaaggggcgaccgcaatgttagagtgagacttgatagagcagttgcctcgccaaaatggaaagattgattcaaccaagcagttgtgacacatcctacttccccgtgttcagatcatgcacctctgctactgcagaaggaagaacatataagataccaacgacaacaaactatgagatatgaagaagtctgggagagagagtcatccctcccagaggtcatacaaagtgcatggagtgatggcaacgctatcacaaatttaggcgacattagtgcgaagatgaaaaatacaatgtgcaagttatctagatggagtaaagagaagatagggaatgtaagaaagaagattgctgccttacgagacaagttaagagagtgcaggagcatgggatcccttgattccgatgtccaagtccgacaaataaaaaaagaattagaagagctcctgcatagagaggaaatctggtggaagcaacgatcacgtatcatgtggctgaaggaaggtgatcgtaacaccagatacttccacttaaaggcctcatggcgatccaggaagaacagagtaagaaagctaaagagaaacgatggcatggccacatgtgaaataggtgaaatggaagagttggcacacaatttttttcagcagctatatttgaaggatgacagacttaatcctgagaatttattaagcttttatgcacaaaatattacagaagaaatgaatgggaagttaactgaaccgttctcggaggaagaaattagtgatgcactcttccagatcagaccactaaaggcgccggggccggatggttttcctgccagattcttccaaaagaactgggggatacttaaggaggatgttgtcagggcagtgaaaaatttctttgttgatggacagatgcaagaaggagttaatgacactgcaatcgtcatgataccaaagaaaagcctagcggaggatatgaaagatttcaggccgattagtttatgtaatgtggtgtacaaagttgtggctaagtgtctggtgaacagattaaggccactgctacacgatgtgatttctgaagctcagagtgctttcgttcctggaagactaatcacggacaacgctttaatagcgtttgaatgctttcattccatttagaaatgtaatcgtgagaatcaaaacttctgcgccctgaaattagatctctctaaagcttttgaccacgttgattggcaattcctagatggtgtgatggaaaggatgggcttctgtgataaatggcgaagctggatcatggcatgtgtgacttcagttcaatacaacgttcgtttcaatgggcacttgctagaacctttctctccaacgagaggtcttcgccaaggtgatccattgagcccctacctttttctgctagttgcggatggtttatcaaatataataaagagtaacgaatctgaaggtctcattcaacctttgaaggtatgtagaagagcgccaggaatttcgcatctcctgtttgctgatgatagcttgttattttttaaggcggatactgagcaagctagcagaatcagagatgtgctacaaatgtatgaaagcagcacaggacagcttattaatccttctaagtgctccatgcttttcagtgacttttgcccacagcaacatcaggaggacataaaacgaatcctgggggttactaactcctcttttgaggagaaatacttgggactcccaactcccgagggaaggatgaaagctggtcagtttcaaccaatcaaggatagattatccaagagaatgtcagattggaatgaaaaatacatgtcttcaggagcaaaagatgtcttgataaaaagtgttgcccaagctctgccaacgtatacgatgggtatctttaaaatgacagacaagttttgtgaagaagtatcccaaatgattcgcaatttctggtggggtcatgagaaaggagagaagaaagtgcactggatagcgtgggaaaagatcactagcccgaagatccatgggggtttggggtttagggacatgaaatgtttcaatcaagctttgttaactaaacaagcttggaggctgatcacaactcctgagagtctttgcgcccgagttttaaaggcgaaatacttcccaagtggaagtctgctggacacagccttcccgacagtttctttacctacctggaaaggagtccaatatggtnnnnnnnnnnnnnnnnnnnnnnnaatttggagaagatggtggcacagggtgagcgagtcaatgtcctgtggaaaaatgcaaggaacaggctaatctatgtgaatgaactaatggaaccggggttgaaaagctggaatgaaaacctagttcgtcatgtgatgaagaaggatgatgccgaagaggtcctcaagatcaggttattggaatgccaaccggatgattttccagcctggcatttggagaaatcaggactgtttaccgtgaagagtgcatgtagattggcctggaacttatctaatcatggtaggtcagatgcctcgtctagcgatgcaccatcgggtgagaggaagatatggttcgttttgtggaagacgaaagtaccagcaaaaatcaaaatctttgcatggaaattggcacagataggttaccaacttgggacaacaagcgcaaaagaaacattgaaagacaaggtatctgtcaaatatgtggatctagtgtggaagatggttttcatgcaaccgtggcttgtccgagagcgaaagcgttgcgtgaagctattagggaaatctggcacttacctccagagaataagtttgtaaattcaggtccagattggttgttgctattgttggacggatcaaatgaagaagaaaaggctcatacgctgttcacattatggcgggcttggcattgcagaaatgaaattatccatggcaaggagatgagccctatagcaagctctgtcaactttttgatgaactacgaagattgcactctaatgactcggcaacaacctgatgatgtgaaagggaaaggaccaatgtttgtcgagacacacatacaacgacagctgaacgaaaagcaggtgtccaagtggcaaaccccaccagaaggtgtagccaagttgaatgttgatgcaggtttcaaaccggacacaggtgaaacaggcgctgggataataattagggagtgtcgagggctcgtgctactggcttcctgtaagaagctaccgcgatgcagttcggcaatgcaagctgaagccttggcgtgtttggaaggtatccggctagctactgaatgggtgaatatgccacttatcttagaatcagataatgcaagtgtcgtcgctaagttaaacgcgaccaatgtctcaagagcagattggagtggcataatttcagatgttaaagcggcaatgttatgtttagttcaggtgcaagtgcacaggataaagagagattctaataagatagctcatgctttagctcaactggtaatgggatcaggaactaatgcggtctggagattatgctcccctgcagaaattcttgacctcctgaaccaggaatgtaaccctttgttttctcattaatgaattctctctttactgtcaaaaaaaaaattaattcaaacttagacccccaaaacttctaattgatgatataaaatttttaactcagaaggcaaaactttgtacttcaaactccaaaactttcaattgaatttaattgttgtccaccttgttgccatcggtgaggatgagccttagggcttgttggcgaggagggaagaaacaccgacgccccaccaggaggaagaacatagacccaacttgctagggataaggggatatcaccggaatcttgttgaggtatggggagcaacacaccatgaggaaggagagcccggactaactaacatatcgtcgaagagaagggagacaagggtaggccttgcggccgctcgccgccatcacaacaaggaggagcaataaggtggggagtactggttgaaacttccgtacaagctcgtcaccatcctgccgaggaggaggaaatggatggggagcggcaatggcccttccgcttttcgagtatgcaaacaactggtgggagaagccgagcctaagcatgacactgtgttgagggggaggagatgaaggataaggatgttcgtgcatgggccaagtgttctctcgggacaaagctgcacgaattagcatttccatatgaacatggccattctaattggatttaattaatcaaatacgattatgaacatgttcattcttttttttttcattgtagtaaggcatcaaaaattcaatttttgaatcattgtctaatcacaatattgagggggatattttcttgaagattagtgatgatgatgcaattgagtgtttctatggtatgaaaacacactgttaaatgttatccaattcaattcgttgtgttatttaagacattattcaaactatttttactgttcttttgatcaaaagttgtagcttgggctatattttattacccaagttttattttcgatcgctatttatcccattttttttactttaaactagataagtttgttttttaattaatttggatcaccccaaaccacttttttaagcacatcaactatatttaacacattgactccaacataccggataaagtctctcacccatgcacaagccatatctttgcggggggagtggttagacacagctaaagaagaaagttgaggtggtctaaagtgtaaaaaaaaaagtaaaattaactacttcatagtgaaaacatatgtcaatgagttgtgcaaagtgaaactttggcaataaaagataatgcaaagtataactcattttgataaaaaaaaagaccttaattctatttattttgcatgaggattttggtttgactaatcttaagatttgtggaggcacacctagcataataagaatgaaaataaattaggtgaattccatgaacaccaggtattatagtgtgagttacataaaactggaggggtttttgttggttgcacaaaatatataatggctttatagttcataaaaccacaccattaactattttcttttatatactatacatatgacttacaagcttgtaaccaaaatatatgagttattcaaattcaacgcataatgttgcagccatctaaacttaattatttgtttattttgctacagtattaggctaaattggttaatatatatagtggttttgtgaaattttagaaccatgatatgcgtgattttgtgaacctaaactgctagacaacctgttgaattatgacgtcataatgttcgacgtaatcactaagtactgaagcttcaaaacaatggttcaatgtaactggaagttacaaatcatacaaggacagcctctagctagctaacattacaagtaccagtgttaattgagcacacgaagcatacggctggggaaccatacaacaaccattccaatctctacaacctgaacacacccatgttgaactagaatctagtactgcgtagaagcaaagcattctttgcgagcaagcacactagctagcgagccagcaagaaggtgggcatggaagcatgctcgggtccggagcagaaaagtaggcaggaccagagaacggcagcagcgccagcggcgccttcaccattgtctccgtttgggacttgctgatcatctgcgcactcgtcgtcgtcttcatcgtgcggcttgtggagttgctcttcccgctgccgacagcggggcgaggcttcttgttgatgtcccagcgctcggccgtcgacgacgcgcggctcagcggccgcttgctgctgtcccagcgctcgacggagtccgcgcggcaggggctcccggtgctgccggtcgacgacgcagggctgcccggtgtcttgtgcgcgtcccagcgttcgcacgagtcggcgcggcctgggttcccgccgctggccttcgacgtcgacgacgaagctgccgagccgcctgctttcttgttcttgttcgcgtcccagcgttcgcaagcgtcggcgcggcaggggatctcgctgctggagctagacgatgaagctacagaatagccgggtttcttgtgtgcgtcccacctctcgacggcgtcggcgcggccgggcttgggattggaggccggcggagcgcggaaggaggcggggaggatgatgaggcatggcgtcgggagcagaggcagcatctggctcctcggcggggtcgggagcagcgccggaaaattgctcgccggcggggtcgggcgcagcgcagggagaaccgctgccgccatggctagctagctagcttggcgagatgtcacaaaggagagagacagttgtacgtgcggcgaagcgaaccggagacgagagagcgcgctgtggagtggaatcacacgtcgaattgattggctgctacgtccccgagcgcgccttatatcctcacgaatcaattcgactcccgttctgattcggagttcgcaccgccgaggcgccgcgatatcctctcctcggagtaccagtgttaccacagaagtgatgactccgcgacagagattcggactggaaaaaagtgggccggccgtgacatccaggcccagttcgatatgggcttaattcaacaggccgtagtttaccacaatctgtggctctgtgccccggccacattcgccagaccagcatagtcactgacagtccagtccaacatcggaaaccggttttttttttgctttgtaggctttagattaaattgaatgaaccgaatataaatatgaacatggtaattctttttatgaaacctgagccagctttgctggttttatattaaaaggggaggaaactgtacagcaacactaccgataacggtgagaaacaaaggaccaaaagaaaaaacagaggagacgcatagacaagagggagcagagaggaaagcagagctacaaggatcacgggaaggctacagcactaatctcgctaaatcttttgccccgcatcctatccatttgttgatttcatccatgatcttcgtcagcaagtgtggcattgcgagttctttgtttttgaaaactcgccggtttcattcacaccaaatctcccaatttatcatcatgtgaaagggagcacatcccttttgttttgcccttttcggtttggttagctcttctttcccaccaatccagcagagtctcgtcgtcgttgtgtggcgtagggatgtgattgtggtttagtcttaaggagaccttgtcccacacttcctttgtgaaagagcagtccttgaagaggtgttgtgcagtttctaaatttctgtagcaaagctgacaaaaataattgttgggccattgccggcgttgtcggcgatccgctgtccaaatccggttttgcagcaacagccatgtgaagttcttgcacttggacggcgcccaggtcggccagattaggttggctgctcttgatccaattctgccactgaattgacccaaatatgctgattttgctgaatatttgccattgtttgtctatctccaaagaatagtgtcttcggttttatctgttaaggtaatttcaccttcccaaatctactggtagactttgatgaattcatgaactagtgccaaattcagctcgtgccttatgtccctgatccactggttgtcgattagtgcatcgcagactgttcgatgcttccctttggagtggttatatagcgctggtgcgaggtacttgagcgactggtgtcccacccaattggattcccagaaatatgcttttctaccatttccaattgtcaccttggttgttgtagcaaaaacttccttgtcaagatcatcacaaggtggcggtgttctgatccacggtttatttgggcattgccaccgaaacaacatggtaattctttatttcattttagcaaggaatcaggaatttgattcttgaatcattgtccattcacatttattgagagggatgtgtttttaaagattagtgacgatgatggaatggagtgtttctatggtataaaaacgcaccatgactataaatgttattggattcaattccttggttatctaagactttattcaaactatttgtgctgttattttgataaaaataaagaatgtactgctacttgggctacttttattgcttaagtttcactttgaccatcattagtttacctcatctttagttaattttgtttgcattgcaatttgaaccaccccaaactactttttttttaccacatcaacaaccatgaacacatgggctgcagcacaccgataaactctctcactcatgcagaagccatgtaaactagattgaacgcatcattagatctacacatgtaaactaagcagtaaaacatgaacatatcaaatatgcgcaacatgtcgaacacgtaccgaggtggcggaaagaccggttgctcggcaggaactactcgcggttgcgagcatcgacgaaggcgcgaagcacgcgagcggagaggaaggcgagccgtcgcggacgaacagggagcagttgcgcgaagcgcttcccaaaaaccttattgccgccttctcccggtgcaggacgtcgaaggcagaggttccggagacctgctcttccgatcgccggtgcaagccggcgagcgggatggagtagtctacgagcgacggcgcagtacagagtaggaggaaaaccctagattgatttcgcgtgtgttgcgtgaaggcggcggctcggtttatatagagatagatcgcctaatcagggcgcccgtgtaaaccgaaccggataagtcacgcgtaacctatccggactccatgccgttttcacgcaccggattttttgaaatgtttccaaaacaaaacaaatccgaatttcccgtagcaaaacaaaactgcaaaaggaggctgcatctgcgcaagggtgaggagccaattttgcggaccattcgacgcgtacgtcgtgcacacgcgccgcttgccctaccctgccaggccaggccaggcgaggcgaggcgaggcgagtgagcgcgcgcgtgtttcccctcttctctccaccacacatgcttcaagtggctaggagggcatcctcccttttaaggaggtccccctctcctagaataagcaaggttgtactaaactccacatgcatgccatcccatgaggtgggtttttgtgattttccaaagaattaatcttcgaatgggccttagcccatctattaattccaacaatcccccaccaaatctcaaaatccctcgtagatttgccttttccaatgtactgtttatataccagctgttcgatggagaccgattaaggttgaacatccacctagaactccaagctacacttactcacaacttgaacaatggactacgccttgaattgcaagtcttgtgcaagcaagtttcactcagagtcttatctggtcctagaccgactgtagactaccccttgggtggagcgtataagtcatactcctaggtctttagtaagcttcctagaagattcacccaaaatctccatagactgcaaccaacagtcaagcttacaaaggtgagttctttcaagaatgctctgcaggacagcatcttcgctaattaaagccaacagaactcattaaggcacagtgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaaac

SEQ ID NO: 74539 - DNA, 31173 bp, Oryza sativa
  unsure (1)..(31173): unsure at all n locations
atgcgcatacgacactgcaccatccttcttctcccttacaatcaccctaccagcaacagtaagatcacggtcgaaccatgtgtaccacaagccacctccataagtttggaccccaacctcaagataacctccctttgttacctgcgtggcaagaagcaggatttaatcgccaattcatcgaattgtaccacgccaattaacataaacagaaatcaactacgaagagttcaaactctaaaccttggagacaggcttgagcttcagggatggactgtcagtatgcgcaccgattatgtgaaacccattgccggcagcatacctacaacacatcaacataatccaataataaataatgcactaatcaggacattcatgatccacaaaaccgtatagaattactacagataagtttcttcacaaaaaaaaaatagaaaaagtatgacaaattaaataatcctatagcctcgagcaatccaaggagtgtgaggacaaggtaaaagtggatctagcagaggctcacttggcgccgatggcgaaggcgacgatggtggagtggttgcgcgtgaagaagtacttgcggccgggctggagccccgcccactcctcccgctccgacagctgcgagaaccccgccgccttcagccgccgcttcgcctcatctgagacaacacattcacagtccagtttgcgtcgatcgacaccaaaggaggaagaaggaagggaaataggaatcgggggggaaggggggcgtaccgacggcgtggaaggcggtgggggaggcgttgaggaagtcgacgaggtcggagacgacgggggcgacggcgacggcggcggaggccatgggcggcggcggcagtagtggatcgatgagtcaggtgtagccgccgactttggtatgcagggatcggtgtagggctgtcaaaaaaaaaggtcgaggctcagcgagcagctcgaggtttcgagagccgaacccgagcctgagcaaaagctcgcgagctttaccgagccgagctcgagctttatcaagcctggccgagcttgaccgtgcatagtttatattgcatgtttaccttattaatataataaactaatagataaatatatatattagtatctatttacacaataaattagcatatgttagtacaatatatttattttaattattttctactcttttattagtgtgattaactaaaaaataattatacttatcaagagattattattaaaatatatattatactacttatggccgagctcggtagccgagctcgagcttgaaccgagcttgcctaaaagctcgaaagtgcagtaggctcggctcgagctcggctcgagcctgtgtcgagctcgagcttgggcagacgagcttgctcgagctcggctcattgacagccctagatcggtgaatagttgtgtctatgtattgtacccgtatatactatgttgtgtccggatgccccttttcccatcatctctccctatgtcttttttttaaaaaaaagtttctatacgaaaattgcttaaaaaaataaaattagtccatttcaaaaaaaatagcaaatacttaattaatcacgtgctaatggaccaatccgttttcgtgtttgtgttgggaactgcctcccgtgaagatagcgttcttttcccctctttcccaactcacttgcctcatttttcacgcgcacacttttaaaactactaaacaatatattttttaaaaaaaaattctatatgaaagttactttataaaatcatattaatctatttttaaagttttttattaggctaatacttaattaatttcactataatcgcgtgctttgttttccgtgtcgagaggtgcccaaccttacctcccgaacatagcctaacttgtttatacggggataatgttcctataatttttggaatcagaaaagaaaatcaaatggagtcgaatattatcgaatactgatacataatgaatatgagttagaatacgggcacgaatatttatcggaacataaagaaagacctttttaccattcttacaaagtcaacaaagaaatataggcagttttatccaaaagaaaataaattcgtggtatatataatatgttattctaaattaggctctttggttttctagattttaataaaaaatataattgtaaatatgaagttgtattcaatattcatattagaatctcaattttaaatgtaatttgtttcatttcaaagttattagtaatgaacaaatgtaattgacatggacacttcttactctttttaaaataataaggtattccattaaaaacaaattatttgatatattactataataaataatgtttttattatagataatagtaccgaatatagtgtatgatttgtaactagcaaatatgacatactggatagctgcataccttgtttctaaaataaaattatttaacaaatatgttgggatagagatgtgaacctaaagatggagataaatggttttataaagctatccgaataactatttaaaaattatccatatattttctaaccatttttcgttttcgccatataccaaccttactgtatctttttctgaaaaaaaaaatctaaattcgtttctattgtcaaaactatcaaaaaataatatccggccgacattatttatttccgaaaaagcatcccagtattataactatctgaaccattttcatccattcgtatattaatggttttaacagatggcaccatttacgtattgatacaggttgaaccatttgttttatagaaaagtaaaatgacctcgatatcgcttagagaggaggtgaatagatgatttaaaatgaaatacgaaagctaaagcgaaacatggttggattatgatactaggtcagattgtcggaagtaagaacggaccatctgacctgtagagcagcaatacaaacaggcaacaacattaaagttgatccaatccacaagtaaggaggcgaggtcaaacatcactacattagtgtggtagaaagcaattcaacaagaaaggtaaagggaaagaggatatcaccaaggtttatgtaacagtatatttttcggagttcaaattcttgaggggattctaatctctgttaaggagctcacaaatagtcaagtcttttaatctgggttgatgttaccaactgaaagtaaagatcctccggcattagtctcggtttgtgtttccaatcggtactaaagatgcacttttagtaccggttggtaataccaaccgagacaaaatgttttcagggacttggacttttagaaccagtactaaaacatttttagtaccggttctaaatctagctgagatatttgtgatttttgataccacgatgaaagatcagttgttaagtattggtagcacatgcatgtaatggctgttcatgcaaactgtaaagtcacactatcactgaacaaaaaaaaagtcaaatagccggagagtattgttgagaagaggccatatttcgaatgatggaatatcgaagtgtttggtcggtccggatgctgatgtaattagggatgaaaacggtacgaaaattttctggattccggatctattttcgaaaacagaatctgtcggtcagaattttttcgaaaacgaaaacgaattcggaaatattttcttggaaacggaatcgaatatgataggggcagtttccgtcggaactcggaatcggtcggagacttttcgggaaatttctcggaatttccggaattacaaaggcccataacatagtctataattcctccctagcccaacccaatttagcatcctaattcctatgtcactcaattcagcccaacccaatacacccaattcaaacttgagaattgaacttgacatgattgtgttttgtgatgtaatgttgaaatttgagacttgagaattggatttgacatattttaaagcttagtttgaggggttttttattccgatatattttcgttaccgtatcagcaccggtcagttttcgctccgttttcggttttgacaatatttaattccgttttcgtatctgggtttccgattctgattccgaaaaaatatgaaaacgaaaacaaaaaatatagtttccgccgtttttgtaccgttttcatccctacatgtaatgagttggagcttgatatcttttttttactgatgagtcaaactgattcaaccagtgaagaacatgagcacgggttgttttattgtttggaacatgtattacgagcttaaatgctcatactatgtaaccttgtggttgcatatatcctgcgggatgtagaggccttttttttttctcaaatccattatctaaaaaaataatgactgatccttaaaacatagaagaaccattttagggtgtagcatagagccacggcaaatcataacagttgattatgtgtgcttcatttctaataaaaaaacatatgatctcccttcaccaaatacatgatggttaaaaatgcaaagtatcataagtatctttcctaaattaattatttactaatgaagaatttatgatttaggcaacaaactgaagaggcccacaatttgccaaaacaaggcgcaatgactatgtgtaatttgggcctacatgtcaatgggaggcttagggcaggtgcaatagggaaaatgtacctactattagccgctggcatcagctctttttcattgctggaagaaagagggagtggagagagagagcagccgtcgactaaattgacaacgcctgtgcacaggcgcctagacacggcatgcatacgatggatgctgtgattggtgaaaagaataggtgagagataattaaggttggcccacatggaaagagcatctgtgactggttgatagcctaggagagagaaccaaggtttggcccacattgagagaaaaattaatgactcggttaaatattatattatctttaatgatatagaaatgacatgtaagctcatctaatagatggctgcttactctcttattaaacttgcccttatgttcgattctcacatatccaataattttgtatagtttttacactaataaaaaatatgaaaagtcggatttggtatgaacaacggattaattgtatgtttgccatatacaaaagatagacgcagataattcaaaattccaagttgtgctgcgcaactaaactaatcgatcaaaattccaacgaccgccagaccaaatcccaaccctttaatttgcatgggctcctgcctttgccatataggaattcccattgacgacaaccgtgtccggatgtgaactcgaattacgtatatacgtacctgcatgcatgcaacattccagttcacaccatctacaacagataccgggatcaaagattattaatctttagtcccggttcaaaagattagagctactttttgatctttagtttcggttgggaacaccaaccaggactaaaaatgagttccggttcgaaaaaaaatagcaggcggtgtcaaacccctctattatttttattatttttagtcccggttatttcgagtctcgattggtgttaccaaccgggaaataagatcggcatatgcggcagagatgacgaggcgtgcgcgagacccagaggcaatatcagttaataagttctatctcctcctccctcaccttaatttatctctttctcctcttcacccctatctcttcctcttcctcctctcctcattctcttcctcttcctcatcttctcctcccctctcctccccattcttaggcggccgggcagcggcggaggcagcctcgtgcgcggatccgggatctagcgcggccggccgggcggcggcctagcgcggagggccgcgcccggtggaagccggcgcggaggttggtgcggcggtaggcagtggaggccggggctgctgcgtgattttttttttcttttttccttaatgtgtgattcgatctgtgttgaatgattcgatctgtgttgaatcgatctgtgatgaatgtgtgattcgatctgtgttgttgttgtgaatgattttgagaatgatctgtgttgtgaatgttgtgaatgattggggattaactattactgtgaatgatttgggatgaactatataactgtgaatgatttgagataatgggcgtgagatatacaaaatagaaaaaaaaaagaaaaactccgattgaaaaaccgggactacaatgagttaccaatcgggagtaaaaagcatttctctaccagtgatacttttatgtatatatatagttttatatatttcaaaaaaaatttaaataagtcgaatggtcaaacatgcttaaaaaaagtccacgacgtcccatatttactatttagggacagagggactacgctatatagaaatactcgcaacattttgaaaaaaaaatcaaacaataataagaccactggtggagaaagcgtttgtagtcccggttcataaccccctttagtcccggtttgaaaaccgggactaccaatccgggactaaagatagatcgctatcttttgtcccgggtgaaataccgggactaaagatcgagctgaccttttttttttcatggccctgttgctgcatggtttatatatatatatatatatatatatatataaaccatgcatatatatgtataaatacacatatatatatatatatacatatatatatatatatacatatatatatatatatacatatatatatacatatatacatatatacatatatacatatatatatatatatatgaccaaaatatatatttacattaaagaaaatgtgtacatgcatatagaaaaatagacatgtattaattacaatctattatgatgtcttagctagctacgatttcgacgtagtagtagtcgttatctcagaagctaaggacctttgaattgtatttccgtcgtagtagaattcacccttgggatcaaggatttattcgttgatgaatcccattagttgttcttgaaccgccgcgataaattccttgtgtgtgatcaggttatccctcatgcgaataaactatatgaatgtatgaaattaattagtaattaaacaacaaatcgatacgtacgcaatgaaattttgaatttatttgtacgtacatcgagctctcttgtggtgatgatttggtctgcaaggcaatggcaatactcgcacacgtagtagccgcacaagttagttccctgcttttgctttgcgcactataaataaatgataaactgcgagagatctaattaatatacacttgtatgtatttgaattggagattgaatataaatatagagcatgtgtactcacaagaaaattgaacttccgcctaagtctttctcgtcatttgccgtggaccaaatgacggaaccgataccaatcgggactaaagatcccgggagggcctgacagaccctgacagcatttgaaccaagactaaagatgattgggactaaagatcatctttagccccggtttttattgcaaccaggactattgtgaaattcggccgactgacgaaagatggtttctccgcccctggacgaaaagaaaaacaacgatcagaccgggaagggcgtgcatgcaattgttggaacgtggataggcacggtatctatttattggtctttatccatgcatcttggaaggggcagaccggcagctcgaacgtcctgtttaacgcgctagggcgatcgagacgcgcaaaattttctgtgcatgcagcacgcgcgcgtacgtgtacgaacgcgcggtgcccgaaaatcgcattgagtatagcagcagcatcgttcagattgatcgatttccatctcaaaagaaacaggagcctttgctatttcctcggccccgaccaacaaacaaacaaacagcggatgagcggagagtagtcaagccgcgtcgtcgcgcgtggtcgtcgatcgcatcgcgctctctcgcggttgtcgtccaaacgcgttgaaattaaccaccgatcgatcgagatggccgtgcgtgtaaagccctacgagtgatcgccccggccggcgctctctcttccctcgtcatggggagggaggcgtcctcgccaccgcccccgccgccgccgccggcggtggtgcatggagccggctcgtcgttgtccggacagaagaggaaggccgccatggacgatggcagcggcgaggacgacaacgtgccaccatggctgaaactgtctctcggtccggtggcctacggggtcgccacgggcgtcgtcgacgacgactcctcttcttgcgctccggcagtgacgacgtcgatcgaggtgcggccgccggtggccactggtgtggtctccggatcggcggcccaaccatcgattgaacatgttcctgccgatgatgcggtggtcacgccgtcttttgtggcctcggcagccggtgtgctgttcaccggctgcgcgagtggtttgatccccaatggtgcagtctcggtatttccatgctttaattttcttggaccttcaatgtcatcatcaatcctatcgcacctccatcaacaattctcctcgactcgacgtcaaagcaacgcgtccatggcaagatctagccgcacctgtggcggggacgacgacatggcacttagcaacatcgctgcgccgaacgtcacaaacggtggcggcaacaacaacaacgacggtaatgctcttcctgatccaccgtatccttgggctaccaatgaaccggccaaacaccactccctcgccgagctcgctcgccgcgacatcaccaccatccaaggcgacgctcggtgcaggcgctgtgatgcacgcaaggtgatcgtctacaacattgccactaagtttcaagaggtgtccgactacttacgccaaaaccaccaacatatgcatgaccgtgcgcaggcgcggtggatgaaccctgtcgtgccgaactgtgacgactgcggccatgagaaatgcttgcgtccggtgatcgctgccgagaaggagcgcatcaactggttgttcctactgcttggggagacactgggtttgtgcacacttgatcagctcaagtatttctgcgcgcacaccaaccggcatcgcaccggtgccaaggatagggtgctcttctccacctacgaagagctatgcaaccaacttgttcctgggctaatcacaagacgtgaccagttgaggatgcgttagttattaattttttcggttgttaatttagacttttcaagatgcaaccatgcgtgcctacgtggttgttacattaggttcatctagagtctctgtcttggagtctcgtctctataagtctgtgagtgtttgagatagttcgcgatatattatttctctcttttatttgtaagttgtgcaactggatttgaatgtgggtgtgtattgtttgttttaatatactatttatgtcctttcagctttgaatgataggcgcaatttggtgtggtttgggatttgtccttaaatttggagaaatgttgattacggccaaaaatacctataggtctttacactttgttgagaaggtgctttatgttacttggaatatctgggagaaaagaaatggtttaattttttataatatcgctccttctcttttctcttggagagttctctttaagaatggtatctcccttttactccataggcttaatttgtttgatcattggattaatctgttgtaattttctaccttttattttttcaatatattaaactgtaggggcttccttccctcaagaaaaaaaatggcttcttaattcaattggagatttcaatgtgggtccagttttatttgtgtagatagtactagtagtatattgcgaaatttcactgctgcaaacttgtaattactgtatttacactaggttggatttgagatgatagatgctatgtagaagctgagagtacgtaatctatgtcgttagcagcaagtaattcaaaccaatggtttggtaaatgtaatctagctatatattttttttaaaaaaaactgagccagcaagagttggtgttatattgagcagagtaaaaacatttgtgcattgaattttacagccttagagtagagatatgtactgctgtagcactggttacaaactcacaatatgttcatttaactaatgttgcggtgtttataaatgcatttctttagtttgctcaactaatttatgtaagattactatttttttattttgtcaattatacttttccttcgcgttgatctaattcacttagttgctattggacccattttttccccacgatgtagtttcatgccaaactgtataaacaacacattgttgaccttgtctgtggatagattggtgtgttatcacttatcacccaatgtataagcaacccattgttgatgcatctatagtactgtttatatggaattattagttacccaccaatctaattattttttatgaacgcaaaaccttaatagatttatagtttctaaaaatacactgccttttacttatcttacatacatacctaatcggtgaaatgcttgccaagccacatagttctacgaatgcaaatcactaatccgttttagtttactgcacttgctatttatgttagatagcttggattcaggcactaatacatttcattccctttgtccaagtaaatacacttaatacatgatatgatatatcctaatactataaatttggacacatagacacatgcaagtgtttttcggtagtttcagcgtgggcggcgtgaacgatattatggtttgccacaaactagatcatttagtttgcattggtgtttgatttgcaattgtagaatattgtagaatacacagcttgtcaaactaaggtctcaatatgtcctgcacaatttttttttcataaaatcgggttatttagctatgccctgtaatgatgccactgaataatggtcgttacaattttttgtgtacacattgttatttggttatcggattgttgtggctttctattccatcggctttctttgtgtgtttacatgtgtgtgttaccccaacacagcttaatcaggagaaaatgggtacagatattagtaaaaattgttaaaccaactgaatttttgtttttaaaaatacaattccttaaagaagtgttttgtgcagtaactagaggaaataaaaatctcaactataaaaattaactcaaaaggcaacaatgtttgggaacagtcaaatactcaagaagtaactaaatttgttaataagggcctcagttggtgaacaaaagagggcatagtatggtaaatgttggacaatattccatttatattgtggtttgtagcagtggacagtctttaatattgttcagtttgaacttgatcaaaattcctgctaagtcttgttgaaatgttttaatatcttgctgcataatgtaaagggagaacattttaaatgattttcataatgggaagcattggtgcaaaatatgaatagagttggttttagttgcatgaatttgaattggtgggagataagatccgctccaatgctccatgaactcaaggatatataggccacatgaggcgttagaaaaattgaggcgttaggttaacacattacaataattaaataatatgaatagcatgtggaagagtttaggagtaacccacgtagtctccttgctttggcaattgctggacttcgctgtattcccatgaggtaatattgaaattaggccagtcatgttgtaattatgggtgctgatttttttgtcccctgtaatcctctctggatagctaccagctgggaagtgattgtaatgtcaggtttgttaaaacacgacgaactcgatttgaattgtacaagtggatcgaagtgtatcgctcaccacacgccttagatcgggtcgatcttcactgattgggatatatggctagcgaatcgagtatttgcacttcacgttgcttggcgttaagaacggcaaggtaccagtgtgtttcttttatattaattgggagataaatctgtagatgtgcgataggaagattgggtaatagcttgcaataaccattgcatagaatagctaaataaacgttctcatgtcatatgttaggtacttgcatgccatatttttaatccattgtttatcataggggttgttagatttagcatgcgccctctttcagtagatgtcacaccctgattttagttccagggattaataaaattatttaataaattattcctagaatttatattaaatattcccacatttacaagtgatattaaatgtgggaaataaaacttcctaaataaaaaatggcttgatttatttattattacattctccatgattaattatactctgaaaattctcggatttttcagagctcaattgttaatttgtaagatacaaaagaacatacgagtaattatttaaatacaaattaatcattaaatgatctggttataatttgttttaaatactttgagtgatcaagtattatgaggatttttattggaattattggagcatttgaagcgttttaatggaaaagatcatatgcaatgattaatttaaatggaaaagtaattaaaaaccctctcctaaatctaggccaattctggagaagtctcaacattttagattttcaaaactacttatacttttggagtaggaataacccttatgacatatctccttgaccgggagcatggtgtattcgaatacgtctgcaatgtctgcccagctttacccacacgatgagaacaattcgcgaggttgtaaacaccatagccgttcgagagtcccatttaccactagttactgcacagtggggtcttggttcatcatagtggtcaaactcttgccaggcctaggcaaggtatctatatcgtcacactttcatgaagcccactgttgtgattcatgccacccaaacaccttacgcatgattcaccacaaaacctgctcctaataagccacccaacaatctttcatatagtaggacaatgtactaggctaagtccaattacttggtcgtgtggatgggcgtaactatgtcatttctatggtataaggggataattataatccggttaaaccaccaaaatatctcaacatcccaaaacttccataccaacttcataaatcacacttcaaaaagcccattttaaccggattcctaagtttgtaaagatatttggaatagtgaaccacataaaatgatgactaaagcatcattctataatctcatgcaaaaatgcttgaaagtatttaatatctaaagagtaatatttcatgcataaaatgacagttatattaagttttctatatgatcaaaattttagttatgtcttgccttgcgccttaagatttcccgcggctttagcgtaatcatctgagtccacgtcagctccttggatgtcgatagaatttgctgtacggtctaacgtacgaatacgaaaaagatagcaaatagagcctataagcaaattgctacaaagaaacgataaaccaagaaataaagaaaattggagcaaggcgaaggaaaaaggagttgggtcaaaagaaattttagtttggaaaacaaaagagaggggttttggtttctaaaggttgggtttcaaataaagttgaggaaaaagagagattgggtaggtagggtttatttggtggttttggtttatagtcgatgctagaatagagtagcacaatggctagatatttggagttggttagccgatgctaaggataagcaacattacggctaaatatttggcttatttagtcgatgatacagcgcaatgactagagagttgggaaaaattcgtgtgggtttgcaagatggaaagtgctactctaaagctgtgagtgacagcaaagcggctaggattgcacatagtccaaggactagtgtgctgtggaggtcgggagagtagtgaggcttcaatcactgtacgcgtcgaggcatgcggtgtgaagggcaacactttgaccttggaactaggttatgccgtgttttacgatcaacgattcgacgtcggggtttgtagactacacgaatgtctcatggaagcgtaaagtttgcacgacaactgtttagtggctattggattagcaaaagaaataattgaaggttttagaaataaaaggaaataaatagatcaaaggaaattgaattcaaaatgggtttttaaagaaataaaatttaaaatggtatttgaaatgaataaataaaaggtgtttaaataaattaaaggaaaaatttagttttttaaaaaagggtttttaaataacacagaaatttaaatttaaaggtatttgaataaaatagaataattaaaaaaggttaattaaaataaattttaaattcgaaatgtaaataaataaatgaataaaaagggatttaaatgagaaaatttaaataaaatttaaaaatagaaaatttggtatcaaaataaagagtttgaaattagatgaatttagataaagaatttactagaattggatctatgatttgagaaatatgggtgtctatagagattgaaattgaaacaaaaaggaaagggattagtatgcagtggggcccacttgtcatagccttccttcttcctccttttctcctcctcgtcttcttttcctctgtctcacaggaagccgagagaagagagagagaagcgcgagcaaggtgacggcgctccggtggccgagaggtggcgacgccagcggcgggtggtgttcccgcttgttgctcacccgaagaggaggtcggccagcgagggaagcgagggaggaggccggaatggcgaggataaagattggtccggccaggagagagaaagctccggtggtggctcgatttagggtggaaggaaaggggaaataggaaaaattggttcacctcggcgaggcaagcccggatggcgcaaggatttggccagcggagctccggtgagggagatcggccggtggcgaggtggtggccggcatggcaggaaagagagaaagagagtttagagagctcggctgtggagggggaaagggcgaccgcggaggtcggttcggagaggagaagggatacttggttatggtggcggcagcgtggggaagtggacgacggcgccggcttcgttcttccattggccgaaaagggcggcgcgcacacgcggcggccgtggcagcgttgggcggtggaggtggaggagtacggcacgacgctccagctaggcaaaacagctgcagcggcggcaggaccgtggcgacggcgcgatgccgtgggcggcggcgtgcccatggcgccagtggcggcgcccacaggggaggaagagagaggcggctggttgggccggctcggctgggcttcggctcagttgggccggcagcccaagaaggagtgagtggaagggagagaggaggaaaaggaatgggccgaaaagaagggaatttcggcccgaattgattaggaaggtttaatatttttgtgtggagagttttgaacggaattcaaaggagatgaaagaatgaaagttttgggatttttgaacttgaacatggaatttgaataaaatttaaaggagatgaaaatcaaaggatggatggatggatgtggacctttttggactttggacaaagaaatcaaatagaaatcaagggaaatggaacctaagaaaattttgtatggagggtttttttataaaaaaattaaatgaaaggtttttaaaacaaaaggagtttgaaaatattttaaataaaatcaaggatatttattttgagataaaatttggtggaaaaatttgaaatgggtaaaagtgctccaattttatagaattcaataagaatcaaacataagacttggcacggaagtttttctttaatatttaaaaattaaaaattagaataatcaaaaagggaaggaaaggcaataatttaatttctaactttggataaatttgaaatggtagcaaaaatagatggaggcaaataactaggattttgacctccaagatatggggtatggattcttggtttagtatttgtggctaagggaagttagactttctaaggaaaaaattggaaatagtgttcttagcacaagagcaatcattcaaatattcgtgataatatcgttcttgtgctaagggtgtgatcaagccataggaatcaaattggcggcttgattcataattaaatagaagaatttgaatagttgatcttctagaggagtttgtggtaggtattgtatgaaggataaaatggggatttctaatgataggtctagataggagtttgatccaaaataaattccaataaaaaggaagttatactggtttagccccaaaaataaaaatggttaatgggatataacagagagttgggtcaatcagggaaatattggcccaagctaaatagtagactttgaaatcttgagtggataatttagatgaatgagatttcaaagaggaaatatttattggagtatagaactggattcggaagtatatgtggatgggaatttctacgggaacggaattggtggtagcttgataaactctagaggataggtatattgactcaaagggggattgaaaaggatatttttgtgactctagagatatttaggtggagattcaaaggaaaggtatcaacatttcatgtactctagggaggttagaaaatggcatttcatgtgttctggagatagctgagcgggaatcgaaaggatatttgtgggtgttggagatgttcgggaatgggttcaaaggaaatgtatttagagtcaaagttagagattaaataaaataaatagagagcttttgtaaaatttaaaagatagcgattaactttgcaaataaagtttaagtccaaaataaaagaaaagattaaaagtaagatcactctaatgcaagaatcgagaagagcataacttaaaatatttcgcaaaatattttcctgaaattttgagtccgttacagccttatagtcagcttgctccaatatgggagttggaaaaaaaaagtactctttttccttcaagtaccatacaatgtactagagtgtttccttttcttccctgatttcccaaacttcacctgaaataaacatgtggcagcaatagtaaggtggtaaatccaaattcatatggttagtcatagttctaaaaaaaggttatgccttatagtattatcatgtcacatgcatagtttgattttttttaatttagaagcatcacacaaaaagattcaataataagatggaagcaataacctgttcgaatttctcatactgagaaataatatcatcttctgacaatggttttggagcacttcgcttttccttttggccatcaaaagaagcatcattgttcctccagacatgtcgcctcggcaagaagcggcgatgtcccatataacaatatttgtgcccattaacaagtctgtggtagcaggtttcagtgtggcatgaaggacatgcatatttaccttttgtgctaatgcctgacaagttttcaaatgctggaaaatcattaattgtccaaagcaaagcagcacgtaaattaaaagtctgctttgtggaagcatatggctacaagtatacatcaatgtcattaccaggtgcttttgggccaagaattatcatagacatcaccatatatggatctttcatgcacatccaaggtggcaagttatatataacaagaactacagtccagatgctatatgaagaactcatatttccaaatgggttaaatccatcactagcaagaccaagtcggatgttccgtgcgtccaatgcaaatgaagaaaatttcccatcgaagtccttccattcttttgaattagcaggatgtctcttatatccatcatctactaacttctccttgtgccatcgcatatgtgttgcaagttttgtagacaagtacatccgttttaacctcggtaccaatgggaagtatcgcaataccttctatgggactttcttcactcttctcctccttgatttagagacattattatgcccttcatttttccatcttgaaatgccacaaacaggacaagaatcagccttatcataagcccctctatataggatgcaatcattcaaacaagcatcgatctttgtgtaatccaatccaagatctgtcatagtcttctttgcatcactatatgacttaggcacattactgctactaggaaatgccttgcataacatggaaaatagagcctccattgcatttgcactagatcatagaggtatttgatatttaacatttgtacaataaatgctagtgtcgaaaaggtaccacaccctggatataactcttgctctgcatcttctagaagtctgtagaatttgttagtttcttcgttagttactgtagagttatccatgtcatcattcaaaccaggtgttgagccacccagtgatcccatattcacaaccataggttctccaaaatcattcatcatctgatccataccatagttatcataattttcatccatatcaatattgccactgtcttctgaatctgggacgttttatccatgatagacccataatttgtagtctttctgcactccatggataaagagatgttcctttatattattctgatcaaagaagtgattgtttttgcactttctgtatgggcatcggaggaatttgtctgcattgtaatctttgaaagcaaactgaataaattggtcaactccttgctgatattcaggaagactcctattagataagtccatccagcttttgtccatggccgtagagtctgacattatcctacaaagaaaatattattttctaatcacttattatcattaagttgttaaatagtaagtaacatgctcaatttaaaaccaaacattcagtggtactctatttgatttcagtttcaggatgctagcgatgtttcacaagctgtatctataaacattatttcaattttggtgccgtgatagttttggtgtcgagcaatatttaagtgtgaatgtatttttagtaaaacaaaggctaaatgtacgtctatgaacatacagaaattgttgaacagttcaaacagtggcagatttataagttttattgttcttgtttaggtataacaatgtataataagtgtgcacagatacatgcaaactccgtataacatttaccatggagactaaaatttaggtcaagttttgatttaggagaggaaaacaatctcccaagattacatagatggtcctgtattcttaacagtttagactatgaatcctgaattatcctaaaaggaaaatataatggttcaggttataatcacaatggttgtaagcatttgatttagcttgcatcaaacatggtaattaaatacttatatagtactgttgcatgcgttggtctggtggctaagcacagtaattaagcttaatctaacagtattgccggcactaaacttccaatgacagtatgattgacataaggatcacgtagattaccaaattctatctaatttaatctaatcggctctgtgtcattaacggcaaggtttatgctctaattccagtaataacatagaagttagacactacatacatacatacatacctggaattctggaaatatgaataagtttccttaagtctctccgtaagcgatgctagagagaacaacagtgtggggggaattcctgcagggcaggcgtcagagccagaagagggccgggaggagaccactggaatggaacaggtgcctccttgtgtgctagggctgccgatcagccgcgcatgtgtgagaagatcgatagggaggaatagaagaagtgtttgagatgaagttaggttaaaaaggaagataaaggaaagacaccgtccatatgttttaaaaaaatctgcaacaactttattgctctaataagatgcgcaacaatttattgctcaaataagaacggcaacaactattgctcaagacaaaatccgatacgaatcttcaatcttgaggaatccagaaagaaaatcgatggtaaatcgagtcagaaagatcaaatcgtacacaaactcacgaaaccaatgacgaatataatcggattcaggcattggcagcacttgtgtcttggccgtcgggggtggaggccgacggcggcggtgaaggccggcatgccacacaggaggtctggagggcttttcggctgggaggccgaccactgccctgagtcagccatttcgttggcaactggtgaggacagaaaatgggcctgttcggttcttacatctgcagccatagccaaaaatagctgtacgaaaaagccaaatgatttcactgagtggctgcctaataggtggacgtaccctataataattcaccaactaactgatctttaaggcctgtttggtacagctccaactcctaaatataactccaggagttgagtctaaagtgacgcagctccacaactctagtacattttgtgagagagcttcacccaacttcactcccagttttagtggagctgaaactgtttggctgagctccagctccaggccaaacaagcccttacatcctcattccattgaatcaacgccaccaaacgaggggaggataggcgtggagacggacggggatcggagtcggagatgaggccgagccgacgcagcagcacgcggtggcgctcctcgacggaggtcggctcagagatccagacctcgtaggcggagaacgtcgcggacgtacgacgacacagctgctgcggccgccgccgccggtgctgctggtcagtggtcacgtcgtcatcggaggcggacgtgaacgagcacgacgatccagcgactcgtacaactcctcatcctcctcgccattccagcgacgcatgccaccgacctgtgccaccgaagcgcccgcctcgccgatctcatccacggtcgatcggtacagagtaaatcattttctttattgtaggagattacagatcagtttccatatgttgcctataagcatggaagctctctcatttcacccaagttgttcgtctacaagtatgtcccctgctttggttcttcaattatattgtcacttcattagatgtagtactttggatgacaatgagattggcttaaaataattctgcctttcagtaggcagcacagaacagatttcccctccaatgtattaggggagagattagattttctaagcagaaacgttctgagattcgaccagaaaactgaattgatattttagtaatgtactgtagtttgcttattactttccaagattgctctgtgatatgtaaggacagccttacttactagagattgtgatatttcatatggtggcatgagtgctgatagataattgatatgtgcatacacaagcttttacacattaatttccatgtcattgctaaatatagattgatgtgtgcattccagataggttgatgggaacatattaaggaggtgcttacgattcattgactgcaagttatttatctatctattatatactaaaagtctattaaactttctacaaaagctcttatgctaccacatggcgctctaaatacgatctcaagctgacatgtggcgttaataaaatccatcccttaattttcatttaactcggtgggccctatattctaagccgttgatttggttgagattaaaacaaaccagcgagctgtgcatgaaccaagcgcctctggaaccgctatgacccggattcccgtgcgggcagggtgatcgatcaacatgttgatctctgatcgatcgatcgatcaacctgtacagtggacacccttctcctgctcatcctagcctccttgcaagacatgtggaagccctgatgattaaatcactattcgcttttggtattcacactcctatgcatatgtacatgtggtttttgcatgcatactatacgctgattagtttgcttgccgaatagtaataaatccaacccatctctaacctctgcttcactccccttttctcccttctttgtatgtctagcagtttgagataaaattttatgataataaatttcaaacagccataacttctaaattatatgtttgatttttatctattcatcatctatctattataaactaaaagtacattaaacttcctataaacactcttaagccgtcacgtggactcctaccaacgctcctaaaccgccacatggtgctctaataatttaaagaaaattctaagaaaaatatctaaccgtcaattttcaattttcatttaaagcggtggacctaatactattgaccattggatcaaaactaaatcccccatcacccttctatcccggacccatatgcatgtacgtggacaattacatctggtagctacaacgtttatttatttgattgcttgatttattattgacattaggcaggataattatatatggcctcggtgtgctcgattgatgcatgcatccggttcctgattttttttctaaatacatgatatatatgtacaccataatttatcatcataataattattagatctatttctcatggagactgatttaggtgtgaacgtgcaagcgctagggatttacaataggagtgatcttggtgctgtaaataaacaattattttagacggtctacacgtttaatttaagatacacttgagcagctttagtatttttttcatcaaatcaacaatccaagaccatgttggctatttgctttactattatatcatattatatcttataggtcctcctcatacatatattatacaaccgtgtatttatgatacatcgcatgccaaaaataattattacacaattatatttaaccatccaatcgtattcataataggctatgtggagcctcgcacacactctaaatgaaatgctcacagatggattgtctctcaaactatgcaatcatattacaaacccatgaatgtagtgtagcctcatgttgtacccaatacatctgtcaataaataatgggcgacctaactaacatcagtaatccaattaaaaaaaagcaccttgcttactttatatttaatttggtaggcatgttttctaaacaaaataagtctaccttctatttagatgatgaagaagattataaataattgcttatagaaattatttgaatatgatatggtataaaggtaactaataagttaaaattatataagaaatactaacaaaaaatgtgaatatatcgtacttttaaagtgtggtagattttctccggtgatattctatccttatatgcttctcaaacctaacctacgatgcatgcccgcgcattcgtgttgagttgtataaaacaaaacagaaaatagaaaaataaatgccaatatgaactacattaattgaaataattggtgaaaatcttataacttattttgcttcattcttttttcttagatattaatgatttttcttgcatcgcatcaattttttaattaagtgcttagattattttttttctctatcgtacgccacagtattatgaatttctctacatattattgcaaatataagcaacatactaaggttaccgtacataatcggtttagaagttatatttcttactattaaatttaatttttaagggtcaagttgattaggttttttctttttaagaaatacaatagatcacagatatcatagggaaacaagacctaggatacatgtatatcatctctgtcctattcatatgtaagtaataattaaactgcatcaatataaaccaaataaaagaatcgctagctagatggtacaaataaaacacctttgatagcaattaaagtatttttaagatttgatagaaaaaagttatcccctaaagaaacacctaccttttaaattacatttaatttgtagatatgttttctaaatatactaaatttgtcttattttagatgatgaagaagattatagaaaattgcttaaaggaagattaaatattatatggcataaagctaacaaataggttaaaaatttatctaagcaatacatcctatgatacatgcccgcgcgaatgcgcgggctaccttcctagtttatgtaatttgaggataataaaaggaattgtctaaacatctagacatggtagcatctaatttgcttcaggaattaattgtctaatttgctcgatgctttgttctcttttctgccagcaaatatacaaaccaaaatgttaattcatttctcaaagctttatttggagcaaggttagagtgcacattctgtatattttggtcaatcaacatattatgactgccttttttttatcatcatttatctgaaaggctgaaacatattatgttcaaaacacctggtatttttttacattttttagtacaacaagaaaatcaagttcctcagctttttgtgaaacactttgtcctgaatgatggaggtagcatcagttatggaattggtctttagaaaatgatggtgtaaggtgatctgatttgttcattgagtaatcgtgcacatgtaatgtggcatgccttcctttataattatgaagccattcttaacaacggccacaagtttcgaaagctgatagaaccaaacaggaatataaaagtgaatttgggcaaaagtatggactgattcttcatatacttggaatggttggggtgcaattcttcatatactatgtgtgtattgtgacatattatttactgttaagacggtgataaggatttgagaggtgctagagggagaataccttcaatactcagtttatttcctgacctgttatgattaacctggatttcaagcattatacaataggagaatatttgaatattttgtggtgtcagtggtagaagatatacgttgaggacttcattaagattaatctagacgatatatttggactacaccgtatgtttgtgttctcactggaaaatacaagctctagtgcagttgtcaggtatggtgacctttgatttggatttatttatgatatttcctcaacaatctattaggttttgtgctctcactaatttcttatctatctcaaaaatttaacagatggttccttaatttgtagtgagtttggttcccgtcgctggtcctatggtccaattgtattttcagacagtccagcttgcatgtggatttgagcggagtgagttgattaatgttagcgtatacagaccaaatatgtctaacatcccctctccgtttgccttctgatatattcttttaccctgtgggaaagatttatgtaggctatgattgaatgccacaatattgcaatgtcaggcatataacacaggggagtgcagaaattctgttgagagaactcaatctggtaatctgctccaagcctccaatctttttgctattgtttgctttggctatgtactggattgaatttgaagatgtttatttgagcgtatatattattttcattcagcgttactggattaaaattcaagtatatcaaattacaagattgcatataagtgagaaggattggggtgatcattgtctgtaattcaagtgcataagacttgctgatctggtcaccattggaactggtctaatttagaattattggtttaaattgaactcctctgtcggtttcctacagggaagtgctgaatgctaatgccatctaaaatcagttccctgcagggaagtgctgaacgctaatgccatctagactctcagtatcctgtgggacatagtgattccttatttattttcttataacattgattgttcatgagccaatatctttagttgttagctctgaaagacagtatggtatgtttattttgctgtcaaaaaatagacaattaattgtgaagtgtaaagttaagtttggactctttatgtaattatttgtgtagcacatgcacataatgctaaggattaatttgattctaatttatctattaggagatttcttggacctaagtaaaataggttccattgaatacatgtttgtgcttttacatctatgcacgtgtaatacactgaaatactttaattcagttttgttgagggtgatgcattggttcagaaattcaatttatgttgtttcaaaatttttgaatgcagataatgtatctctgatggtacaaataaattgtagtcatatgagttgtaagtgatatcacaaaaatcattcagttttgatggcaaaatttactgtattgactgtttccctttatttctacacagattccaagcaactgactttgattaaagatgcatcaactgagcattgttagcaatacaaaattacctgattggcaattatgaatgcatcctgagcatcaccttcagtatatggaggttcatttgttagtcattcaagcggctcttgcttataacagttgtttatcttcaagttccaatttttttatccctaatgtctcattgttttttagaattattggtaaatcttgtacataaaagttatagtctttggaaaaaatttgtagtaagcaaggctgtttctgatttcctaacagctgttagtgtgcaggaattagagataagctatatatgaagctgcagttgtagaggtacactgaccaaacaaattgttattgaagagaaaaaaaatatctaaggttcccctgaatatttcaaacgaattgtgtgttcttcgcctccataataaactcatgtgagataagagttaaggattttgacctactttttaagcaggggcacttcttggatgtcctaatattatgtttgtttagtgcctttaaggagaacagaagcaatgctaggctcagtgtgctgcgtgtacgttgtagcagatggagattgttcatactacggaaatgataaagcattttaaagatgttttatgtattaatgaaataataaatctaatatttatatattttcctaaattttcggtgccattatttagctttttcgaggaataaactaaacggcatatttgcaaatgaaaaataatttgtgaataaaacttttatatacgtgttcataacgatctaaaagcaaaagctaaaaaataaactacgatgaaaaaaaatcttaaaatcaactccaaatttaagattgaaatttcaaattttgacttatgaacataggtataagcgaaaagatcatgttcttatattctttcaatatataatttataatttataggcaatggtaagtcatgtatgtttcttcatatcactcatctgtcatgtatacttgtacgcacatgtttgatttacgttttaaatatcaccgttgcattagcacaggcatgctactagtaattacaaattgttcaataagcatttgcatttaatacataagaaatacacgcttcgatcattgtatgacctagatattccgacatttgtattacatttataaagtccatgggtccaaaagatcatttttatatcacaaaaatttaatttatgctagtcatatcaccgaatgaacacaacacgcgcacacccattgcctatgagcactcaaatagcacctggtcataactctagtttaagcatcgtcatgactacagcttgctcgctcgtcatctgcatcgcttttctcgcgcactaaacgagttagctaacaaatgagccaagccgagcaacgattttagcagaaaaatagtttttcttcattgattttaaagaaatatacgtgtttacaatgaataggcagaatgatatcgttgtcgcataggagtgatgcgaattcgcggcaagttcacgtggtgagtgcacgacttggcaaacttacgacgagtttggagcngaatactcacgcgattgattgattaattaattaattgaccattatttttaatttagcgtcattagctgtcgattaaaagtgattaaattaatttatgccgcgaagattaatttatgctcgtgtcgtcaatgaggctgagttttttccccaactttcccaactcactttcctcgttttccgcgtgtacgcttttcaaactactaaacagtatatttttttgcaaaaattatctatacgaaagttgctttaaaaattcatattaatccattttttaaaaattagtaaatacttaaataatcataagaaaatatgccgctccattttgcgtgcacgggacctcacctcccgaaccagccttcttctgctaaaaagtaatgtaactcacatcaccttagcaggaactctcttctttgaaggttgtccgtcaacttcacctggatcatctcgtctaatcttgtatcgtagtgcattacagaccgggcatgcttctaggttctcgtactcctcaccacgatagaggatacaatcgttcggacatgcgtgtatcttctgaacctccagtcctagagggcagactatcttcttagcttcgtggcagactatcttcttagcttcgtgtgttgttttggcaacttattttcctccaggagaatattctttactagtttcaataactcgccaaatgccttgtcactgaaacctgaaaccatttcttgtcttccattgcaagaattcaagagtggtacccaaatttttgtgcccctgttcgcaacctgggtacaacggcgtcttgtggtccgctagcatacgttccaatttcttgacctccttttcactttcgcagttttccttgacgtcccgcaacatctgaccaagatcatttgcagcgtcgttatcttcaacagccccgtccacctcgtccgttgtgtttccttcaaatccaccataatgagcccagtccagaatgttctcgtcctctacttcatcttcttctgcttgaacccctagctctccgtgtgaggtccaaacattatagctcggcatgaagcccgtctcaaacaagggaaaatgaatagttcttgatgtagaatactccttctggtttttgcatttagtgcatggacaacgggtaaaacccttatgcttgttagtttcggccaccctcagaaaataatgcacatcgtcgataaactctttcgaccgtcgatccgcgtacatctattgccgatccatctacatgacaagcacaaaaatcgataaaaataatccacgaaagtaaaaccaattaaacaataattttatataattattcatgtaataattataaaataacatcacatattactcatgtttttttatatttaaagttgtaaacaaatattaaattggttgtacttattttaatttcaaattaatttagttttctattattttagactaattttctatctttttactttctcatctcttttatcataagtttttataaatttctaaacaaacctattttctatattttttccctacacaaactttctctctcatcatcttccattcaagtttctagaggcaaaaaaaagtatagaaaactaatctctaaatgtaaatgccaagcaaaaaaaaatagaggaggatagattactaaccttttatacacctcaaagttgtatattatcaccaaaccaaattcacaaaaaaatgggcagcacctcccctctcctcttaaaaaaaatgaagccctgctctggatgaaggaggaagaagaagatataggcatgctaactatagatccaggaactaaagattggaactttagtcccgggactaaagatccctgggggcctgacaacctctgataatcggcgaaccgggactaaaggtcacaagattcctttaaacttattaaccaggacgaaaaatggtttttagtcccgggggttttttttttgaaccgaggctattgcggaatttggccgaccgggcaaagatcacttctctagtagcgaaggatccaccggcgccagtgacgggaggggtggatccggcgccctcttccccttccccgcaggccgcgcggatcccgtcgcctctccgtcaccccacgcgcgcggatcgatctagcgcccgctccccctcccgcgtgtatcccggccgccgcttgtctgcccctcacgcactcggatccggcacccgctccccctcccactgacaatgtgggcccacaagtcagcctggtagttcggtgggaacggataccacggttgttttctttttaatatggcatagatatcgcgtgctttagttatggaaccgccggctatatgtttccctttttgtcggttctgttccctttcggccaaaggaacctcctcaatcctttctaattgctattcatcccccaaaaatattcccacccgtgcattgcatgatcgatctcgattaccaaagggatgataatgcatatagcactgcattcgttcgtaaatataagcattttatttagtgcatcttaatcgattcaatcctacaaaaaatatatatacatataaaccatttatattattaaaatagatatagaatatactatttatatttaattacatataaacttcaataggtggtaggtaggggtgaaaacggtaggaatcagtaacatctcttcggaagcgacgcttgatcggtcgataatcgactatatttatcatttaaactactcagcgccgacattaatacgatgcataaagaaattagaaaaaaacaaaattcataaatacccaaaaacggtacggtaaaaaacggtgccctatatacgaaaacggcgctcggtcgatcggaatttccgtaaccgttttcacccctagttgtaaggatagggttagagtcggctttgtgacccgacaaccctttaaatagagaaaaatatgtcacaatgtaatcataacgactataatattccaataatctaagcttttatcagtatacaatacctccttaattattactaccactcatatggagatggtcggaccaacgtataagccagctaatttagagttggcatcaaacgttgaaataaacattaattagtacatacatgtttgatcacagctaaacttttattcaaattagcttgtgaccattgatacagggatgccagcacaaaagtaaactggcataaaacagtttctagagttggcactgacgtaattcaacgaatgagccaagtatatgctgccatgctggtgcctacgcgcaacatttgttgatgtatgatattagtacaaaacttagtataatagaacaatgatcgatagtttaaaaaaatatcgtaatatttggtataataacttactctactgcataattatcatcggatcataacatacaataattgttacgatgacataaactatgtatattcaaaactcttctaataaataatttaatcagatcactcgtctatcataaaaccgtacttagggtgtttagatgg

SEQ ID NO: 74540 - DNA, 12771 bp, Oryza sativa
  unsure (1)..(12771): unsure at all n locations
acggaaaatgggtgcctcttacctcagcgatgagctcctgaagggatggatcgcataggtgcgaatgctggcgtaccgtgttgaggatgtattggacagctttttctaccattctattcaattcaagaaagataagttcctgaataagattgttaagggatcacactatgctgttgtttttaatgcaattgctgatgagttggttcagatagagaaggatattgagcatgtttcaaagttgaaggacatgtgggtttaccctgtcagtcagcttattcctactcaagtcaccatctctgaacaccgatttcctcagtacagttttccccgactaatgaaagatgaggatcttgtggggatggagaataacagacaacacttaaagcaattattcagtcatggaatttcagctctcagggtgatatctgtgtggggtatgggtggcatggggaagaccacattggtccttaatgtatatgagcaacataaggagaaatttgacattaatgtgtggcttactgtgtctcaagcattttctgtggaggctttgctgaggaagctattatgggagataaggcgtagatgtgagctcacaacaccaggtgatggtgatagtgtcaacaaggagcagcaggcttcagatgagactgacaaactggaggtttcacaattgaaagaactgaaggatgagttaaagaaagcattaatgcgaaagagatttatggttgtacttgatgatgtatgggaccgtcaagtatttgacatgatgcatgatgtgtttgaggattttaggaatggaagtcgcgttgtgatcaccacaaggagaggggatgtggctgctcttgctcacgagggttgccacctcaaacttaatccgttagaattgaacgatgccctccttctgttcagtaaaaaggcatttcctaatagcaatgaccttgagtgccccttaaagctcaaggacctagccacagacattgctaagaaaagcaatgactcatcactgacagagtgccgattggagctaaatgggctagctactgatattgcagagaaatgcaactgtttgcctttggcaaatagcccagcacaggttcaagagctagttgcttatattgtaaagaactgccaggacttattacagatggaaaataatccatctgggcttcagaagcttgctactgatattttaaagaaatgtgagctcttgcctttggtgaaatgctcagcagagttgcagaagctcgccattgagattgtaaagaaatgtgggggcttgccgcttgcaattgcttcagtaggcagcttgctgtctgcaaggatgcaaatagagtgtgtgtggaagcagattcatgatcagcttccatgtgagctggagaaggatgatcaggtccgaggagttctaactctgagctactatgacttgcctggagagctcagaaattgctttctgtactgcagcatgttcccagaagattacctcttgtcaagggaggttcttgtgagacagtggattgcggaaggttttgtggaaaagaaaggggacagcactctggaggaggtggcagagggatatctcatggagctggttcatcgaaacatgcttcaactcgtgtataatgatgagcttggcagggttagtacatgcagcatgcatgacattctgagagagctggctctttctatctccaaagcagagttgtttggcaccgcaaacaattttagtgagatggcacagatgaacacaaatgtgcgtcgcctgtcagcatgtcgatggacacacacagaacatgatttatcaaagataaaattcccacatcttcgaaccgtaattgcactccagtcaagtatggattttgtaccatcaatattatctgaatctaagcaccttactgtccttgagctgcaagactcaggaatcaaccaagtcccagcatcgataggggatctttttaacttacggtacattggcctaaggaacacagcagtaaaatctctaccggactctatagagaagctcgtgaatcttcaaactcttgatgctaagtcaaccaagatagaaaaattacctagtgggatagtgaagctctataagttaagacacttgctgattgacagattaagtgatggtacaagaacggaattccggtatttcgaaggagtggtagcaccaaaagggttatcgaggttggaagaactgcagacacttgagactgtagaagctagcaaggacttgggggaacatcttgaaaaaatgatccaattaagaaatctctggatcggcaatataaaagctgggcactgtgcacagctgcttgcttcattgtctaagatgccgcttctttatagcttgcttctgtgtgcaagtgatgaggaggagaaacttaacatcgaaaaactcgtaccgacatccacaatgctccaaaagctaattatcagaggatgcaccagtgagagcacacttgagtgcccggtgtttcaggaccatggacgacgcctgaagtatctagctctaagccggtgtcaccttgggcatgatgcatttgagaggctcgaaaagtgtgtgccgaacctgacatatttgagtcttaacaaggtgcataccaatggtgcacacactttggttcttcctgcaaagtcgtttccgctgctgaagacactcgtcttgaggaacatgtccaatgtcaatcttctgaaaattggagctgacgcccttaaatgtatcgaaggtttatacattgtgtcattgtcaaatctaaagagcgtccctgaaggcattgaatcccttagctcccttaagaaactcacccttctaggcttgcacaatgacttcaaagctgagtggaacaagaaacgaatgcacgagaagatgaaacatgtcactaagcttcgtgtgtacgagtggtcctaattcagtatagtcctgcatggatctgaagaacatgaagctgcatgctgcacaactggtgaatccgtgattgcaggttttctcagatatctatatttttttggatactgtagttctgtaattgcataatgctttaaatcctgttaataagtcctggaacaatggtattttgccatccggaagattattcaagttctgtatttttctgttttcttggaagctggttttcttgtaagaaatggcacatatcagcccagctttatttgcaagtagtgtaaggattctctccatttccatcgtttttaggcatgttgcaatgtggtgtgttgtgatcctgtaaaatttctggtaggcagatcttccattgcatttgtctgtatatctatggtatctacttttctctctgatcaggctataattcatacatatatgagagataatttggaaaaagaaacatacgtatatgagagataattatccatcattgttcatcgtttggaagcgtatccttctactgtgtttttgaccaatttcacatgaaaatttacatcatatttcattccatcgacgggtcgacgatgtgtccggcgaagacgaccgcacttgacatctcctccactatgaagtaggcgaacggatgttcggcgacgaagtccaccggcggcggcggcacaccggaaggaagcatccttgtcatggtggcggcggcagccacggttccttcctcgttcacctcgatcaccgccttgtgctggatgtcgccgacgaacaacggccagccggagccgtcgtcctccaccatgtcggacaggtcggcgagctccggcgaaaacggcagccggaggcccagctgctcgagggcgccgacgacgctgccgccgcatgacaccttgaacttgggcacccgaaactcgccgacgggcactggccacgccgccggcatgtgctcgtgcaggaaccccggccgcgacgccatcctctccacgaggccgcgcagcccgtcgcgcgcgtcggggaggaagatggccatggcgtaccgcgtgaactcgccgccgacatcgccgccgccgccgcgcttgcgcttgtcgcggaggagtcgcggcgatcggtagcggagcttgagcaccttgaagccgtcgtgcacggcgacgcgctggtaggaacggctcgacatgtagggcacgtcggcgacggcggcggcggcggcggcgccgtcgtggcggtagaacggcttcctctccgtgtcgctctcattgaagggacgatcccacttgcccttgaagtagatggcgttgccgagcacgacggcggtctccgggccgacggatctcggcggtaggacgtcggtgatgagcttccccgtcgcccgccgcgcccacgcgttgatctgcttcctcgcttcctctgccttctcagaaaccaaatcaagaacacattgatcgatcatggatggatcaagtaaaagaataaatgcatcgatgagtatgctataaccaaccttgttcttgaagtcgacgacggtggcctcggcgttgtactcggcgctnacgacggcgcggtagctgggcttgaacgggcgcgcggcgtcgcaccatacgccgggcgcgaacacgacgcgcggcccgagggactccgggcccctgtcggcgagcgcagtctcggccgtgcgtccgacgaacgccgccaggtcatcgcgcgacgccgcgccgagcacggcgaggatctcgtcgagggtgccgccgcccgcgccggcggcggcgagggaaagctctgcgtgtacggagagcggcgagaaggccaggttgcggccggggctcgcggcgccgaggcggtcggcgaggcggacggccagcgccgtcaggccgccggagatggcccgatggcgatgacgtcgcgccgcctcgccgtcatccatgcgaactgctgcctcgtcgatcgcgggaaaagaggaagggaggtttaaaagtcggcagatcgaattcgtatctctctatttttttatgagaagtaatataaagaaaatcgattcaaactagaaaacctacaaaaccgccggccatgcggaaattttctttgtataagcccggcatatattgcaaagtagtagtgcgatagggaaaaaaacagacgcttgttatagttaagtgaaaattggattgctcttttgcatgcttgtatagttgtacgggtaaagtgttacttcgagaatgctcaaaatcaggcgcccgatgcggcgaaaaaaatcgggcgccacccatgctcgcctccgcctcgcctcccacacgcccccaccacgtgtccccaccatttgcgccctttgcaacaatcgtctggatataacggaaacgtcctgttagggggatttgtttcattttttgttccatcaacaatgtttcagctagtgtactcgtgatgtttcactatgtatggatgaaatgttgcagcggatttttgatactgtttcataatttcatcttaatggacacgttgtttgttcatgtacacagggtgtaagtgttgcaatggctttaaaatcgtttgttgcatacgtttgaaccaaattgtttcatccagtgatcttactgtgtttcacttttttttaagaagtgaaacattctttcgctatttgctgaaacattgtttttatatagggtgaaataatacccgattttttggaaaccgttgtttcatacattgtaccaaaatatttaatgaggtgatttggttgtgtttcagctttttacaagattaaaatatttttgatctacttagtgaaacatgttcaatctacttggtgaaacagcgcccgatttttgaaaaaaaatttaaaaatcaggcgcccgatttgtaggcgcctctacgtattttacattactactagtaacgtattacgtagtaatggaccaagctatataattagtaactagttgggtgcccgtgctttgcaacgggaaaaaataacaccaactttgcctcaactcacattaatttaggtacaatatacgatgaagactacaaacgttcatctagatacaaatagctacaagtgatcattgtaccattatagaatagattagattgtaatcccatctaacaatgaaaaaacaaaaaatataattcaatactcataggacatacagtagcaatttcagatcttagctctcaccattgaccatatttaaatttgttctgaccaataggaaactaagatgatcaacagtatcagtatggccttcaaatttgtaaagaatacttcatacttacatgtcccatatatacccaaagctatcttctgatcaactaaaaatataatttccatttgtaataaaaaaaaacataggctggatgtaacatatgtgtttggaccttgccttccgaggtgagtcttgctcagcaccctcatttgctttccatgccaacaactctgtaccgtctgtaccctactcctttaacaactcaatgaaacagtggccttcatatataacatatattttcattattccaacactacacattctaaaatttgaatctctttacaaacaaacaacatggaactgaaggtctgaagccctaaagtaatgttcatgcaaagcatttcaccctgttcaactcttcatttcttcaaattttcaaatcacactctataattataattaccaaggaactaaaatattaattaaatggaaaaagaagaatatttcagtacattctaagaccaagtaaagaattactacaaaaccatcaatgaccaatttaattatataaagtatgcaaatttaacgccattttgaaaaatcaatagttgttgaagaaaaattggttatttgctgcatatccttcaagctttgctgctcggttagattgggaaaacagggaacataagccatggaagatatgtcacataataagttttatcaaaaaggcacgcagaagccatggaagatatgccacagaaccaaatttatccaaaaaatcacatcacaactatgtaaatgatgcttataaaaattacttgaatagagcaatgatcagcggttcattatttcctgaaacatataacaactgggttagaaattgtgaaacatttgatgactgcagaagatggttccgcatacctaataacttgatgacctcgaagacataacctgcaacgttctcatctaacagatgacagtaaatggaagatcaattccaatgtccttgtttgtactatatatattagtaaatagcagagatcctttgacagcatcagcaaatagaactacaagagaagcatttagtggagcataatcttctgcttcagtagaaatgattaaactcatatcactaagcaataaaatgtcaaaggccctcttctttgctaaataaagtaaggactaaggagcactgctgcagaataacaacaaaagcatcattatgcatcctatcaagtatagagaaagttagtgacaatttaattttcaacattgatgagctgttccataattgtcaacatgtttgcaatatgcagtatccagtgattcagacgatcacacccaaactttaatttcagaagcatgtacatatcaaatataaagaactaaagagtacatttttgtttgatattgacataaactctaaaagaaactatagcaaatacttcgattatttatgacaacttaatgcaatcatgttagggtccaaaaaccaattgtaatctcattatcatctcagagaaagcactattctcaaaccaacaacaggggccagccagatgttgtgtgtatcttccttcattaatctaacatatgcacaaaaagagatagaaaatgtacagctcatgtgacaactgtttacatacccacattgccatggctgagaaaccacaataccactccatgcagctggtatctccattaatatgaaagtagtaaaacatagtagtgggttatgggcttttgatcacatcagagcatcatggttagattatctggcagagggctatgtgcttttgatcacaacagagcatatcaatattcagatgcttgcctagttgctcagtcacccctctctatcaaaaaacaacatattgactgacatatcacctctaggagtataggacttcctaactgatcaggaaccatacataaaaattaacggtccttgccataatgcttaagctattataaacaatatattgatggacaaacacatgtaagtgtgatataacgctatgtagtacctacatgataattgatgccttaggttgagagcaaatcaagtcacaaaagaaaatgaaccacattaaccatgagaaaccataaaaattgaagtgattgccatggataaaatcaatggtccaatctatgataaaaacaaaaataggacgaagtagcagagaggtgtggcataacaaactcttaattttgaaaaattctattggcaatgtaatcaaccaattacaaagacatagtcacagataaataataccttagggacacacccttactcccacaaaatcatttgacatgtatatgtaaaaaaatacatgtacaaatttggtcatttcaaatctaacacctaacatagaagatcagttcaggagcaattaatttgttctgattctcacatggattagaatcaaatagatgatttacaaatcaaatatttgtagcatcaaacgagcatgaactgatggtttaattgccactgaagcaaacaaatgtaagtatgtaacacgataattaaccaatcacaaatgtacaaaggcatcactgcatacatatgacaccaatcagttagacaattgtacttttttttagaaaatcaaagagtatataacatgccactgaaatatggcatttgagaaaaaaagaatgaacaatcacctgagatctaaggggtatgtagtgctcacagtacttgagtccagggcagcctccttcgagcactgccacttcttgccatatataagctctaggtccagcttctttccgaagtacggtccaatagcactttccgaagtacggtccaatagcacgaaacacacatatcagatgaacagtgttatccctttacaatgtcatgaagatgcaacacacacttctacaatgtcatgaagatgcaacacacacttctcttgttagaagtcggtagaaaatgatgagcaagggaagagctgccaaggtgcttcaccaagacaaatgcttatgccagagagatagtggtaaaaaaactctttacctgatcacctcgtcgtcagccatggcaaggaggcggccggagggtctgctcattgcaggaggccgcagtagaagttgtgcagttctgggcatattgaccaccggcggcgatggatttgagtgcaaggtggtctcttcccttttccatctcgtctcgcaggcgagtcaccttgcggatgctactccatccagagccgtgggcggaggaaaagagaggaggcgtggtggtcatcgatggtgacctggcggcagagcttgcagcggatgggtggcgatggagcttgagggccggggacaacagcacgtcgatctgcgcggggcggtggtggagcttccggcaaagggaacagtagcgctcggctgagatcggtggtaacggtggcggtggtggtggcgggagacgatcgaggagagattgggggcgatgcggaggaggacgagaggggatcgggacgagtggcagcgcggagccggtcgtcggggcggagatcgtgggcggcgtttgcggcggcggcagcggtgcgggagggacctagtggaggagatcggcgagggcgacggggaggatcgatggaggcggcggcgctggtcggttaggggaatcacggtgacggtgggggagggagctggtggaggatgaaagagagggcggcggggaggatctatggcgtcgaagctggtgggggaagacggcgatggcggcgacgaggacggcggggacgatcgatggtggcggcagtgggggagcgatctggtggaggacggcgtgggcggcggggaggatcgatggcggcggtggcgcgggacggtgggggaggacggtgggacggcggggaggatcagctggtcgaggaggacggcgagggcgagcgggcgagaggaagggtggcgagaatgcggcgaaaagcgagcgggcgcgcggaagccggaaggccagggcgtactgggtagttggagcacgattggagcgcgatggtgcgggcggataggagcgtctggagcgtcgatttggtgcgaggatcctagaaaacatgtcagccgttcgattgtccaggactcaccaccaccactaggaactttttaagtagtaaagatgggttaggagggtgattaagaataaagcattagatctagatgggtacttcgatgggaggaggggatgaaaggaggacaagtccgcttttaaggtagtatagataaaccaaaagtgcatattcaaaattcaccaatataagaaagacacatggaaaaatagagttagaataatatatctaacttataaaccagaagtgcacataaatttaccaatataaggtcttgtttagttcccaaaacaaaaacttttcacctatcacatcaaatgtttggacacatatatggagtattaaatgtggaaaaaaatcaattacacagtttgcgtgtaaattgcgagacgaatcttttaaacctaattacaccatgatctgacaatgtggtgctacagtaaatatttgctaatgacatattaattaggcttaataaatttgtctcgcagtttctaagcggaaatatgtaatttgttttattattcgataaaatttaatacttcaaatgtgtgtccttatatccaatgtgacacctcaaaacaaaaaattttgccatctaaaccgggcttaagcaaggcacatgctcgaattcaattgacgtggtcaagggtactaatgtctgtacatgagcaattttgtactaaatatttatcactttgtactgaaatatataccgtattagctttttcacggtcctatattcattatcccttgtgtcaaagtacatcttgtattagttgtgctctggataaatcatagccttttaaacaccatctcaagccaatctaacaacagatgattcctcattcaagactttggttggttaatctctcccaagagaattgatagttaattggtggggaattttttggaacgactctcacaagacggtgcgaagttctattgatagagcaggaaaaaattacaagattacaaccctagaaggtcgtaaccaggaaaaacaaaaaaaattataccaacacccacacaccgacagcgccaacacacagaaccaggagaaagctagcaccggaccgactgccgctaagcggaccagcaccaacacacagttaattggaggagattgatcctctccaatccttttctcatagaagttagtcgaacaagttctaagttgatactctgacgatgtacctaatgaactaaacctaaacaaaatattggatggaaattttcaatcaaccatgcatacccgttaactaaaactttgtggcatagcaaagtgtggcaacatttttttttgaagaattttgtcctagtattcgctaaggctgtcgtgaaagatgtttcaattgccaaaaaagtttggcatcaatgcaacatatttacgacttcatgtataagctctgcaaactgaataaccatattcattacctgtaaatttcaatcctcaacttatatatctttttacatctaataagaagagaagctattctttataacaaagcactaaatgaagcagcaaccgtgtgtccagaacatgcagaaacattttatctaaaaaaacacgcataaacatttttgtaggaatttgttttcctcttctgatacgcaatatggtctatataggtggaggtggaattttttctctcaagggaacgtttactcgttttgtacatgtcaagaaaaacttataactttttttgatataatagacccatatataatatatcaatccatgcttgaattcaacctatacaaaatggaaaaaaataacaaaaatacacgtattgtttggactcaaaattattaatttttcacatatgttggaaattcgagtttgcatgtcaaaaatactggcatatcatatatgtgccagctgtatgccacatgttgatgcatcgtgtcaatttttttatgacctttgaaaaacatgcaaaatcaaagataatttccatgtaggggccggagatctagagagagagagattggaggggaaattggcaggataaagaagaacacgaagaacagagtatagtgtcttggagaagaggtagatgtattgagttttgggaagtagtttagtgtttacaattttcatacccctctcctcccttcatccaggcttatatagatgcaccggatacagttggaacttcaacctattcgggccaagcaattttgctcgctatgctgacgcacacgggatgaacatggcttccgtctgatcagattgtctgctgccgtatggtgaacagtggctgtaacagtgttgtcgctggagaggagtgtgagagtcgtaaaatagggaggaagggagggggagtgcagaagattgagcaacaacatagggagaaggagactaggagagagaggttagatggagaggcagagttgtggatggcgggatgaattttctttttacttgacacgaagtaattagttaataaacattttttattaacagaataacattaaagatttgctagttttgaaatatgccattactatttgtgtatttgtaactatgccattgttgtttatttgtaatctcagtgataccattatgatatgtattttacatgcattggacgaa

SEQ ID NO: 74541 - DNA, 1366 bp, Oryza sativa
ctcaatatgtggctgctggttgccacgggctgcttgcttgaagatgaagggatcaacgaatgagcttgctggggctagtttgctgcttgaagaccacgacgaagacaaagactcaaatcccatcgctggcgatgcctccctgttgctccctgattgggtcgagccgtgcgcatctgccgttagaattcggagcgtcagacagcactgcgcaggccgttgtgccaaatgaccttgtcagatgcagtgatggggaagatgaacagtagagaggagaggttcaagaagatggggtaattttgtccaaaaagtttagaaaatacaataaaggagtaggtagtggcataaaccaaataaccacgaaattataatggtatggttacaaatagttgaatactaacggtatatttcaaaactgacaaatttataatggcatgaatctaattaacctttaaaaaaagctaccatgaaatatcacaaatgtgtaaaaaaaacccaaatataacaaggcagtaagttaagactatattctaacctccctcttcccaccttccgctcgtttttcttgagcatatgcttctcaaattattaaatagtgtgcttttaaaaatgttctaaagaaatgttgttgtaaaaatacatattaatccatttttaagtttttagctaataattaattaattacgtcctaataagctattgagcaaagaaaaaaaaagttaactgctgcttgattatttgggttcaactggcaagaactatgaggggatatcgattacctattctgtggtaagcatacccattaattaatttacggccactttcgctactcgctaaaaatagaactaataatgacttaaaatagaaaacaagagaggagcaaacacgtactctgaatgaacggaggctactgacgaccaaactgaaccaaacacttgtgaagctctcctgccaaataccactccatacccgcgaaaaacgctattcaattagcctatataataacgcgtaaccacagcctcttaattcatcccagcaaaatcatctcgatcgatcgacaaagctatagctagcccagtcatggccgcctctcccgcaatggcgacactcctcctcctcctcctccatgctgtcctcgtcgcggcagccgatgccggcgccgccgataaggaggcctatgcggcaacaggatcaaccgctggcaaggagaccgctgcggcggccgacaaggagacctctgcagcggccggatcaaccgcgggcgccgtccctgaccccaacatcttcaacaaggaggccgtgtgccccaagacgacggacgagaaggcgtgccagcaactggtgaaggtcctgccgcccgagtttgcag

SEQ ID NO: 74542 - DNA, 18257 bp, Oryza sativa
caaccgaaggcaaggagaccgctccggcggccgaatcaactgtcgataaggagacctctccagcggccgaatcaaccgtcgacatggcgacctctgcggcagccggatcaaccgccgacaaaaacgcctacccggcggccgaatcaactgccgataaggagacctctccagcggccgaatcaaccgccgacacggcaacctctgcggcagccggaccaactgccgataaggagacctctccagccgccgaatcaaccgccgacacggcaacctctgcggcagccggatcaactgccgataaggagacctctctagcggccgaaccaaccgccgacacggcaacctctgcggtagccggatcaactgccgataaggagacctctccagcggccgaaccaaccgccgacacggcgacctctgcggcagccggatcaaccgctgataaggagacctctccagcggctgaatcaaccgtcgacacggcgacctctgcggcagccggatcaaccgccgataaggagacctctccagcagccgaatcaaccgtcgacaaggagacctctgcggtggccggatcaaccgccgataagaacacctatccagcggccggatcagccgccgagaaggagacctcttcggcagccggatcagctcctgtcgtcgacactgcgcctgcggccccgccgacaacttatgtttaattacaaacattcggtacttaatattttttaggatgctatacgaactttaaataactcttccaaaatttttactacaccaataaaaaatccttacaaaattttgactacagcaatgtttgtaaggagttaatcgaacaaggtctaagttgatactctgatgtgtctaatgtttcctaaacaaaatattggatgaaatttttcaatcaaccatagccgttaactaaaattttgtggcaaagcagcaaacaaaaattgaagaatttggtccaagtattcgccaaggctgtggcaaaagatgtttcagttgcccaaaaaagtttgtcatcaatgcaacatatttacgacttcacctataagctctgcaatctgaataaccatgcatagtttccaaaaaaaaaaaaaccatgcatattcatcacctgtaaatttcaattctcaacttatatatctgttttcatctaataagtagagaagctattctttactataactaagcactaaattaagcaacaaccgtgtgtctagaacatgcagaaacattttatctaaaaaaaacgcagaaacatttttgtaggaatttgttttcctcttctcatatgcaatatggtctataacactcgatctatataggcggaggtggaattttttctttctagggaacgttgtcaaccaaaaagttaaaaaacaacttttttttaatataatagacccattataagatatatcaatccatatttgaattcgaccaaactaacacgtactgtttgaactgaatattattattattttacatatgttgagtttgcatgttttatgtaacgatatgccacgagcgtttaatatttcggtttggtcatttgtagggtgaaaatttcggtccgaattatatgaatttttaaacaaaatttgaataaaatattaccaaattcatgaaaaaaattaaaaatttcagccaaaataatatcatatcgggggggggggggggtccgatagaaccaaaattttccaaaatccgaaattttgaatcctgtatgccacatgttgatgcatcatgccacctttgaagtttgaagtgaaatgcaaaatcaaagataatttccatgtagtgataataaatactccctccattttacaatgtaagactttctagcattgtccatatttatatagatgctaatgaatctatttatataataatatccagattcattagcatctatatgaatgtgggtaatgctagaaagtcttacattgtgaaacggagaaagcaaatcactttcctctctatagtctatacactactcttcggaaaaaaatttggtggagaccgggtgtaaaccggctcccgtgcagccccgaccccgatggttgctacgtggacaaccttaggatcgaacgtctcgctgtgcatggctgtgcatggctccaagcgcagcgcaaataggacggaggagtcgcgactcgctcgatggctctgggcccgtcagctcaccggctcagatcatatcaacatctcttctcagcagcagccactgtcgccgatgcagcctctctcgtccgtcgtccgcatggcggcgatagagagtggccaagggcgaccgccctggctgaggacgtacgaagacgacgcgccgcttggggcaacgtagaggttgaggtcgccctgtttgccggcggctagcgcagagatgtactccatcttcctatatatgggcagtagctgctatactatctcttcccaatcacaggctcacgggcttctttctcaccatggcgcatgattgatttgattagttagtatgatctgggcttctgcattcaaactttagtgtagttgttaactgctacattttaatggatgtacgtagtctgaatgtttgcagattctaattagatttgataaagtactaatattgattttggtcttttaccatgtagatttgatacatactaaagattttggagatttgagcatttcatttcttcatggtcacttggtcagtgcatatatttcagtaaaagatcagtgtcaagttcagttgaacaaattaacatatcatacggttttccggccgagtggacgacgttcgagaaagggagtggtgacggacgagagactgtagatgagaaaggcgccgcttgccgccgctggcagcggctgcggaggaaccggtaggagagggatctgagcctgcaagccaacggcccgggagccgagtcgagcgaggctcatctgccatatttgcgttgtgcttgaagccgcaacgagctagacgtccgattctgagattgtccacgcggcaaccatcggggtcaggattgcccagaagcctactcttcctcggaaggatcgagcacatgccctgcgaagacgatggcttgcgacctctcctccacgatgaagaaggcgaacggatggtcggcgacgaagtccaccagcttcggcggcggcgtgtagtcgtcgtcgtacagcgagcacccgaggtcgtcgtcggactcctcgtgtacgccgccgcctcgctcccctcctcgttcacctccaccaccaccttgtggatcacgctgctcacgaacatcgccgggtcctcgccgtcgccctccaccgcgatgccgctcatctccgcggcgaacatgtcgaacggcaggcggagcccgaggccgcggaggacgtcggcgatgccgtagtggcagaaggcgagcttgaacttgggcacccggaacctgcccacggagacgcaccccggcgggaggtgctcgtcgacgaactccggcgaggcggtgatcctgtcgaggaggcccgggaggccgtcgcggtcgtcggggaggaagacgagcatggcgaacgacgggaggctgtagcggagcttgaggttgtaggtgtcgctcgtcgccttgtacggcaggcggagcaccctgaagccgtcgtggcaggcgacgtggtggtagctccccgacggccgctgcatgaaggggacctcgacggagctcccgtcgaggcggcggaactcgcgctccgccgtgtcggacttgtcgaacggggcgagccactcgcccttgaagtagatggcgttgccgacgacgtgcctcgtgtccacgctctggctctccggcttgatcacctccgtgatcaggttcttcgtcgccctcgccacccacgcgttgatctccttccttgcttccaccggctgcatcatcaatggccacacatcaaatattaaatcaaacaaaagttgatgaattagctactccatccgtctctaaatatttgacgctgttgattttttagcatatgttttaccgttcgttttattcaaaaacttttgtgaaatatataaaactatatgtatacataaaagtatatctaacaatgaatcaaatgataagaaaagaattaataattacttaaattttttaaataagatgaacgattaaacatatttaaaaaagttaacggcgtcaaatatttacaaacggagagagtagatctgatgaatttgaggtggatttgtgagaggatttacgtgattcttgaagtcgacggtggaggcggcgcccttgtacgtgccgacgatggcgtcgcggtacgccggcttgagcgagtacgacgcgtcgagccacgagccgcaggcgaaggagacgcacgggccgccggtgggggcctggtcggcgaggacgcggcccatgacgacgccgcggacgaacgcctcaagctccgggcgcgacggcgcgccggccacggcgaggatctcggcgagcgtgctcccgccgcgccggccgacatcatcgcgacggcaacgtggatggacagcggggagaagatgaggttgccgcccgccgcgcccgacgagcccgacgcgaggctcttcagcaggcgcgccgccagcgccgcctgtccggaccggcaggcttcgccgccgccgaccgtgtcgtcctccttcgccgccgccatggcaaatcgacgacttcttggcttgctggctgcacgagatgttaacctaatccggtataataggtggcgttgcagctagcgatgcgtcaatttgtagcggtttcgaagtttagatttgattcggagtagaactctacatgtatacttctgtttgtgaattgtgacgtgccgattacctaaaaaggatgccggcgatattttcagtttctgggctcattgaatattctattttggaaaaagtccaaatactctcctaagctccgcctatcaccttaagctttaaaaccggacatttaaccccctaaactttacaatacaatctatattacaaagtttagaatgctagacggactttcatctaaaatttaggggggggtatttgaattttttccttctatttttctaacatataagtgtactttatatgtaaaaaaaactttatatgtgtactatagttggagaaagtgtttttatccgtggaaggaatgttatctttttttatgccacctaaatagtcattaaaaaaataaaagacattgacaagatagattaatatgaaacattactccacaaacatatatcacggtggttgtggagttggtcaagagctatctgtcctcgccattgccaattccaattccttcgctcgcgctcatgctcgatctggtggtcatgacgagggggcaatcagacctacacattacaacagaaccaggcattcgtaaccccaaaagatatattatactgtctaagataagatatggaggaagtggaagatgaaccatcacaaaagtaggatcatcgttttggccccacgtctgtgacggttgcaatatcagtgatatattgtaaggtctatctgtctatcttcacggaagacgtatctttgttccccgtctaccaaactgctcaccttctctcttgctcgtaccctgctgcttactgaccctctcgcacttgccctctttgccatggcctcacctcttgctccaactccaccgctaccgcacatattgtgttcccatagtggagctttccacctcctccttaatgttgtcgatgcctcgagatcacccaaccaagctcgccgtccttgtcactgggctgtctagatccaaagcagcttccacttcctctttctactcttgttgtcaacatccgtagttctagtggtaacaaagtgcgagacgtcagcctagggtttacttttttggtttagctgatttgatcgaaggtcaccgatataccgaaatttcgaacaaaatttagttaaatttgaacaaatattacctaaatcatgaaaaatttaaaaaagtaaaaaatttcggccagaataatatcatatcagaggggtccgaaatgagcgaattttcagaaatttcagtccgaaatttctaaccatgatcaggcctggcctcctaatagtcatggtccactagatccagatgaccctgacctcatggtggggtggtgtcggtggcaaagggtggaggaagtagaaggtggcaaaggtaggaggaagtaggaaggtagtgttagcggatcagatggtgcttgatgctgcaacttcaacaaaggagaggcacaggctaatataagtgtttggtggagtggcctcgacgaggacgagcggctgtgttgtgatggcggcagctagtggcctcgactttttctaatagctagctgctcgggcatggcatgcaagcatgtcgacgatgacatcgagatgtggatggtgacgagctgatggcacgacgagcatgattcaggtacacatggccggtacgaggatggcaacatctctcttgtcatctcatgacaatgttggaggggatgagtggtctggccaggtggcgacaccaaccatggatgggatgagtgggatgagtgtacgcaagcgtcctttttaatctttttaggaaaactactacagatggtgggaaactattttaacatctcgagtcttgtttatatttttttaatttactagtttacatataataaactagcatgatggcccgcacagattgcgcggctagcatcattatattttctttcatatattagcatatatgttttctcattatattattaaaatatattacaatgtcaacataattttacattttgtaataactttacgaaactactaatgtgtaatattcatattgtattttatatacgtgttagttattaattatttttaatatcaaattttagttatttgtaaattatatatattcctatatggactctagacttatcttttaatatttctttttttaattctgaatttttattatttctaattgtatttctatatggactctaaacttatctttcaatattctttaatttttaatttaaaattttagttacttctaaattgtattcctatattaactttaaactattcttcccatgtttttcctaatttccaattttagttatttgtaaattatatttttatacggactctaaacactacttttcattttattatgtttattttgaattttagttagttttaaattcctatatggattctatactctacttctaatattccttttttttattccgaaattttatttttttcataattgtatttcacttctaatattccttatttttaattccaaatttcagttatttcctaattgtatttctatatggactctagtctcctcttctaatgttccttattttttaattctgaatttcaactatttctaaattgtatttctatatagactctagtctcctcttctaatattccttatttttaattctgaatttcagctatttctaaattatatttctatatggactctactttttctttttctccgattaatgtgagaatttctaggccatgagagcgaacgaggaggctcctttttctattcctttaataatataatagatagatggatatccactcaaactattagaattcatctccgtagattagtaataggtggtcagctgtcggaacaattttttttttatcaaaaatgaacttttttttaccacttcacataactattctagtgacatttgtcaccgacgtcacaccatgctcagaacagcaaggagttagttagatctagcggcctccaccctagctttcccatcatcactgttgtcatcaattcttgtgcttggtgacaaatgtgatagcgctgagctcaggccgtagatttggtcttcctacatctcctcttcttgtcattgccattgctggagactgcagggtggtggtgtgttgtcgctggagagcgtgcgagggtgagccctaaaatagggaggaagagagggcgagtgtagaagagattgagcaacagcagagggagaaggagagaggtgttagagggagaggcggagtagtggatgcatggcctgatgagtttcccttttacttggcatgaagttcttttatgatcgaacaagataacacaaatgtagccatatatatatatcacaaatgttgtctgttcaacgaagagctactaaaaacccaaacatgtctctacctaacttacttcctcggtttctgtgattacgaactgtttagtgcactttttgtaaaagttttctgtaagaaagttgatgtaaaaatacatattaatcctttttaattttttagctgatacttaactacttatatgctaagagcacccgcaatggtaaagtaacgtgctatctataaaacatgtatatctcagcaattgattagattaatagtaaaccacttcaatagtatgtctacatgggtatctatagctctctcatgcattgcctcgtttttctctatagactatctctaagttagtagatagttttgctctctcttttcatttaatatcttccatgtaggaaaatatgctgacattgatctcttgtatagagcctataaataatcattgtgggtgccctaataagctactttattttacgtgcggaggaaaacaaaagttcccaactactaacaaacacagcctttaaattggttttacgctgattacgagtatatatgttcaatcggaaaggactatatacgaggggatatcgattacctgttcttagctaagtgtacccattaattaatttacagccggatatactttcgctgctaataatgacttaacgattttgctaaaaatctggcgacaaatttttggcacgaaatcactcggatttacttcccttgtggattagtctgtgcatgatttaattagcggctgtgatgcgtttccttcccacgcacgcatgaggccagcaacatctagcttggcacataattgatgagtacatacattgcacgtcgttgcagctaggtgaacagattgaagaaataaaatataaagttacagtcctatataactaaaattacattcgtaaattcagttgatatgacatgtaagtgcactataattttggtaaaaatgttgtgtaagtaaatatgtacttgttatttcctttaaaatataaaattacaatcctatataactaaaattatatttataagtttagttgatatgacatgtaagtgcactgtaattacactatagttacactgtaactacactatagttacactgtaactatagtgaaattacactgtaactatagtgtaattacactgtaacttttagtagatgggttggtgatatatttttttcaatgtaaagatctaacaaataaaatatatgcaatatatataattaatatatgttgatacatgtatagactcttctaatcaagtgatcaaatgagcctaatccaactaatctaaaatctgtgtgatttggacccaaaaatctgtcgtgtgatggatagctagtcccatgacttaaaatagaaaaaaagaagtgtacaaaactgaaccaaacacttgtgaagctctcctattagttagatccatgcaggcgaaaacgctgtgcgattagcctatataaaaacggcgtaaccacggcctctttagccatcgatcaccattaattcatctccatcgacaaagctagctaagcccagtcatggccgcctctcccgcaatgccgtcactcctcctcctcctcctcctagccgttctcgtctcggcggccgatgcctacgactccgccgccagcgccaacaccaacgccggcgccatccccgaccccaacatcttgaacatggaggccatgtgccccaagacgacggacgtgaaggcgtgccagcaactggtgaagaacatgccgtccaacatcgtcgcggggaagaaggacgccaggagcatcgcccgggggtgcatcgccaccgcctggttcgtggcgagggacggcgccaaggactgcaccgccgccgtggacgagtgcaaggacaaggtcgaccagtgcttcgacagctgccgccacgctttcgccgccgtgaacgacgccctggagccccagggcaccggcgacgacgccgtcaaggtccccgaggacgagaagctcctcgccatccacgcaagcctcaagcagttgctccgcggccccacgggcacgcgccgcccgcccctttgcaacacttgctgccaggacggctcgtgcacggaggagaagaagcgcaacgtcgtcgcgctgttcgtgcaattgtggagcttgctggatttcgccgacgcggtgctcgaggacctgtatcctctgacgaagctgccaggggacaaggccgcgggatcagatacctctgcggcggcggccggatcaaccgccgacaaggagacctctgcggcggctggatcaaccgccgacacggcgacctctgcggcggccggatcaacctccgcaaaggagacatctccagtagccggatcaaccgccgataagacctatgcagcggccggatcagctcctcctgtcgtcgacactgcgcctgctcctcccgtgacaacttatgattaattacaaacattcggtatttcatattttggaggatgctataggaactttaaataactcttccaaaatttttaggacaccaacgaaaatccttacaaaattttgactaatcaacgtttctaaggagtttaacaaatttctatacgtgtaactttttcttacatatctgagtaggtgcattgctgagggcagggtgcgccttccgtggttgtcattcgaaattgtctttgtaacctcgtcaatttaatgaagtttagaatcaaaatgatgagccttttatctcacttattgtcctctttttttttttggcgcccgtacacattatatggtaccaacgtaatttttaaaagtcaatagcagtttattattacaaggacattcaaatatataaccatgggcaatagtagtaatggtctaactacaatatatattaggatcgaaattaacatatcgtcgtagactacattcatatgaagtaaatcaagtatatataattgtgattatgtgggttttaagatcactttcagtgcaataacttttaatgtaattggctaagtttgatagcatatttctattgtccggagaaaactatgggttcaaatacctacaccatccgtctaaaaaaacaaatgctgactatgaatttggacgaacacatattttatagttagaatttgatttctttttttgaaatagagagagcacaaatttaattcgcccctacatacaaaggctgcctcctataagatccacttacccggaaaaatatgtggtgaaaaccacatgtggaaacttagaaactatctttggatcgaaaaatggacgtctgacattcgtccacgccatcacgagtaaaaattttactcacggatttactcataagtaaagattttaccttgagtatttttactggtaatgacgtgaacaaatcttagacgtccattttttatccaacggtagttttcaagatttcactgcatagctggtttccaccgtatattttccctacttacccggtcagagtgggtagtgtccagcgatgtgtaactactaactagttaacaacttgattgcattgggaagggagattgatgatatatttcaacctgaaattggattaatgttaagtacctttctaggtatagtgagtgagtgatttttttttccatccttatttttagaaattaagtcttttgattgacaccaaattattttctttttctttcctgcggtttggtgcttcctcttgttcctcttcctccacacagacaacttataaattgaagatatatgtttataaaaaaatataatcatgtgagatcttattagcaagagttaattgtaacgaatataatgatgtaatcggatttcaattcagataagtaatttagaagaagaaaacaatttgaagttttattggagttgtactttgagaaaaaaaaagataatacaaacatgtagcaagccttagcatagcatgtaacttgcacgatttatcaattagtgtcaggattttaatggacatgaacactaacgtaacgcgccggatcgataatttcctccaaacttttctggagaaagctagccatcaaacgtcgctcactttgccgcatctctgtagcgttgcatgcgtacagggagctaggggtggcggagcatcgtatgcatgtctgactctgcattctctctcccttttctttttgtttaatcaaactttaaacaacttatttctaatttctaagatattccaaccgtcaaaaaaaatcaaccttatgatatatcccagtacaataaaagtaaatatagagggagggtggaggggtggcgatcgctacccggtcgctaccgcgatcgatcgcctattagattttccgagagagagagagagggggggaggagaagaaaaggtggtggggttggcctaaaaagaaaagtggtgggtccaaccaaagatgagtgcattgtagagaggggagcgtcgactgcttttcttcctatgtggatgtttggcgggacgtattgctactaccctaagatagtgcgatttgatctgacttgttgactcttatcattctcctattagttcaataagacatactaatttcatcccaaaataactatgtagcaaaatctcttgtattttgagtacaactaacatattttgtcagttttgtttcttatatttttctataaatttggtcaaatataaagaaatttgaattatgaaaaaaattcaaaacaaattataataaaacggatgttgtaccaactaacttggctgcagttaatgacattaaaatagttactcccccatcattttggaacatagagggagtaaatagattccgtttatctaaagtagttttgtttgtaatgttatactgcatgcgtgaaactgatgcagttatttgataacgttccacacattttgggacagagggaagtacatatgtgagctgctctctccgtttatattttaagttgtttgaattctttcttaataaaattatttaaatttgtccaaatttataaaaaaaaagcaacttctacagtatcaaattaattccactaaatttgacattgaatacgaaaatgttactatattttgctaaaaacttgatcaaactttaaaattttgattaaggacttatataatataaacggatcgagggagtaattaagaaacggatcgatcatatatcacgatctaaaatgatcatcttcgagaaaatctttggaaggatagaatgtatgaactaaggtgatcagcatgcattattcctcggtcggcccacgtacgtggcattgctctcctgccacttaacacatttttgcatgcagactgaaatcgcgcgtactcatttcatgttccctttttttttaaaaaaaaaaataaagcttactcattcattccctccattcacaaaaaaacgatgttttaggcattttaataaagtcagtaaaatatcaactaaaagagtcagtaagatgtaacctcgatcactttgataaacaaaaaatagttgcacaagtataatactatgacaactttgtatataatgactgttactttaataacgtgaacaattatattatggtgaaagttagcttctaccacctatatatatgtacggattataaaatgatattttagattgtggaaaatatcaaattcaacatattattaacagtatttgtagtactattcacatagtacaaattatccctctctatagggattagaatccatcttcgtataacatcctccattcctccactcatcatacagtcatacatggaggggaaaagatcgatcaaatcacgtgatttctgatataccatttgcagtacatttttgagagaaaaaaaacgcgtaggaggaatgggaggatgtccatcttcgtaatcaggaagagatacatgcaaatcgccaaattgagctaatctgatatgttgcccttaattatgtacccatatagtactacaaactgatgatccctataaatagtgacactatctacactaattttcctcacaccacagagagttgaaccaaaccatctaccatcaagcttatctaacgccatcatcgtcacgaccatgacgaccaaggccaccacccttctcctcctcctcgccgccgccgccgcggcgctcctctgccacatccacgtcgccgtcgccgccggcgaggacccggagccgtgcgagtgtgcgacccgtcggacatcaccatcgcgacggtgaagaccgggcgggtcgtgggcggcctgccggagttccaggtgacgatcggcaacgagtgctcgtgcccggagggggacgtcgtgctgtcctgcctcgacggcgtgcccgccggcgtcgaccggagcaagatccacgccgccggcggcagcgacgggctctgcctcgtcaacgacggcctgcagatcgtgaaggggtcgccggtggtgttcacgtacgccgccagcgcgccggtcagcctcgccttcgacaacgcctcgccgcggtgccaacgacgttgagtttggctgcaggcgtaccattaattgcttgcatcatcttccatggaagcgatctgttatgtgtcatgtgtgctgtagcttgtcagctgttgtgttccctgtattgagtataactgggtgtttgggcctggcttgttgtgggccgtggaccgtgtgtgtgtttacgacgtgccgtgctggactggcggtcgtgtcgagtgcgtgtgtcttgtacccgttaaaaggggaactccctgccgatgagcaggtatcgatgagaagaaatcaaatacaatcaaactacctctctctctctcagttcatccccttcctctctaattcaacccaaatcccctagcgaattccggattagcttggcgtgacgccggcggagtcttggagttcgtcacatctggtatcagagcagtgatcccgctggcgaggaagaaggggccaaatctcacggagaggatggttgctgcggaggcagagctcgtcgatctgaatcagcgagttggggagctcacgagcaacctcaacgaactcctggggtcgctgaccaagctggagacgtggattccatcggtggacacggggatccaagcgctgaacaaggccgtggaaggaatcgccgcaagagtgacggttttggagaacttacctgcagcggcatcggggatgacgaccccaacgcccatcgagcacggcgaaatcgagaatcaccagggagacgaatccaaagccctcgcggctcaggatcgatccctggtcaagggtaagtcccgattccccaactctcccatcacttttgatataggagagtcttcagttcagaatcaatccagcaataggttccaaggtcctaggcttcccaagtctgatttcccaaagtttgatggtaacaatcctaagctctggaagaactctaaaaagtattttgaaatgtatcaagtgtcttatgaaaattgggcaaaatttgctaccctccactttgttggaaatgctgccttgtggctccaaacttatgaggccctccatagtgttgaaacctggcctgaactctgtatagcagtgcatagcaaatttggcaaggacaaatatcaggaacatttagaagagttagaagggcttaggcaaattgctagtgttgaggagtattacaccaagtttgaggaattaatgcatagggtcttagtttataatcaggcctatgatgaaacctattttgtcacaaagtttgttgggggtctaaaaactgaaatcaaagcagctatatatcaagctgcataggcccaggactgttgatacggctttgtctcttgccaaaacgcaggaggaacttgtcttggagttgaagaagggtactcaaaagctgggttacaaagagagttacaagttagcggctgtgaagaataattaccagggcaagggaatattggggcatgctcctgatgatgctggaaaaactgaagagaaaccaaaatgggaggacagatttgagtccttgaaggcttccaggagagctaaaggagaatgtttcaaatgtggagaaaagtggggacctaaccataaatgcccaaaatctgttcagttgcatgtcttggaggaattacttgaagttcttcaaattcaagagaatcaggaagctgggcaagattgtgaatcagaaggcagtgatgaagaattggtagtctctgaatgtgcagtttcaggaactatgggaaaaagaacagtcaggctgcaagggttaattcaaaatcaagaagtgctgatattaattgattcagggagttctagcagttttgtggctcagcatctggtggatagtttgagtctggcagtccttgaaacagctcctgctcaagtggttattgctgatggaggtgttttacaatgtaacaaggtagcaacaaaggttgattggtggtgccaagggcatagttttacttcagatctaaaggtacttcagcttgggggatatgatgtgatcttaggcatggactggctagagcatttcagcccaatgtggattaactggcaaaggaaaaagttaaggtttacataccaaggaaagagaattactcttactggggttaaggaaaatctgtctgattgcaaatcagttactgctaagcagttaaaaggaatgttcaaatctagagctattgctcaagttgttcaactatgctcaattgaagaaattgaaacaaatgaacagttgcctcctgaaattagtgcagtattgcaagagtcccaagatcaatttcaggaaccttctaggttaccaccacatagagattttgatcataacattcctctcatgccaaatgccaagccagtgaatgctaaaccttataggtatgctccgaaacaaaaggatgagatagagagacaagtgaaagttatgctggaacaaggaataattaaggacagttccagtccctttgcctctccagttcttctagtcaaaaagaaagatggttcctggcggttttgtgttgactatagagggctgaatgacattaccattaagaacaaatttccaatgccagtggtggatgaattacttgatgaattggctggagcaaagtggtttaccaaacttgatttacggtcaggctatcacaagatcagacttttgcctcaagatgaacataaaacagcatttcgaactcatcaaggattgtatgagtttagggttatgcctttcggtcttaccaatgcaccagcttcatttcagggactgatgaacaaaatctttgcactaatgatcaggaaaaatgtgcttgtgtttgtggacgacattcctgtttacagcaaaagcttggcagaacatgtgcagcatttgagacaggtgtttcagatactacagcaccatcagctgtttgtgaaggctagcaagtgttcctttgccaaacaacaattggagtatctagggcatataattggtgaacatggggtggcaacagatccagcaaaagttcaagcggttcaggaatggccggtgccaaagaatctgaaacagttaaggggatttcttggacttactggctactacagaaaatttataaggcattatggagttatcactcgaccactaacagagttgctcaaaaaggataagtcatacaattggacagatgctcaacaaaaggctttctgtcaagtcaagatggctatggtccaggctcctgtgtctgtgctggccatgctagatttttctcaagaatttgtgttggaaactgatgcctatgacaggggtattggagctgtgttgacccaaaatggacacccaattgcctatttgagcaaggcccttggagtgaaggctcaggcattatcaacatatgaaaaagaatgcttggccatcttaatggcagttcaaaaatggagggcataccttcaacattcagaatttgttattctaacagaccacaggagtttgactcacttgggtgaacaaaaactaaccacaagtatgcagcacaaagcttttgtgaggttaatgggccttcagtatagaattcaatacaaacaaggatctgaaaacaaggtggcatatgccctttcaaggagagatgctcagacagaattgttagcaatctctgttgggaggcccaaatggttggaaatagtggtagagcggtatgaacaggatgatgaggcaaagcaactattg

SEQ ID NO: 74543 - DNA, 35697 bp, Oryza sativa
  unsure (1)..(35697): unsure at all n locations
tcagtaatccaagagcctgggtcacatgttagtccagatcatcgtgaagatggtggatcatatgaagtcgacaaatatgcacatatctctgacagtttttgtttagaaaagttaattgacttaccagttaagaataatgaattgccagaactagccagaggtaatgaaatgtatcctgttgccaagccaagcaagtgttttgatatattccttaacctatttgatttcttaagtaatgatgccagaaaatgggtctggggtagttttagtcacctggaaaaggagtacaagaaagagcttcagggtggttctttggacaagtttcatctcatcaacaaatacatccccaccttttcatcactggttcagcttaaatcccaaatggacatggtacagtttattgttggccctggtggtagtatcttgtccattgttgaggaagaggcatctagtatgattgcttatgcactattgatatctgagcaacaaggaatatattcggaagctgcaattgtaaaggatgaagttattgctggtagaaaaattgataaagtaacaccaatcaactcgatcggagatactcctgtgccatctgcaattttatctccaaatgattctttagaacaagatcataacctatcaagaaatgtgtcatcgttatcatccgaggaatcaacatctggattttatgattcttttctatctgccttaaaagatctgcatcctgaattttgtttgaataatgaaaagctaactttgaagagcaaatacactgttctgtgtatatatgcaaaacaattctacgatcttcggaagatttgttgtccatcagagattgcctatatttcatctataagccgttgtaaagaatggaatgcacaaggtggaaagagcaaggcttttttttcgaaatcaatggatgacagatttatcatcaaacaaattaagaagactgaatttgactcattcttgaagtttggccttgagtacttcaagcattttggtgtatctcaggcctcagttaaccccacttgccttgccaaaattctgggaatatatcaggtctgccaaaattttgagtacttcaaacatttctgttgaatgtaataaaaaactacttataactaatattgtaattctctctaacaaccatgtcaggttaaggaaatcaggaatggcaaggaggcaaggaccaatttcatggttatggaaaatcttttgtttggacgtaatataatacggagatatgatctgaagggtgctcttttctcacgatatgttcttgactcaaaaaatcctgagaatgtgctattggatcaaaatttcattgaagatatgcgtgctatgcctatctacattgaaggcaaaaccaaaaacctcttggagcgtgctatttggaatgacacggcgtttctaagtgtatgtgtacctattgccagaaacggatttccgctagtgtatatgtattatttttcttcataagagtatattcaggatgctagctcttctttttttgtccttttgcggcgacatgatgatagctctaaagttcacaatttgcatttcttttatttgcagcgcatgaatgtcatggattactccttgtttgttggagtggacaaacagaagaaggaacttgtgtttggaattatagattatttgaggcaatacacctgggacaaacaattggagtcttgggtgaagacatcactttttgttcccaagaacctatctccgactgtaatttccccgaaggagtacaagataagattcagggcattcatgtctcagtatttcctatcagttccagatgcttgagttgatgagttctgaggcgttgaacacactctggcttttggtggctgaacttatgttgagtatggtttggttaaatgcctgtttggcatacagtaaatcatctcatgagttcaactttaagtttcattttattcattttttcaagtgtgggtctatcaccatccatactgcttcgcagctgctgtacatagcatttaggatataggttccctgggggaccacaaattttaagcaagggagcggtgactggacctacatataaccaacatgttccttttttgatgagcattaaggtggagttcaccttttggacaactagcttggagtgttatagagaatatggcattcatgtattcatttgtgttattaggagtaggtttctggaatcaaatacatatctaaatatgtgtcaattatagcttgttggttaagcatccatagtggtatgacgtgttattgtcgtcctaaattcctaatgctatttaaatcagtcaatgtctcttataaactgttcacttatttataagttacctcctaaaagatctgtgacaggtgatcaatcgaaaaaaatatttccatgatttgttaggatttagaaaaatgagttgtgattaatctgcatatatccggacaattgtattttgttgatttagatatatggacagaagtatatttctcctgcacctgtgtaaactttggggtcaacatccaatcctacacttgtacctttgcattctttagctgtttacacaggtctcctccccaaagaccaccacgggacttgagctgccttctggtggtcatgtaagctgtcgatactgcacaccaagtggtaagctgtctagcgcttctgtattcattgagatggagatgtcgtatatggtgaatccacaaactgggtatgttaacaagcttaaggaacgggcaaagatttctacaccaagattctcatatttaccccagagcgggattttacatggatgaggctcattgctgataagtgcggtgcggtgctgtgttgtgctcatgtgcgacccggcgcacatcagcaggcttgtcaccacgatggtaaataactaccagcatggaacatttatttatcttgtatgtgtaatgtagcagaatctcttattaatacaatcaaaattagttgctagaattgttttgcttctagttgccctggaaactcattgcaaaagagcttcaatctttttgccttcttagtcacttggccatctagtaaggcatgtctgtttaaatcattgaatgtcacaatgcaacctttccttgtttcaggtttttagggtgacaaatatgtatatgtttttgtgtacgttgattaggttgatactatagttctgatgaaactattttgcaggtatcatattcaaactgagtttgaacttagtttatcaaagatcattctgattttcagaataacaaaggtaacattttgaggtatgtttacatgagcatgatataactacaaaattatattttccactagtccggacaggctgattcttaagttggatcatttccatagcaaaattattgggctatttatggttttttcctctggtgatggaaatcattctgatggactaagtaatcagcatttcttgttgttatcaactgcagtgtcttgttaatttttacaccttttagaaactgcactctccaaggggcatatacacaagataatatcacaagataactatttcttaagcagatttattggtaccattttcatatggcttgttgagaattgagatagtttccgaactttgagaaagttgactgtgaataccataacgatacatttataaatagatagagtaacttttgttacagttgtcgtaaatctctttgttgcatttttcatgttttacatgctatctcgcttgggaatgcaagcaagccagcctgcaagagggttcaacgctggcttgcttgcatattcttatgcttcgttaccctctagaattgttttatttccctaatatgggctccccagctaatgaaaagaaactccagaataatatgggctccccaaataatgaaaagaaactccagaaaggtcttctatgttgctggtgctgcttaatttggcaagttcaatgttcttaacgtccatattataatgacaatattgttccatgctccactgatacaattttcttattcctacaaggtagtcatactttggttcctgagcatttgctgtctattgatggtttgaatcttgttgcttttgcaggaatgccgtagtctctttaaccactgcgatgtggttacatcaactaacaagaatctaacaggtcctagaggtggtacaatatttttcaggagaggaaaaaattaaggaagaggactgttcttttttctcaaggggatgaaaatgaattgtgactttcaggacaggataaattttgttgttttccattcaaaacaactatgccaggacgggaggtccccatggtatatattgcttccttggtgataactctgaagcaagttgcaacacctgaatataaagcatagattcaacaagttaagaaaaatgcaaaagttttggcaacagctttgcttagaagaaaatgcagaattgttactattttagatgatggaaaatgattagtacatgccgactgctgggcgatggcacagataaccactactttgggatttaagaacttcaggcctaaccggtataattgtgcctaccattttcttaattaatttattttttaatccgtgagcacggttgtatattcatttcattaggcctccctagaaactgaaatgtcattgcatgataaacatatactccttccggtttcataatttttgatttgtttgacaatgacacggtctgtgtttttctattataaatgtaatgtattcctttcttccaaaaaagtcttatttcttttttcaccaggatcaaggtgtaaactcattcatcgtgtaacacaaccaatgaacatgcaaccaataagtattaaaatgacttattggattccaataaaaaatttaatatagcacatattgactccaaataggacttagacttttagaaaaaccaaaaaataaaataggacttagaattttggaaggagggagtatacaataaggctcccatcggatggcctaatcagtaaaagaaaaagccagattttgaattttcaaacttaattttgagattgattttgagatattttcaacgtagtttcttttacaacattggcttttaagtcaccaagaacacatttataaaaatttcatctataaatttatttttatttcctaataagccgttttgacttattaggaaataagccaaacgatggggacctaaataaatacatgtttacttttattatagagctttgaaagatagatccatatatgttattctagttcttttaaactaaatacgtttaaagttattgatagtcaaagttataaaagattgactgcaatctttgtccaaaacgttatttcctccgtttcataatataagacattctagcattgtctacattcatatagatgttaacgaatctagacatatatacgaatctagacatgtatatatgtctagattcattaacatctatatgaatatgtgagatgctagaatgacttacaatgtgaaacagagagagtaactattatggaaccagagggagtatgcttactaaacttgaaacattagtgcctgttattttcttgagttgcttaaagtcttgtcagtggcactattcctcttggacccatttgtttctatagattacatgatgtgtacatgcatatagtttataagtagtatgtaaactagatggatgggcgcgccctggcgcgccgcctgtggatagttggattgccgggtgtaaacgttaatgtcatagcattatcagttcagttaatggagtggatatggtgcaaagaaactgacttagactgtaagagtataagtgtcatattactaaggtttatgaaggtaataaaatgatcagcaacataatataacatagcaagttatacagaaggtggtgcatcgttcattgggtatatgagtaaacaaaatcgtcaatgacagtgataaggttgttcttaacaactacactacaacagtaggtgaagatgatgtctttaacataacatttacagagaaacaagcagcatatagcagggatataaaggttataaatacttagcatagtggggttgtcttacggcagctagtaggtgttgataaagtattttcatgatagtacaaggatggttcttctgcagcgcatgatcaatgcattcacgttatatgtattgttgcttgtagctgattcgtttcgtagaagtggaaaatgcagattattcccacttgtattttattggccgttgcaaactctgaccatcctgcttttagattgtaccgatcatctgttgacttgtgaagaaccatggtggttgatgtgtttcctgcagtatgcacttgatcctttgttgtcttgtgttgggtgagtggctgaatgtatttttctgagaattcttttgtgaagtactgttattaaaagtggatgttaggcatttatattgcataagagtggaatggtagtgagcgaaagatctctccactcttgtcttacttcatgaatgtctggttgatagtaacaagtagaattagaatttgcttgagtgatgcgggaatgtcgcaatatctttcacgtagttctttagttcgcttgatagctttatacttttgttgtagtagcacatatctttgacagtcctttttggttggctgtgtaaaacaaaagtagaaataatagaagtagataagtatttcagttagtatgggaaaaaatattgatgaattgcattgcaattagtatgtaaagtatttggacctgtagaagatgatccagtatgtttgttgaggctgagttggatgtggtggtttgtgtgctgtttagtcttgctagctctatctgctttttctacgtttgaccaaagcttcgtctgaagtgcgaacggagcaagaaagacctgaaaaaaaagttaaggcaatgtatgaacgaatttgaatggcaatctgtaaaaaaaagagaaagaagtggacacgtgcaattggaccaaataacagaaacaatcaaccatagccgaaaacgtggtcagaacataaaggaaagcactaaacactcgaaatggcaggaggaacaaacacgggcggtgacacagaagaagagtaggatgatgattaccaacagcagatgtcctatgaaagaacgaagctataaaaaaaacaaaacaaggaaacatatcattggaacgaatataaatataaaacggggtaaaaattatagaacaacaaaaaaaaagagataggagaatgtgcatttttttattccaaaagaaccaaatagataaatcaaatgacacaagcacgatggaaacatataatcaatgagaaacaaatatcccccgacgaacaaaaacaaatcaaagcaaaacgataagaaatggtaaatataacaaagaaaaaaaggcaattaccaagcaagaacgaaggttcacatgatgtgatgaagatggcgtacgacgaatcactgccttgtgatgagctctagcagccgatgcagatggcatgaaccaatgaaaccagcaacagcaccaaaaacctgacaaaaaaacatgaaaaaggaccatgacaaaacatgaacctgaactaaactaaataaaatgaaggggacaaaaaaaaagaaaaggaatgggaaagaccattaagagaacaacaacaacattgcaactagggtaactatcacgagaagccattcagacatacttataaaatgagagaaggagcaggaagaacgagaacgtgtacaggcatgcagcaaagaaagacatgcacagtgacacctaatcaactaacagtaatagaactcgccagcacacccacgcaaaacagagaagggatcgcatgattgacacgcaaagagatggatcagcacaaacaagacactataataatcaattttagcctctataccccaacatatctgtgtattccaaaaaaaactcacagaaaacaaaattttatcttcttcacattatataatcaagaaagacaagtactaaacgaaaaaacaacaagacacagacagaaagcacaaaggagccatagtgaaatagaaggaaaactgaaggcttaacaagagagagaacagagggagttaaccggaagaagccgtttacaataaccagcacgcgtgtgtaacacacggcgctaatccaggagattaaccggacagccgtgattagccagttataaccgcgggcacgaggaggcttcaacgcaaaccagcgacgtgtaaggcagcgaaatagccagaaaacaattccaaaaaaatgagaaaaccgggatagttaggagaattatcattaatcatagctgaaataactctgtttaacaataagaagaagaaagcatttcttggtacctcaaggccaaaagcaacattttattcttacatcagcactaacaaacgaaaacatccacttgtgtaagatgaataaatcatttttccccaactaaggtaaaaagcacagaaagatatgcatggttaacatactaatagagtgacgcatcaatgcacagtgctcaatcaagtcgaaaaatttcagaaaggtagcacaagtgctagtgcaggaatcacactaaaagcaactgaatcacaaagaacaaacatcccaatagaagacagaagctgacacatgtaaatccagggcgaagaacagacgcgtaaatgaaaagcaccacccgaatctctacttgttttgttggtcactgctacctgaggagaaaaaaaaggcattagcccgcgaaggcgatgtgttcgggcagcgcaatgcccaagccgcacggcgacacagcactagctgctgcagcaaagcaaaaccacacccacgacgccgcggcggcagcggcggcggcggtggcggaaaccaaatgaccggaagaaaaaaaacccaaatggctcgcccgcgatcgccggggcggctgctctcaacctcgacggcaaaataagagcccccatcttacacaagcctctcagttgagccccagaaatcatctgacattcagccacattattaaataccccctgaattcttatagtttccccatgttcttcatactctaaccatttctgcaaccaatcaattttcatgacccccagcccttccaaccaatccatgcctaatatggcatcatacccatttagaggtattagcttaaaattggatcgatagcatctaccttgaagccaccaacacagtcaggaagttgtttatcagcaaccctgaccttaactggcggagttgtggacaccactcctggaaaatggtgaatcatctgttcatcgacaaatgagtgggtactcccagagttaatgagcataagaagttcagtgccttgtattaatcccttaactcgaagagaatgggctgaatcagtgccattccaagcatgaactgagatggtcatgaggttgttctcctctgggttagactcaaggattgtctccaaactgtctgtttcttcctcaagttgaaatgcctctaactccaccacatgcaactggacggtctgagcacacttatggtccttactccaacgttcaccatgggtaaagcataaccccttagaacgtctataagaccttaattgagaaaccttgtcatccttgggagtagttctggcagactccaagattctcttttcctctccaggcgttgccacaggactcttctgacatacagtgccctgaactggtctagtgaaagccttggtgaagctagtaccctcagccttcctgaaagaaattttcttattcccatccaagatttcctcctgaagcatagccactgagcaagcagcatccagatccactggtttctgaatcatgaccactcctctaatctcatctttcaatccatccacaaacttggttaaaaaataaggaggggtgagagcattatcataagaaagcaggtggtgcattaagttgtcaaacctttcaacatactcagctacactgccagtctgtcccacatgaatccattgccttatcagggttgcctgtctatctctggtgaacttatgacagaccatgtcacacagctccatccacgaaatgcccaccatctggtgccgcaccgattgcaaccaaaatgaagcattaccagtgaaattcagcaaagccaccttaacccaattggctggatgcacaccatacacatcaaagtaaatttcacaattatctcgccataactgggtattctcaccatcaaattggggacaagacatgggggggacattaccaccgttgctagccataccatagtatccatatgctgatgactagaattttcaagagtgaaagggcttgcagaagtgaactgaggaaggcgatttccctgtggagtaaacaggaaaggatttggggaattaccattgagatcatcttcattcaacatctgactgggtccttggctgccttctgccttgaacaacaccttctgttgaacatcccgctggcacttctccaaccctgcctggatcgagttcactctctttgccaaatcgctaacagatccccccaactcgctcaccttctattccaccatgggtatgcgcgattccaccaccgccttcaacgactgcagctccgctagattcaacgcatcggactcctcccgtctcctccctcttcttctctgcatcctccatcatcttcaacaagagatcgagcttcccttcttgagccatgatttgagctgcttgtttcgtgatatacctaggtcgctccaggatgaatttttcccggtttcacctcgaatccagccaaccagatcaagggagccccaaaagcttttgcggaatcacactgattaacagcgaattcccacctatctaatggaattttcacgggcggaccaagggaatcaatgaaaccaggaaaggaatcgagggctctgataccaattgttagctacctaacaagaaaactgaacaagaactcaagaacagatagatcaacggggattccaacgaatttccgccgtttccgccgccaccaatcgccgcggatttctttcttatcatcgatagccaaaaacagagttttcttccggtctcacctcaccaaccctcccattacaggccaaaacataggctacacaataacacacgcttacagagcccattccggcccagacaaacgaacattagcctcgcgaagttttctttccctcccgccatcagcttccttctgcatactacttccaacatcctggctatcagcagcaggcgccttaacagttcaccgcgggaggacgccaccgctgggtcaccttctccgttgccaccgctgtacagacctctccaagctgcggtcaaggctcggtgagcatcctggacacccaagaaccccatgcatacactccattcacttagaaactgcctccaactcgacatgcacgcacatccgagatcttccaccgctcggacccaccggcggcgctcctccgatgtccactaaccgaggaaagtagaggaatggaatcgcaatatcatgctcttcatttcgtcttttggtcgcgcccccaaacgagtcaccatttgttgccggcgccggcgagcagaggtgccgccatggctgctctgctgctagatcgatgggagaagaaatcaggacttcactttgtaaatttaacaaactgtagagtcttttcctcaaaagcacaagacacatagtactgttgcaggacctattcgtaattattaaaaacaggaaggactcttaatgaaaacagctattcaacaagtgctgaattgttcaaatctactttaaacttcaaaaatgcataactaattcatcttaactccaatttaggtgaaaccaatttctgtagattcacgaaaatatgaacttaaaagttatgacataaaaagtggtactcacagtatgaaaatttatcactaaaactcatctaatttaagtcacacataaagcatgcacaaacttataaaatgcatataaaattaatcttagctcaaattggtgcaaacttaatttctatagatccaccaacatattatctaaaaacaaagtaaaataaaatatgtacatattttacatcaaatgccttaaaactaatatctttaaaatgactagatttagataagctgaactttagaaattcatatagaattcatcttaactcctttttgggtgaactcagatcctatagaatcatcaaaacatatacttccaggttgtaaaataaaaatatattcttactctataacaatagcccttaaatatttatataaggaataaacaacctagtgtacatttcaatttgtaaaatttgtagaaaattcatctttaatccaaatgaagtgaaccaaatttttatagaactggcaagtaatgagcttcaacatagtaaaataaaatatggcagcttctatacagattatagctctaaaccttaataggtaacctaagagctaatcacatagtaatggttaggcattatataggtgtagtggtatttaaatgcactctaactaaattcaactaaaacttaatagaccagataaaccatagttccattcctatgcatcaaaacttatcacacttagctcatacataaactacttctagattagcatagtgaataattaacatagatcatgcccctatttataaaacgtgtagtaaaatactaaaaactctaaaattatggaccaaagttaaattagttaactcaattactcattttgtacatcactggcaagatggaacaagttatggacctagaacctctatatcatacactatagggaccatatgcctacaacccgttacaacttgtaaaatacattagaaattcatagaaactctaaaaattgtgaaaccaaatgtgttagtcttagagaactcatatattcaccccagcaaactcaaatataataaatatcaccttacaaaagcatttcatagcagcacctaagcaaatactatactataccgataaaacttctaaaatccataactctcaaatggaatgagataaaatggaaattctttcacctaaattcagtttaaaccagcacctacccactgtgcacagatcatgcattttagagcattttggattttccgcatatttcggtgtttaatcgcataacatgtaatttatatagattgtcgcaataacggtgaagaagtgaattaggccctgacttttaccattaacaaggcaagtcccacctccctctctttgaatacattgctcctatgttttggaggttattgaaaatgtttgcaaatcctgcatgtcgattgtacattaatacgctaaaaccttgtaaaacttgttagaataacacctattgattgcattatcacttgaactccacatatatccataacctacattcttagccctagaaacaacaagactttatctttatatatatgagttataatgacactatgatactacgatgcttagccatgcttagtatgattttacttgtcatttgggatcatattaacatgaaaaatgattttatctaatttctggacaaaaatgaataaatggagaatttgagaaacaaaatgatgaaaaaccatgaattttaagtttgggcctcaagtggtacacatgtgttgattagttgtataccgatagggggagagtgtgcccaagctacttaaggacttcactcaatgtctgttcattatgtatatagtacaaccacatgtgctagttatgggatagtcctgtagatggccaaaaggcccgaggcccgacggcccggcccatggcacggcattttggcccggcccaagcacggcacggcccgatggaggtcgggcccgtgctggcccggtccgaccaccgggccgtgcctgggcccctccaccggcatgttgggtcggcccggcacgatgtgccggcagctaggcccgatacacaaaaaaataagggagtaaaaatagacatattatatgccatagatgaaagaatagggatctaaaatagactttttttatctacatatgtcagccaaagaggagggatggaaaatagacttattttagctatacatatgtcagcccaaagaggagggacggaaaatagacttattttagctatacatatgaaatagcccaaagagaagggatgaaaatagacttattttaaaaaaggcccgatgggccacccatgccttcgggccggcacggcacgacccaacagctggtgggccgtgcctgggcgggtggtgcagcccatgggccggcacgacccggcacgaagtgcctatcaggccgtgccggccggatggctgctgggccatgcctagccatggctgggccgggctgtgtcgggcgggccctttggccatctatagatagtcctagcttagtaatctatttatgatttagccttacattctagtaggctggtgtgtatgagttagtggttagctcagaggagcttcctgttacagctgaggcagtagtctaggtgactaagcgtgtccaatacaacggtattgtgccacgtggtgggtttactcgagggtagttcgtcaccacggcgttaagtttaaggcgtgggcccgccacttaatggttctaggtcatatttccagtatgcctaggatggaggaacgcgtatacccttgaattttgtttttgatcttgttcatacccattccgttagttgactgtttaattcccttgaaaaggaccattttgtccttagacatgaaggaaacatgaaaattgtaaactactcattccttctcaaattgatcatcatacaatagaattcaaaatttctcaaattgatcatcctataaacacatggacacgaatttcatcaaaatacaattaatgcagcatgagagaaatgtgtgcatgctaaggtgtaattgggatgatgttttaatcgatacatgcattgcgggagaatgtgtgcatggtgtcttgattgatatggtttaaattattcttggtcttagtgcataaacttatatgatgatcaatatgggaaagagggagtataattttgttacataagactactatattcatgattttttgttgtacaaggtattattcatggcaaagtttatttttacataatgacgtaaaaattaatatttatttacttattaaaacagtatatgtagcatttttatggtagttcaatattttcttttcccagttgtatatattatatagaaatgctttccaaagctatgtttatcgtttataaaatgctgcacgtacttttttaatatatattaaaatttttatgtacaacaaacttatgaatattatggtcacaaaacaaatttctatacttacatcaatatagtccataaatttctacatattccacatatattgaagggtaaaactgacttttctacatgtattaaacgggaaatttaactatttgtcacatttaggtttttcaattatccaaatacccttcttatatttgctcatattttttgcccatcttagatggtggcttcttaactatttgccactttgcctatgtggtatgccaaagtggcaacacaagagaaaaaacagtgtgggacccgcttgtcattctctcccctagctgtccagccggcgacgccagcgaagaggccaaggcggcggccggaggaaagtttgacggccgcggcagcactctcctcggtgcacagagtgggtcctcgtcttcctgcaagttcaaagaaaacgaaaccccttcgttcgggagcgcgttttgatgcattcatccagtggtgttcaccatcggaggtcgccgttgtcatttctctctctatcaggaccatgttgttggtcgcgtttctgcggttctgattttctttattgccaacctccatcatcaatggatgagtctaatcgtggggcacatcctaccatagtccttattaccgtttgatcatcagagcatccacacccatgttgagtattacgagaacatgagtatactatatatgcaatagtggtttttattcatcctaattatcattaaaatttctaatcaatacttagcctaagaaataatttatctgtagcgaagcatgtgtatttcgctagtacagtcaaaataacatatattttgggaccgagacgatgtttttaatttttttttaaaagaagttcaaacaatttgctaacaatcagccaaaaaaaaatatccgccgacctggcccaatcaacgcctcccctcatccacaccaaccatctgcgctgcgctccgcctccaccgccgtccttctcctctctcccccaatcaccgcccacgccacccaccaccatggcctcctccgcctccgtttctcccgccgccgcctcccaccaccgcctcctcctcccctgctccccgcgccgcctcccccgcccccgcccccgccctcgcccgcgcctcctccgctccgcccgcccccgcctcgtcgcctgccacgccgacaccctcctcccctcctcgtcccccgccgccgccgccgccgcgtgcgcctccaccgcctccgccaacgggttctccgactggctgcgggagcacgggctgccgccggggaaggtggccatcctcgaccgacccgtcccctgcttccgggagggcaaggacctgccgctgcactacgtcgccgcggggcaggatctcgaggtgcgttagcaagcggggatttcggggttgattccggtggtaaatggtgtgagatctttgactgtggtgggctgttgcaggctggggatgtggcgttcgaggtgcccatgtcgctcgtcgtcacgctggagagggtgctcggagacgagtccgtcggtgagtgctcttgtgatctattctagtgttgaattctgtagtttggttgctttggggttgagaggaaatggcgatttttttgtttcctggatgcacatttcacagtatatgacctgaatttagcactgcaatagtcctcctgttgggggcattttgtgtaaatggcagaatctggttttaatttatctgatgtccaccttataagtacaccgaaatcagtaaagtatagcttcacttcaaggaattcataattgttagtaagaagtaagatataggttgaattagttgactttgttaagtaatcttctatctgttcacttcaatttatttcaaattttcaataccatgtagggcactggatttgatattgttaccatcaatattaatatgtgtgtgttttgaggaatgctttttgaatgtttttaatccgtgttcaactggttcaagagtctgaatctgccggtttgatatgcaactttagctaatcatatctttcttgcgtatcttcaggatataatcaagtattatcaatctctctttgtgtgaaatgttgtgcattgtaattaaacaatgggtttatagcaatttcatctttcaaccttaggtgctgattcgaattttctctctttttaagcagtctcttcacgagattgcattttctttactattgcatttgtcataaaaggtaaggtcacaatttttaataaattaatcatcaaacaatgttagcatgagagtaatataagaaagtagccctatgtttacaactttgttaaaaatagtttaatgtgaaattgtggatatgtttacattggcatgatatttctgttagataggtcttccatgcattatttcttcagtccttgtatatttgtttgctaatacctgatctgtgaaacttatttgtggtttatgtctgtccacttgcgctaacaccaaaagaagaatatggaaattgatatgtccttttcatgtatggtatttgttttcatttttgtactatggtaaccagctgatattttgaaccatacagctgaattgctaacaacaaacaaattatctgagctggcatgcttggctttgtatctcatgtatgagaaaaagcaaggacaagattcattttggtatccttacattaaggagcttgatcgccagcgaggaagggggcaattagctgttgaatctccacttctgtggaccgaaagtgaactgaactacctgaagggtagccccatcaaggttagtgttttttcctatccactatatgtcaatatattatgagcacattttatgcagtgtcaagtaatatacaacttagattttctaatatttcaggatgaagttgttgcaagagacgagggaataaggcgagagtataatgagctcgacacactgtggttcatggcaggttcattgtttcaggtgctttcttttgaccttccaaaatgttcctgtctctgggattctgttgcactagctgcttgttgttctcatgtcaactgttatgcagcaatatccttttgacatacctaccgaggcttttccatttgagatcttcaagcaagcttttgtcgcagtacagtcttgcgtggtccatttgcaggtaacataatgagcaatgagatttcatttatcaaaaaaattagatattaccccgattggttgttggttggtttaaataattatctctggtgttgaactgaagtttaagatttacttagagtgtacaccatttatgaacagaacagtttagtgctaaataccttgcccatataatagattatacaagcctcgcagtatttttgtcaaattcaataaatttggaaatttgcttcttcaaattatgtagatttgttctgtaagtatttttttttgtttcatatgttttatttgcttaatacttcagtttgggatcaacagttcatagcatgccagccttttattttattactggataaatactgaacctgctcgtcgctaagttatttttatttttcattgaagaacagaaagttagtttagctcgaagatttgcgctagttccattgggcccaccactattgacctacaagagcaactgcaaagcaatgctgacagctgttggtgattctgttcggttggttgtggatcgaccatacaaagcgggagaaccaataatcgtctggtataatattttcttcagatgcattaaaattcttgttgtacctcatcatatttggcaacttcagtgcttatttactgtttgcatatttcatttctgttgtttgtgcatctccactgtaacgtcaagctatgcaaattgtacaggtgtgggccacagcctaactctagattgctcctcaactacggttttattgacgaagataatccatatgatcgtatagtgattgaggtggaatttgttttgctattgttctacattcatcttcttattggatttgtgtaagcaatactgaatcattgttacaggcatccctaaacatagaagatcctcagttccaagagaagagaatggttgctcaaagaaatgggaagctggctatccaaaatttccatgtgggaactatgatttcctttttcttttccatttggaatgcaactacaaatgttgtatattgacatgccttaggtgcattaggtctgtgtgggtaaagagaaggaaacaattgcagaaatgctgccctatttgaggctaggatacatttcagatccagatgaaatgcaatccatactttcttcagaaggtgatacatgtccagtaagtctacttgcccttaattggccttactattagaattttcagaattttcagttacggttagaatttttaattacacatatgagataaaatggagcagggcaaggtgacagtgtcgtacattgttgttttatttattacatttttggggtcattatgcttgcgcagttagccagtttatagtttctgccttttttctttacaagactccaaaagcactttccaatgggctcagtttttatggggcttctgcctttaaatattgcttcaagccttgaagacccagaagtattgatctagtgtcattagtcattactatgtttgtaacaaattgaagctagacaaacaggcatttgatctgaagatcttgtgttatgtgaaatgcaataattacatctggttgaacatttaggaagagagaacatttcacaagtagataatttggaaaatgcctttacatttgaagctttcttttaggccatcacatttgtcattccaggtttttaggatttcattcaagttataagttcatctaacccattatttatttttagtcgggttgatctaaggtgcagattgttcaaaactaaaccggcttgctacaaagcaaatccatcatacatttaaagtgcaatattttgccatgcaaatatcccacagtagcatgtagggtttccattgagtttttatggaagttgagcaatggttctaaatagactatgtggtaatagtagtgttatgcataacactgtgtaaattgtgacatgtttccaactatgattataggtcagtccatgcacagagcgagcagtacttgaccaacttgttggatacttggagtcacgattggctgattatccaacaactttggatgaggatgatgctatggtaacgagttgcaaagcactatgtgtatgtttttttgtaaaatctctgatacgtaatgtaatgaagagcatttcatttctctggtattgggcagttggcagatggcaatttggaaccaaaaaaggaagtcgctactaggcttgtaagattggagaagaaattgttgcatggttgtctccaggctgctaatgagttcataaatgatttgcctgaccacactgtgtcaccttgccctgctccatttgctcctgaattgaaataaggtaggcaaagctcaataagttttcactgcttcccaaagtaaatttattagaccgtttactgtgtaccatgttgatgtaattgatctaatagactgaattttatggatgtgcagaaaagtaaagcatgcagcgagcattaattcttgcaacatgggtgtcacttctaatggtgttctcattaatgatcacatccagttgaagtgcattagaaggtaataaatctgataaattgttactcctttaaaatacattcaagtagtaggatttaaaccagtactaatattgctctggtattataatttttttattgttagaagtttagaacctactgaaagtgtgtaactgaaagataaaataccaaataaaacttatgattcaactattccattgttacttggggtacattctcccaacccttgccgtgcttttttttttcttgttgtgcgcgaacaaaaaatttaggaattgtctatgaatctctgaatattttttttctatttctgaactttcttaattttaaaatttaaaaatagacccttctaaaacttatttccaaaatctgaaccttttaggcacgcgaaccagggtggcgtcgcaaaacaacactgaccccacccacagcgggcgtgatagttttattctaccacgccaactatggtggtgtggcaagacaatgctaaataatgctaccatgccagccaaactggcgtggcagtattgtttttcctactgaaagtattgtttggcgtgaccaaaaggttcaaatcttgaaaataagttttggaagggtttatttttaaaattaaaaataaagaaggttttaaaaaataattcctgaataattggtgaagataacaacatagctatgtcaatggtagtcaccacacctaaatcactcaatactttttaacttaactaaagtagtttcttgagcataatttagctacttcatttcttcctaaaaatagttcctatagttataacaggtcatttggaacataaaaatggcaagaccagaataagaggcacaggaaatcagtaatgcaatgacagaatacaggaatgccctctgtcctgtacgcaacacaggaaagcatagcatggtaaaaatagtcccatttggtctgtgccttgttccttagtggttgggcactgtaaattaaatggccaatttttgacatataaagtagcctctattctctcttatcccagtcctgtcttttgcatctccttatccctcttctcacctgtgcaaacttgaggggagaagccagaccatccgctatgctgcatcaataactttggctaggttgcactgcaacacgcacaacagtaggagtatgtactgtgtagaacttactgtgagaagtcggatgtgtgatcccaggtcccagctgaataaatttctctcttttttttcattttgaaaaacatgtaatttgcagccatatactgcaatcgatttggggaactaaatttaaaagacagatgcatgaatgaaccacaacaagaaatcaaaatacagcagcaagaagtatctgacaacatcacaacaaatgagcaaatcgatttcatgattcatgtgcatgatttgagaaatcaaaggtagacctctagatctgatgcaaagacaacctaagcaaagtatgctgcttttaatgatcaagcatacgtctctgttccttggtgtcactctggagaatggctcgagaccatcatttctcatgggagccctgaggtaatgccagaccaaggcacacagctgctgtcactgaaggtggggatggatgacttagtgctggagctgggctgctggggaccttcctgaactggccaagctgaaaagtcactggatctgtatttgtttttggtttgaccggtggtttggtctgtctcttttctcggacatagaatagactgtcttggatgttgcagtgtagacgggggcggctaatgggcgggtgaccnncccaggcgatcaccccccatcccccctatacactactctctttcttcctcctctccttcttttcttcctactacaccataaattttttaaaaataaaaaacacaaagttgaaaaaatttatgtatagaaatactatatataaaaaaattgaattcaaattcaaaattgaaacgggtatgtaaacttttgacttataaactttgcgtctataaactaatatttaaattcaaattcaaatttgaaccgggtatgtaaacttttgacttataaactttgggtctataaactttaggtgtataaactttagatgtatagaaatactatatataaaaatatttgaattcaaattcaaatttgaatcggatataattcaaattcaaatttgaatcgggtatgtaaacttttgtcttataaactttgggtctataaactttaggtgtataaactttagatgtatagaaatactatgtataaaaaatatttgaattcaaattcaaatttgaataggatatataaacttttgatttataaacttgaggtgtacaaattttaggtgcataaatttactaaaaaaggaaagtaatgcggtgccaaaaaaggaaaccaggtggagggaggggattgatcgatcgccgggtagcaatctcgagtgtagactgtggaccatatttggtgtgcattgcttgtttagtgtgaagtggtaaagataagggcacatcagcagagtgtagactgtggaccatatttggtgtgcattgcttgtttagtgtgaagtggtaaagataagggcacatcagcagttgcgtgacattatgtcggtggcatcatatagggtagcttcccaaaagttagttgtttatctgttctttcaaaattttgtaaatgaatcctcagtagtgcttctttgcaggaaatctgaagcctggctgacgggtgtaatagggatttcactgcccgcatgcagatttggcgattagttgcattgcacacaagtgtgcacggatgttttgttaacctagtggcttttatattcactgagtagattctgtacattctgatgattgactgagatggtaatgccaatgtacatgttcagtctcatttgtcaatagagattctgtacatgttatatttttgggtgttggcatgatttccgccgttctcttttcatggcctgtttgatttttagctgtctgactacacagcagagaattgtatgcaacagtttactgtgatggctgccaaggaatcgcattcatttgaaatgctccaccatttttctgtctacagcaattagtctccctaccctgatgattaatacctttttactgggctgatttcaaatctggatgatccacaaagcatgaacttgagaacaaatcgtgctacataatttgttttcttcacattctgccactactgattaacagatggatgaatcgtgatgatgaaccatggcttgatactcgcgggacgatttgagagcccggtaatattagcagagatgataacagaaaggaagaacttggagtaaatttaggtgtcagtcattttattgatcctttgctggatgaagaatgctcctgtttaactctctgatggaacatgcccaacgcagtgatacaactacgatccttcaaacaaattcgtgacaccaccaaacaggaacaggtcttttttatagtccactcttacaagcagtgtaagtggtggcagctaaacacatttatttcagtgggcctcaaaaaccaataatctcatttaattcttttaatatcaatttttgtttgtgcatctccttccaactctctctctctcacacacacaccatctatgagatgaaataacatgatggcaagaggtccatttcccgagagtaaactagacaagagttgatggccatgctactgagtgcctgagagtcgtttccatctgattatcctatttcatttccccttgctgaaatcctctaaatgattttccttttcttcttgcaatataatgcatatgtacatgatgctcgaccacgaagtctgaccaatattggattgggagccaacaggaaatgataaagcgatttagccacatgtcgcacatcttagtatttaagatcaagtctccttgtggggtgaacaactcatgagtgaacagtggcttgcgctagttcattgctgtagtgatgatacagattgaaaaaacgccggctgggagaatgaaggcatcttcatctccatccatactcttcagcacatggattctgggctgataggattctactacccagcagctgagcatatacacatggtgaaacacataacattttcctctcattagctagggaaagagcttgaatgcttgatgcatctgcttggcctgagcatgctaaattaatccaatccgttatcatgttttcttcctcttgtaatgtattaagttgcttgtcgcgtgcatgtaatcaagtaaaaaagaactatactaattggattggaaggcgcagtgaaatgttaataaacaatattccacccaaatcatgagttaaccatatcgattagttcctcggcattaaatccttacttaattagttgcagattgatatatcatgcccatgcaacatgatttcatcctcacctttcaagtaagcatgtgtggctgcattgtgttatatgtgtaaaatggccaaattcaagaggaattgagcggatttgttaaactatgtgaagaagaattatacgatacatataccagaaccatgcctatgggttgataaattatctaaaagtattggacgttaaagtaaattttcaattaaagtatattaaacaagacataatttccccgcaaaaaaaaatcaacacatataattatgcaccaaagatgggtacacaagctacctcattttgtcttgttagaatctttaagaaattcgtccagcggagaattgatttacgcctgtttgatttttagctcagtctgactacccagcagagaatagtatataaaacaaaaggagtaaattgcattggtagtacacaaacttgttaattgcgtgtaatttagtacataaacttataaaatactcgttttagtacataaacttgtctatttgtgcaaacgaggaccaaaataacttgccaatgttgattttacgaagttgatgttgattaggatgtgatgtacacgtgtaatgagtatgaacactgctatatgtacgactgctctatccgaccggtgtatgacggaacggcagagcagcacaatacttaacggcgtaagtcggaacagcaccagcagcacagctcttgacgtcgtgtaatacgcagtcgtacgtcggtcggacacttaagtggtatgtatagcattttcgaatgagtatgcatacttacatgaaaaagtttttgacagcgtatatgaaacaatttactgtgatagctgccgaggaaccgccattgatttggaatgttccaccatttttctgcctccagaaattggtctccctaccgtgatggtaaataccatttactgggcggatttcaacatctgagtgttccacaaagcatgaatttgacagcaaatcactacttcgaaacaacacatcagtatcggttcgacaaaacctaccactgataatggtttttcatcctataaaacactcgcactagcattgatgagaagataccagtgtcggatcatataaacactactggaaaactgatttttcatgggtggtgtaaaattcacaataatcccggtttaaataggaaccgagactaaaattatttttagccctggttcaaaagaggcacgacactttatgatctttagtcagattggtgttatcaacctggactaaatatcatttttagtcctggtttaacacgttgtcaggctgtgtcaggccctccactatttttagtcccggttgtttataccagccgggaccaaagattgaaaaaaaaaccgctcccacacgcacctcctcttctccttttgtccttatctccttgtgctccccgtccttagtctttatctcttcatcctcgtcctccactcctcctctcctcccctcgatcccagccgcctccccttcccggccctctccgaggcgacctccccctcccctctccttagatccctcctccccttaccggccctctccgtcagccggcggtggctggcgaagccgcgtcagtggcgtcgggcggaggcaggcagcggcagacggcgggcgcagccgcgtcggcagcgtcgggcgaaggcaggcagcagttgggggctagtgacgtcgtcggagccgcgtcgacggagccgcatcggtgggaggaggcaggccacgggcgtctatggcggttggtggcgggcggagccacgtcggcggcggcgggcggaggcgcgtcggcgggaggaggcaggccgcgtcagcggcggctggcggaggcggagcctcgtcggcggcggcgggcggaggcgcggctggcgggaggaggcaggccgcgggagtcggcggtggcgggcacgattcggtggtgggtggtggcgatttgatttgtgaggtttttgtgaatgtgttgtgatgtaacatttgatctgtaaattttttatttcaatatgatctgtgaatttttgatgtcaatttgagtatgtttgaatttgtgatttgatgatttgtgatgtcaaattgagtttggtgtgaaatcaatatgcaaacaacaaaaaaaacaatgaaaaaaaataagaattttagtccactaaaactgggactaaagatgagtatatttagtcctggattaggcgtcccggttgtatactcggaattgaagggagttacgaattgggagtgaagatggtttctccagtagtgaaacaaccggcactgattgttccacgtaccatcagtattaatttataagaacattgatactgataattaaccaatcggtgtcggtttaagtcgcttggagtggatgagctggcgtattggtgggaaaagtcacctgtcacttatggtcattacttcctctgtccaaaaaaaactcaacctcgtactacgatgtgatacatagtagtacaacaaatctgaacatactctacgtccagaatacaagcaactgctattctaatgattggacaattatgacctaaactggatgtgtcagatccaactctcatcatgatggccaagtggaaataacccgatctctctcacatacttcctccatctaaaaatgcaacctacaaggagatgtgacccctccttcttctagtacaataaatcatgtgacccctcctagtacgacatatctggacaacgtatgctcatattcgttgtacagtaggttgaatttttttgaactgagggagtatgcaatcagcgatatcgaggttggacagtatacttgataaaaaaaaagattggacggtgcaggtaacgtgctattacagaaacaaaagccgaagcgaacgaaatcaaacagctgagaaactgattgtgatcaaggagattttatagcgacttaaatttagtaaatccgattcctttataagttttgtttgtgcaactccttccaacttgcttatatatacaccaccatctatgagatgaaataagctagaagagatggtggtcatgcttaggtgagtgcccgagtgtggtgtatccatcttattatcctatttcattttcccttttgcagtagtccagtaaaaaaaatgtcctttcttcttgcactgcataaatatgtgatatttgctcatgatgttcgaatcatatgggattggaagccaccaggaaatgataaaatgatacagccgtatgtgttgctcgccgtgtgcatgtgtttcacacatcttacctagtgaaaagtaaatttcaaaatgctactaggatgagccacatcatcaggtgaacaatagccattggatcgacaaaaaaataaaatagagagaagagagttgaaccattgattatagaggaaaggaaaagacgaagaactttcgaagctttccagcaatgcggaacgcgagagaaagggaaaagaaagaaaagcagtattgaaagagagtgggggcgttggctggtttatggcatgtgatataatttgcactatgcacactcagtaaaagttattttataaataatccttcaaaattatttataaatggactcttggcttataggctcatatgttatctatagataatccttacaacctactaattctaaattatcactataacgttaatatcacaaagtttgttatcacataaacatctaataaaattttctatgattttaatgttgtaccctggatcacctctttagcgtaaaagctactccctccatcttattttgatcatctctaaagagcacaaaggccaatattgaaattaattcgtatccaataaggtgctctatcgtttcattttcaacaaaaattaattcacactttaaatgttgcatgagttgagccaattaaaattaatatttattggttgcatgcatgcagggcgttgctccatgcacatttactctttacacaaataaacaaagaaatactttgttaggtgatgattattttgggaaaacctcaaaaatctaatgtgatgatcaatttgggaaggagagagtgataggtggggcttaagaactagtgtttcatctatacctgttgctttcaggtcattactgatccattacacttctcccaagcacatacttaacaaaatgaactttgtttactgatgccaatttaaataacatgctcatatacacatataacatgatggttaaagtcgtgcgaacgtgtgacatcataggccaattcaaactgaaaggtttgaagaaggttgcaacaaccaactatgccacgtcagatagacataccaatctcacctatgcatttaatgtttttaatcttaaaatatgtgaatagctagctcttgcatgagacccaattctctttattttttaattttttcttctccacataagtttatagcctactattatacttgctctaggaggtgagctaggctaggtactatttggatcgggcttttctttcatgggttgcatcgggagctagagagtagtgcaagcaaccggcacatcgcatctttatttcctcgctcctcatccgcagcctcgttttctctttcctctggcaccacagtctaccggcgatgggccgacctcgagccagtgacatcgcagcctcccaaagaatgagatgctcttcgtcaacctcaagggaatcatcgctgttgctgcttgccacagccgatccaagttcatgctgcggctaacagtgtatctagaatttaggatattgatggtccaacttaaattttttttaaacaccgtagatctaatgatgctaatatataatacaagtatagataatgaaataaaccaaaagtgtaccatgataaataagacatcttaaaatacataaaattagtaattaagtaaaattttgacttatatggacaaaaaagtttgaagaagattaccatacttcttctagcttcttcttatcgggtctacgcaatatctctatctttctttatttttaacaaccagtaatctacaatatagtactaatatcacaatgctcattgcacaaaagttaaaatcttatatagtgaaagtagcaagctttcttgcacaaggatgtgccacatcattaaaaatatattagccgtcggataaagagttcggataaataatggtcattagatcgaaaaagtgtatgtattaaaaaaaatcacaaatgagctaaacatatggaaatttttggaggtttctgttatctattgtcctagccaagtatatatactttgtaaacaaattaacttatattaaaatcttattaagggttaaggtaaactaatagaccatatataaaagttcttaaacaggatcaaaagtcacgcagagcgcgactatatgactagtttaaaactgaaaattgaaaagggtaaaaaacctaaaattgaaaaatcaaagtcatcccgtcggccgtcgcggtcttgcggaacagaacggagagagtcggagacgcgcgcactcgcagccacgcaggccggccgggcaccgggcacgtggtggcgcggcgcagacagcggctggctgcgggcggcggcagggcgggccggcggcggttggagtaggcagcgtcagttaagccgtcggccgtcgcgtggttggtcctcactcatccgttgcgaatgcgatgcgtgcagcggcagcgagaggtggtggcactcagcatgcggcgtagcagcggggcggccgtgcggcgctcggcgagtcggcggccggcgctcgcggagtcgcccgtcaatgaagccgtcgccgtgtcgcgtactcgctttgcctaactcgcgagtcgcgtcgttaatcatgatgcgatacaatgccgcgcgtgagaaatgaggagtcgacgaggagaggtgcgtgagtgcgatgacatgtcatagacagtgagtggtaaatcattaattggcacatcttaaaagtgacaaataatcaaatgtcccgatcattggagtcattgcaggcttacagctcaccgggttcactcacctcacaccttcacccgtataaactaaaaatgtccgttccaacacctacatggagaaggataggatagagaacagccaacactatgataatagcttaacaagaacatgcatatattggggataaaatgactccactgccaagaagaaatcaagccatgtccagaagcttttattccattcaggattcagctcatcatttcataaaaaaaaaagaaagaatggaaaacagcaaggaacatgcatgtgattgaatcctgattcccctccgcggttgccttgcctgcatgcactcgatcagcagcagcatctgcagtggcgcggtgctcgctgccgcagagacctcatcttggctttggctccaccgatgagccgtggtgtccccttcactttcttcttcccaagaacgccatcatctacttctgtgaggctcctcttttgccctccagaacaatcacaaaccaaagacttgagtttacggagcgctcctgctttaagtctagagagttcttcaagtttatcggccttgcgatttatggaataatatagtgagcaatcaactttttcccgtgcatcatctgccgcagcatctgcctcctctatctttcgtaccacatcagctggaaaacactgtgtcaatccataaaaaaacacatttatttgttttatctatatatttcataaatattttttggttgcgaatgttaatttatacagatatgaattcatctactaccttggagggtaaccattttaccatcatttgaggggtcagaatcatcaccataacatttgcatacttcgcgtgatccttgataatcgtgccaatgccaggaacaagcttgtcacattgctcacgcagcatcttgccgtatgcatttagcagaacatcagctcgacacagctcaccagcacaagctataaatgttcttctatcaatctggatggatcaacatgaacatgataaaagaaagcattacagaacttggtcaggctgtaaatgacaattgattcaaagcagcatcaaccatctctagccattaaaaatcctggacttagaaataaaccagacactaaccattctgaattcatgaatgaataaatttttcaataaaaaattgacatcaattagacacaatagagatatcaagttttgttttctctgggtcatcgggccaaccaaaaactcaattaattgaactaggtcagaattcaatgaaaggaaagtgtgataactgataactactgtactagctaagggcaagttttatagtaaggacagttgccacgtttaattttatctatttaagataagatgtgatatatatatatatagacaatacaccacatctacactacctccaacatactaagccaaatgattttatttgtttgtccaatcccctctttctttcatctcatttttcttagggtttgtatggaggttgcctctaacatgaggtgtggctcacttactctttcctcacttaggcccggtttggttcccaaaaacatcacatcgaatctttagacacatacatcgaatattaaatatagataaaaagaaaaactaattgcatagtttgcatggaaatcacgaaatgattcttttgagtctaattagtccatggttagccataggtgctacagtaacccgcatgtgctaatgatggattaattaggctcaaaagattcgtctcgaggttttcaggaaagttatgaaattagttttttcattcgtgtccgaaaaccccttttgacatctgatcaaacatccgatgtgacacctaaaagttttcttttcgctaactaaacaatgccttatttcttccacctcatcatccaattctatttggtatttttagaggcaacaaatcaaccattacagtacttgccctaaatgacccacactatgctaccaccattggtttcagtgtttcactacttggatccctacacatacagcataacaactggcacaacagtaagtctgaaattaagcagaaaatataagggtgcacgctagaaaagggcacaactgcaagaaagctcagttcttaccgttattttggacatattgattctaaatttagtcatgcaatcttttaacacttgaggtaatgggccaagatactggctagtgatgttttccctttctgctggtacaaattcacacagaagattccttaacccccacatcagttcaggcataacacgggtggagaagtgctttttactcccggttcgtaacccccctatagtcccggtttttcaaccgggactacgaatatgggactaaagatcgctatctttagtcccggtttaaataaccgggattaaagatggatcttttagttccggttggtgttaccaactgggactaaagatccttctttttagtcccggttggtaacaccaaccgggagtaaagagagaatagcggcagttccagatggtccccttttttttattttctccctattaacaaccaaatttggtaatatcggcatcgggaaagaagattagatcgaagtaaagtcggaggcggagatcgagttcggaaacagagcaggaatcggttgtagtccagatcggctacgattaggatcggctgggtctgagtcgggctaggtaagccgatgcagccgattccgacaatgcaacttgatgtatgacatcgggttgaattgaggtgcttcaaggtgattgccgcacatggatagagtcctgagaaggcaattgtatctattaattaggatgttttatgtaattttcttagagatatgcttgggcaaaagtctgccgcaaagacttatggtatcttagagtttgttagagatagttgtcgtgtccgttatggacatatcttgtaattttcgggtataaatagacccgagccctatgtaacttttaacacacacgttcaatacaatctcggcgcatcaccaccttttttgctttagttttatttcgacgagttcttgctttcgggttgagctgcatcggtttcgatcttcaacaagaggtaaaacttgtaatggcggtttgcattctcgggattagtgcttccatctttatgacactttaatcttgtttatgtaattcgtcgagttatcatatatcctacataatccttggcaatatcgatatccaacctacaataggctaacatccgtcaatagaagacagccgattaggttaaataccgatgttgccttagattatataggatatctaccactctatgacacatccaacggcttgattgtctagatattgtccttcttttcatacttatagctgcatcagttaagtttgaccttatgagtcgtgattagaatctcaatctctagcccgcttcttggttgctgattagggtagtatcggagtttcagccgatcttacctgatttaactacttttatccctttacgttaagatcttgctgcatttaagtatattaggcttgtgtttagtatattctacttgctttaatatcttaatatagagtagtatcggagtattagccgatacatgctagatctatctgatcggctatgttatgaacgtatatagtctcattattaatatatatttcgatctaagtgatttatactgtctcggcatggcgaccgatctatcccaatcacttgatttaagtatatatcgatataaagattatatattggtaatatctgcagccgatcgagtagattcagtccttccttatttattaatgactgccgatcgacgcatatatgacattggctcaaagataaatgatgtcatcggcacctagctgatcagctatcatttatagatttaactgcggtttctttgcttctatttcttgttgattacaggatcaaatcaactggcacgctcatacattcgaaggcgagctttggacctgcactggagttaagcagatctcccaggcctcgtattttctgtcaacactcccaaatcttattttctcccaaatcaagtgggaagcatatccccaaatcaaagtaacatcccaaatccacatcacaaataaagtaacatcacaaatcttaaagttacatatatacacaaatcaaatacatcacaaatcctaaaaaattacacacaaatcaaatacatcacaggtcatcttagatccatccaataaatcacaaaattatacatgtgaatcacaaattaaaaaaaaagagaaaacaactccgttgctgccgcccgccatggccgccagcccgccgccgccgtcgccccagcccgccgccagcccgctggccgccgcctgccggatgggaaggggaggatgggcaggaaaagggagaggaggaggtggaggagaggggaggggatgaggaaggggaggaggtggaggggaaggggaggatgggcaggaaggggagaggaggaggtggaggagaggggatcggatgaggaaggggaggaggtggaggggatggatcgggatgaggatgtaggaag

SEQ ID NO: 74544 - DNA, 1560 bp, Oryza sativa
tacaaaaagcacttagcatttttaaacgtttgctaaagatgagaccgaggtgaaagacgagagttgagaagtcgaacactcatcactaaaaatgaaaaagggtcgaagtaataagccctcaaacaaacgaagcgattaaaaaataacaagaggaccgaaacaggcagacctggatggtcgaagtatattcacatgataaaaaaaatactttacagatagattacaatatccggatcaggacattttcgccttacccctgttacctcagacgaacatggttcgtcatcgctacttattttatatattactctaaggggggaaggaggtgaaatgcacgccaaactataccgacgtcaagcaatagcagcttggcaattggtcatcttgaagtttcgccaaaacatagctacatttttgcggcgttggacatgacaccggtcgtaattttcgaaagatcggccaggatgtcttcgcatccagttcgccactttgacaaccacatagttatttccgttgataaccatttcacggtatacgggcttgcacgaatacctaatctttggtaagcccttaattgtgacaatttactcgtttgcgctttgccagtctttgaaaggaggctgaacgcattctttacgcagtggaacctgcgaagaatgtggaaatacatagcaaatcgccttaagaacaaagtcattcggaaaatttgcaagtttaaggcaagattctggcgaagatttccattccattcacataaacataaatgccatttctgctacataaaagcaaatcgccagcagcaaacaaaagctgaaccaagaaaaatttacatcaaaagaaaagaaggcctcacacctcacgatggtcttgcatatcttcgtctcttagtagttgcagtagtcggtcagggccgcggcctccttcttcgtcttttccaatttggcctttaagaccttattctctaccttcgcctatttaaaggcgtcggcgacaacctcattgtagggatacgcgcaggctatgataacataaatcaaaattttctagcacataaaccaggaaccatataagtattagatcatagatcgttaccactcgacatactgtgtccacattattaatttggtatctctataccatgatccatgagacatgatcatcaattaatacatgtgctgatcattaaacatatttgttccacatatgatatttgatcagggatcctttagaaatagtaacatacaacataaagagtctcatgaaaaaatcacatattcattaaccaataatgagttatctatttcaagaaacaatatcggataaatatgtaaacatagtatgtgatacaatcatctatatgattgcctctagggcatatcactaacagtctcccacttgcatatctaatacccattgccctagtgtgcgcctcatgcttagcctaagggagtggctttgtcaacggatctgcaacgttcaaatccatatgtattttgcatatcttcacatctcctctacccactatctcgtgaatgaggtgataccgccgtaaaatgtgtt

SEQ ID NO: 74545 - DNA, 761 bp, Oryza sativa
tagaagagcgaagccgccatagaagaaatgagagaagaccacaacctcgtttgtatcgggggtcggaaaagcctcaccgcatgctggccgccacccgatgatttccttgacagggagaacgccgtgcgccaccatctccttcaggttctcctccgtcacgtcggacggcgcccattggccttcaaagctttctttctcttccgccatcgattttacccgaatgcgctgatttggttcgagggatggctgtggagagatgagggattaaggcggtggatcacgggaaggattttgatgaactttttgaaggtggattcgagtgggatggtgaaccctagtttgccggcgcagctctgtactgtagcagggagtggggaaaatggcgagagttccggcggggaagacgaagtgacgcttggatctcgggatttcttgttaagggtatcggaggtgcaaatgggcttaggcctgaacagtacctcagctcagtatttttaacagcgtggcccattgtgttccttagggacttaggcattttttgctttggcaatttatgcgcacaatagtgttgcccaatgctgataaaatcctttttatgcggtcatataattctttgaattattgcaatgcaaattaaaaggtgcccgacagaaaggtgttatactgtttttgtcagctttattaggctacaaaagcagtctgggttaacttggaatgacttgtttttaccatagtcatttccttggtatgttatatgcctg

SEQ ID NO: 74546 - DNA, 7711 bp, Oryza sativa
tcttaatgttaaacaagcttgcaacaatggtggttgtgtcccttttaagttttaggttctcactgtctgcaaaacatgcatcaagaacatgttgccgatcctcatctatcaaccaagttcttgtactagtggtcacactttcatgttctacatgactgacatcatgatctatgttgtcttgtccccctcctgaaattgtgaggcaagaatctgttttcaaatgtgatatatacttgcaaaatgtaatttaaatgggctgcgattacctgaatcctctagttctactccataaccaatatccacatgattggcataaacggcaaagtcgtcatctattcattggaacaaaaaataactttcagcttcaaactttgtaaattatgcatactgattatatggaggaaatagatgtgtttatcataaattgtgaacattgtacacacattaagttgtaaaaatgatttgatacctggttgatactcataatcctcctcttcaacctgcatgttaacatcagaatgacgagtagcgtcaccatgatattcttggtcttgtggcgcttgttcttgctcttgttggacttcaccataagattcaaattctacaaatatcaaaatgtgtcaataagttttaccttgtcaataagtttcacactatgataatgctttaattatttatggacataactacatccatctcgttgttattatgattaggcctattgtaaccatacctggttgatcttgataatcctcctcttcgacttgcatgttcagatcgaaatcatgcatgttcagatcgaaatcatgggcaatagtgacatgatattcctgtatttgttcttggtcgtgttcttcaccttcttcagcttggtgggattgttcttcatcttgccatgagtacattacaagtatagtgtaaatgaggatgttagatttgttacatgccattcatatgattctagattatgtcaaatgcatttttagattccaagcacggtactacgaaaatgaccatatactactactacttgctgggttttggcaataaggtaggagaagtccgtaaacttgtacactaaaatctgatttcccccctatattatttttgagtttttaacattgctgccattatcatgtcttgtcctaagtcctgacagcaagaaagaagccttgtgcatatgatgaaaagcgtcaacaaagccactcctctcccgatcagaggtatgcatatactactaagttcaacttatgcatggaaagcaagctactcatgatccctcctgatactaaaatccttagcatgtataatcttcttgtctttcatatcactggtcatgaaatgtgctcatcacaatcaatatcatcatataatccctttgttatgcaaaaacttaatcatgttctttataacacatacctggttgttttccatacttctcttcttcagcttgcaggttgagatcaagttggagggcagcattaccatattcttcgtcttgcacatcatcttgtcggagaccatgttcttcaccgcactcttcatcttcttgtagtgctaggttcagatctatgttcattgtggcctcgtgtatttgttgggttgtggatggatggtgttgagttctctcttgatggatgttgtggatggaggagagtgttttgatgcttaagtgtgctagcgctagtgatttttgagcttggttttgatttatgtaagcaggcaagccatgtgatttggcacgccttcagctgtaatatttggcgcttagcggttcaaattttgttttgtctatcgcttgtgattattgagtagatttttaatgtgttcacactttagcctctatattcagtttgtgctgccactttatttgtacacgccagtgactgacgcaactggtttctgccagagcatatcatggagggtagtatggtctatttattggcttccttaatagctgtgcccaaggctaaagctcgttgtattctgggacggagggagcatttcttttcaaatattatggttgctctaatatttaaagattagaaaacagttaagatgatgtgatttcatgaggcaagagaaaaagaaatatcattaaccgtactcgatatagagacaagtacggacagtttttttaaaatttatagctgttgcagccagaagaagaagaaatagtcagaaacgtaaaatttattactagtactggtatacctaccttatcctcgtcgagtgcggtggactcgatacaaagaaaaaaaaatcccattctgtactgtaccctacgccgcggctatagctccccccaactaactccccttaaacccctgtcagacgcagccggatggataggtagcctcttctccctcctcacgccggagttttccccgcacgcacccacaccaaaccaaactctactcgatctccacggccgtacacgatttcccctccctggagccagcgcgatgggggcggaggcggaggaatcgctagatcatcctggtaagctcacgagttacttcttcgtcgtgttttcttttttccttttgagggggcaaatctgttggttgttatggtgtttgcaagaattgatgtttgtttttgcttgatctgtgatatctgttccacggagtggcggtggggaatctgggtgctgttaattttcctccggatttttccgttttgtgaccgtttcgttttgttttgatttttttttcggagcaggatctctgtcggggatgtcgccggcgacccccgacgttgcctggaagccggcggagcggcggcggcggcggtcggaggccgacgcggaggggtcttcttgctgctccctttccgctgctacggcggcgtgggttggcgccggtaatgtggagagtgacgacccgtctgttcgttcggtcgccgccggggagcaatcccgctccgtgtctcggccggaggaggaggaggaggaatgcgcgtcatgtacccaggattccaccgtctctccgccggtgagcgaatgcggcgacaggactgcgcagcaggaacccagcacccaggagtacaccgtctcgccaccgccggtgagtgagtgtggcgacaaagttgtgcagcaggaatccagcaatcaggagtccaccgtctcgccaccaccggtgagcgaatgcggtgataagattgcgcagcagggatccagcactcgggagtccaccgtcttgctgccggtgagtgagtgctgcaacaaggttgcccagcaggaatccagcacccaggagtccaccgtctcgctgccggtgatcgaatgcggcgacaaggtcgcgcagcaggaatccagcacccaggagtcgaccgtgtcactgccgtcgagcgagtgtggagacaaggttgcgcagcaggaatccagcacccaggagtccaccgtgtcgctgccgttgagcgagtgcggagacaaggttgcgcagcaggaatccagcacccaggagtccactgtctcgccgccggtcagtgaatgtggcgacaagattgcacggcaggaaggtgctgccagtgcgatccctacgccggagaaagtggaggctacccctaggagacccaggaagaggtcaacgaaggggttgactcgattcaagattatgaaagatcacaaggcggcccagagaacggcaacacccgttgaagttaagatcaagaggaaagctaaggataatggtaggcggccacttggtgataaatcagtgaggaggaagttgaattttgaaggcgatgcggtggactttgaaggcaatagggagttcagcagagccaagctgatggaggatttgaggtgccttgccaaggttcatggtctgcgcgatgatctgggtgcaggcaagcgaagcaagaaagggaagaaaagaaaaaagatgactggagaacatcaggacaatggcgaatcggcccttgtgccttaccagaaggccccagctgccacatcatcatctgcgctggttccaattcagaattctacgcaacttgctattgtacaccacagaaatcacttgaagaacttgcggacaaaggttttaggccttgatgagaagacattacaagtgtataatgttctgaggaagtgggatgagactgatagtgagagtttcgaaggtgtagacattggcagcgggcctgaatggaatgaaactcggcgtcacttcgaacattacgtggatgtgtttattgctactgtgcatggtttattgggtaatagtccggattctagaaacttctttttctccttttttcttctcttcacatgtgtgcagcacatgatagaacataagaagtatagagacataacaagcaaaatgcactactagtttgatttctctaagtaggctgggagatatttgtagtttggtttgtctaagtaagccaggagatatttcagtatgcacatcacacaaaagcactgaactttttatgttgaaaatctctactgacatgttagtgttttgtttggaataaaagtaagcgcaagcttgaagatttgtgaactcttacaaaaactaagcaatcctggtggctcaaatgatatcttagtaagaaatgaacttattgatgatttattagtctacagttctaaacaagagaacaatcaataactgcgccaagttgtacactccagattttgaaatgcttaatttaaatgtgaccagctgttttattttccatctcttagtttctaaattggggtgaaattacttaaaatcaatcaggtgcatttttctgagcaaacttggaagcacatgtatgaacatcacttgggtaggtcggtgagaaaaaaaaaccaatcagcatgatgtataatttgatcaaatcatttacttcagtttttgtctgaaaaaccaaggaaatgaaatcagcagcatttttcatcgttggtacaataattattcctggttaatgatttcaaagcaatagagcctcacgtccactttatacaacatatgcgtatgggatgaaacgagtcttggaatcctctgcttcattgaaacatgcagatttaaattggattctaaatccaaactacttttctgtcaggtcccagaagattttctgaatggggaggatcagtaactgattctgttgtgggtactttccttacgcaaaatgtcgctgacaatttatcaaggtaaaacttagacgcaatctgatgtctactttacatgtttgtgctggagcgaatctatcagctgcatttcatgtttctgattataattttcaataaacatgcagcaatgcttttttgaacctggtggcaaaatttcctccaactaagagacatattaatgctgaagcatgttcaaatttgtctctgttgatagatgacatgagacggaaattgaatttgaatgaacaatctaatggtactgattctggtagttcagattttacaaaacctgtcgattttgagaaagagaatggttacaatgaggaggtaaaaggtaattatggccgagactacagtacaattatagagaattttatatctattattgagaaacatcataaagacatgtctacgtgggacaatgcacgccttgagaacatggtgaaggataagtctggaactccagtatgttcccatagaaccttgagaaagtttatggacacatttgaggagaaagacacttctcattgggataagttacgggaggaagcatatagtaagggatacaaaataaagggaaccggaataagtgattctgctgattgggaagctgtgctacatgcaccagcagttgagattgcaaattccattgcagtcaggggacaacattatgttatagcattgcggatacaggtataaggttgcaagatacacgtctatttgcttgtttaaaaaactctgttctaacattagtgtagcaggaagatattcctgaataccttcgttctggcgatgaacatattcaccttttgcaaaattgaacttaatcaccattttgtatcatttttggccagcatatcggattaaatatatctgtagtttcaaagtggtttatgtattcaatattacttcattactagtttagcatccttttttactaggacattattcttaaccaaattcatttccttaagtaggcatttcaatcacttactgtctgttttcatgtgtgtctattgaaataagctttgcttacagcatgtctacataaataggtcttataaatctgaacttaaagatggaccgttttattactttgtttcatacattatagattatacattgtctcatactaatgacataacggactaatactttgcatttaaactacatttttcaaataccctggatatatggtacatttctattctcgcaatatgtgtggccagtggcattttagaacatttattgtttaaattttaaaatgcccattgaaagaacaattttactactgatgcaattaatagattcatgatcaaaagtgcagtttacagaccatgttgatatttgaaataccttttattttcttatccacataattgtatctattaaaaatatatgtgatccaataagaaaatgattgaaacatcagctatgatctaagctcgacctccttattcctgaaaaaaaaactccacactttatgcaagaaaccaagatttacctataatattttgattttaacatcattgtcagtggaaagatcatttttttccatgtaagctatggttttgatattactggaactctcacatatttcttgtcttcttcttcttgtgcatttgacacacagcactaaaagtattccttttccttttacaggcttttctcaagcgtgtaaagaaagatcatggaaattttgacctggattggcttagatatgtaccacgtgaaagtgcaaagtatggacatatttcataaaaacctacactatttttagtatgttcttttttttacgctatgtacaacgtgaaaatgcgaagtatgccttttttttaaaatgttgaactgacagtaaatagctgacaatggtaattctattccgtatataagtttagaactatttcccatatttgttacgttgaacttcagaagtattattgaaggaaaaccagggaacttgttgtagggagcttctatcaagctagctgaaaataacaattcgtagttgttgactgggttacttgccttatattttgcttcttcttttttggcgggcattagaaattacctcatcagtattctggggcttggagataaaagtgttgactgcatccgtcttttgtcattaaagcataaaggtttcccggtaagttatatttttctaaaaagaaaaatcaaatattgtcaacagagtacgtttcattgatcaatctcttgacaggactgcatgctcctttcaggttgatgtcaatgtagctcgcatagtcacaaggctaggatgggtcaaacttcaacccttacccttttttgcagagttccatttagttggcttgtaagattggcctcacccaaatttataaataatgattacaattctctgcttatacatacatatatatttatatatttcccttttggtgaaggtatccaatcatgcgtgatgtgcagaaatatttatggcctcggttgtgtaccatttctaaggaaaaattgtaagtcatttggtcctctcacaaaagtttgtcatacctttggtttccggcatcccatctgatgaacgtgatacgataggtatga

SEQ ID NO: 74547 - DNA, 7572 bp, Oryza sativa
ctacaaatataccactacactacaaatatgattccctctatgaaattgtatatgattcattttcttgtatcacttatacacaattatgttgcaattttttcttttgcaggatatatttgtgttagaggatttgatcggaatacaagatacccaaagccaatatgtgcaaaattacacgccaccaatgaaaggaacggaacaggtgaaaatagccggaagaagaaaaagacatcacaagaggggaagaagattgatgacaaatcttcctttggcaaattagaaattaactgatatatatatatcaccattaacaaagttgtgtacaaattgtagttggaaggatgctgatagcctctgctagctctagtgtatcatgtagatcagtagatttgcttagggcggctgcatgagtaaatatttggttgagatctcttccacaatgcgccttgtatattagtcaaattccttttttattatgtgtaaacaaaacatcccatcttttatgaggcaaaatcgcactatttagtcttaacgggcgacacatacgcatgagaaaagtgccacttaactaggtttggatgaaaagctcgtggctagttatcttgctcgactcgtgtctggctcggtttgtttgaatttgttaacgagctgagccacggttttagctcgttagctatagagccaactcgagctgcttaagagccaaacgagcccagcccagcagttaacagcctaatctcaaaagcccaagtgcaaagccccacaaagaaagagcaaccctagatggatcgatccctcttttccccttcttctctatactgtatgtgcgtatgccgatatgtgggcccaatgatttctgggtccacatgttagtgataaaggcgcggtgcagtcaactacagcatatcctaatcccatctccattccctgtctccctctctcggctaatcgtctctctctctcacacgacatcagcagggtagcccttcggccatcgccgcatctgtcgccccactccacgcttgatgactcttgcctcgccatcccctcatccagctgccgctttgctcagtaatggagcaaacaccgccgccgttgtgaagttctgaatctcgaggattcgaggattagtaatcgttgtctcacaagtgaatcactagtgaagtgttagttgcatgtgtccattttcttgtgtggaattctgatgacggacttttggttcatcagtatgggtgaatgaacggatgatgggtcatgtatttgctgttttacttgcccggaagtatggattacagacttttggttgatttgcaaaataattcctgaggaaacaagcatcgacaatcctccagcaacattgttgttcccatctatagcattcatacaagaaattggctttacaaaaggaatatcagtgtccacagcctccttttgcaagtttgcaccatcactacggatttcagaattcgcagaagccaattgcacggcacattggcatacctcattcatcagcttggtaacaaaaaaggcaggaggttggatctggtatgaatggatacatttatcctcaaccattttggaaaccttgtctaaattaatggagaacctcaaagggtcgaaattgcatttcagtggcatatatcttcacctcacccatagtggatgaagctacatcaagttccacaaagtgtcccacttgagtatcttgagaagaggaagatccaaactcattcttgcaacctccgactctgagtgcatggaggctgctgtgagcctgtgatgaccatgttctcggttagctgcccacctgaaggatcccaacaataaatcatacaatcagaacaagcagagaggtaacatgcacattttaatgaggtaactgatagtttcgacttttgttacatacgcacgcaatggtatgttcatctaggaacaaacacacggtatatacgaaaagaaaatattgatggaatcgaatacctgaagaagcaacgatgacttgttaagactcagccatgtgctgctgcttctgctttcctcttgtaatgtgacctgcaatatatattatatatgtatgtatagatagatacatagcactactcaacaagagtaaggagtattagcataagaacacacaaccactactacaataaggattttcccgtgcagagcattcgaccgtctggaagaaagtgtctgcgaaaatcacgattttttcgtgcgggcgacgcgggcgcttaagccgccagcacgggaaaatgaaaaatcaaaaaaaaaagaaaaaccaaaccctaaccctaatccagccgccaccgccaccctagtcgaggcccgccaccgtcgcccccgcggtcgccggtgccggatccgctgcccgctcccatcgctaccggggaggggagagggaggggagaagccacgggccgccgtcgtcgccgccacctgcacccgccgccgccgccgccgcccccatgcctcctctccgctggatctgcaagaggagggaggggaggggaggggacccgaggggagtagaggggaggggccgtgtcatgacccaaatattttttttccgtgacagtctaccgtatccttatacgcatatatactaatatttatatatgtccataaggatacaaggcaaaatgcaatgtctaaccatcataactggagcttagacacctacagtggttccatttattattattacttttttttcaccagctatattgcatattacatcggttggttcacttaccaacttattgtcactaggacgataccctatacctagcatgcaagtatgtcctctgggatacctctaaagtctaagtagaccacactctccactaggtctgcatgtcaccatttccctctgacatctcatcttgactagtttctgcgcacatcaaatagtaatatactcaataagagtaaatttcacaaaactacaggtattttgcacaatttatcacaaaactatagatttaagagcttgtttcacaaaactacagatttagtgccttcatttatcataaaactacaggtactttgtacaatctatcacaaaactacagatttaagaacttatttcacaaaaatatagttttagtgtattcgtttatcacagtgctacacatttagtgtcttcatttatcacaaaactacatatctagtatctccattctcacattgctaaaacgtgtagttttgtgagaatggagacactagatatgtagttttgtgataaataaagatattaaacctgtagttttgtgaaacaagttcttaaatatgtagttttgtgatatattattcaaagtacctgtagttttgttataaacaaagacattaaatctatagttttgtgaaactagttctaaaatctgtagttttgtgatagattgtgtaaagtatctgtagttttataaaatttactctaataataatatatgagtatgttatacatacttagtaagattagtacatatagctatatatatgttttaaagacaaaagaaaatactactacctatagatattaacaaccaataaataataaaggacattgaacatagtaaatgagttaaatccacactgcagaggtattaaaataatcgtagtaatctcgttcctttaacccatttttctcttcaactagtgataccctcatctgagaatcacgccgccgggttccctacttgtgtgaggcattccttatctcacattgatatcagccgacccgatatcgttatttcaggtatcggctgtctcaggctaagtatcacaatcacgttattattctcactgataaaatcatcaatacattattcgggtgttcataatactttctattagattcttagtatcaccatttcaatataatattggtaaacaaatttagtcatagtaaaatagttaatgggtgcggtcttgctttgtcttccgttgttctttctctgcgtcccacctaatcaaatatatagatcttcgatattaatttatatctatatttttcatgcagaacattagccactgacataagctactagcaccatagacagaaagaaaaccaacatggagtacagctgcttgctagtaactactagtctctgtactagccactacaagtactaacctttcgcactaatatatctacctcctactacatttagtacacaggatcataaaaagcaccctaaaaaaatatggtaagtgtagcagcctactagtaccacaagaaattttggctaatctagctagcttattactagctacttgctagatctgaatactattaaaatgtaacaatacacttgccctgtgctcacgctggcttctatggtgcgagtagtattcctaggtttttgggaggcttttataggagaagcttcattcgggtctaaggagacacatgcccagtttataagaggaatggatagctttcacctcctggacatttatttgtccatttttttaactagtccctacgatcctattcacaggtgcatgtctatcatatcccctttggtcagtaaaatatactaccctctccattctttctgtttctatctttttcacactttaagttcacaaaataaaataataataataataataataataataataataataattattattattattattattattattattattattattattattattattagtagtagtagtagtactactatactactactactacagcaggccacacgtggtccgccaccgccacccccatgcctcccctccgccggatctgcaaggggagggaggggaggggaggggccgctgcgcaccgccgtccgcctccgccgctgtcgccgtcgcctgcgcccaccgccgggaggagatcgaggagagaggagtgagagagagatcgagagaggatagagaggggtgagagagagatcgagagaggatagagaggagtgagagagagggaggatagagagagatagatcaaccggataaataagagagagagggggaacttaggcccacgcggatgggggagaggagagaaaaaggaaaaattttgaagtgggtaggagggaaactattttcccatgcggttctcttgatagatccgcacgggaaaatcggcgcatttttgcgtgccgattttcctgtgcggtgcgagttaccgcccgccgcaatctaaaagggtccatgtccaggaaaatcttttcagtagtagtgcacagaagtagaaaaaagtttttttttcttcccatcttttctggacaacgactgatagagcaacatcattgagcgcaaccaaatcaaaccaaactcctcccaacacacaagaaaggttttgcgatggattagggggagggggcgagagagagggagataaaaaaagcaaatgtgcatgcaattagaagggagcaatgtggagtagggttccttctccctctactctcactcgcagcacaagcgctgccttgccccgccacgaggaggaggatgaggaaacccattaatctttatctattataaaaattgaagatggttctgtacttatatcttcatcttttttttcgttcgtcatgatgtctccgatacaaagtagtttacttttattcggtcgtatgtatgaaaaccgcactttattgttacaggcagtcgggctgctactgctgcctgctgctatgcatgccgttctgttggcttgcctatccaagtacaggcccatatggccctcagcgatagtccatcagggcgtttggtaagacccacaacccacctggccacctgagagcgatgcgtctctggctgtgctcatatgtcaaggttaccaactctccctccccattttcggcacgcacgcttttcaaacggctaaacggtgcattttttataaaaagtttatatatgaaagttgcttaaaaaaatcatattgatccatttttaaaaaaaaattaagagtaaattgcatattgggccaccttttttaccattgtttcaacttggaccaagtacagagtaaccttttcactttggaccacctatatatgttgtttcattttggggcactcttccacctttaactccatcgatcttctctctggcctacctgaattacatgtcgcactcattctcaagctctgtgatgcctcgctatctcaagtcccgttgttatactctacctcgagctggagtttgacctcccaacaaccagggagatcgatcttctttccaagcgcgtggaggtgacgctgatggagcttcggtacgagcactgatgatcacttgttggtttgctcatggtggttcctctagccctttgcagtcaagaaagagagaagaaacaaagataagagagagggagctggatgtggaagaagaggcccaaaataaaacaaacatgtaaatttaggtggtccaaagtgaaaagattgttctatccccagtccaaattgacacaatggtaaagaaaggtggcccaatatgcaatttactcaaaaattaactaataattaattaatcatgcactaatgaactgcttcgttttctgtgctagagggatggttcctaacccaggcaaaagaacagagcccaatatattggttgcaacaactcaatttggatatctatcatcttcctcctatgtcctatggattcatggaatgattttcgactgtacgtgcatgataatacagatgcattacgttaatttgttgccctgaattgattaatttgccatgtgtctcaacacaagacaacaaagtggcattgtcgcataagagagaacctgcatattctgaagtgtttaaaagctgggtggatttattgttggctcatcgtggggtggtgccgtggtggcggcagatccgtccgttgtagagtcaacggcgttggcaactctcgccgcccgcaagcttcttccttcagccaccagttgcttcttccccaccacttcatgggggcgggggcggcggatccacccgccgcagagcccacggcgacagatccgcctgccacgacgccagcggcatcggcagctcccatcgcccactagctactccctcgtggcattttttggggccgacgatggcagatccacatgttgtggtgccggtgacatcggttgctcccaccaccagctgctcccgccccaccacttcgcgggggtcggcggcggcggcggatccgcccgccacagggtcggcaacatcggctgctcccaccgcccgccaaacagctaccaagctctgtcccgccgccccgagaagatgagcagatacggagggagagggaaagaggggtggaaggtagagatggcaacggggaattcaccacctggggttacatccgcgtccacgtccccgtcaccgtggtgttaaaaatttcacccaccccgtcaccacgcggtgaattaatccccgtggttactcccgtagagagaatcaaagaagggacggcgtgctggcgagtggcgagttggcgacggcgtgtgtggcgcgaggacagccggaggcggcacaagctgcaagagacggctcaagccatgtccccatcgatcgatctatctcgcagtgaggc

SEQ ID NO: 74548 - DNA, 11242 bp, Oryza sativa
ccgaatcctcagacaacatagaacaaggcaagaaagattagtcccaaataatagcctaaaatgtttgctcaaacatacaaataattatttttttaaaaaagcgtagcgattgggcacttcgtccacactaattcatcgggagaaccaatcatcaccgaccgaccgactcgtcgtcgtcgtcatcagcagcaggagagaaaaaaaaaacgaatcaaacatatacaaccgatcgatatattacaggccgggcgtggaggactccgggcgggcaaattacctctccgatccgcgagcgcgcgcgggcggtcggcgaggcgtacgtgcgggactccgtcggccgcctccgcctgcgagacgacagagagataagaagcgcaacgtacgccgtcggcggcgtgtgctccggcgggcgggggtgggggggactacccgtgcgtggaggcggaggcgtggcacgcgtggagaacgcggggcgggagaagcaaagacagggacgggaagggaagggaagggaagcgagacttgtggcgggggaggtggccaacagcgagcggcggaggggagagagagggggagagggagggggacgctttttaccgttggaattgctacggccgcacgaaagccagaccccagaccagaccacctctcgccgatgccgggccggtctttgggccgaatgggcgacatcgataagaatttatttttatttttaaggatataagttcactttaggtctgggaaacgctttataccgcgcgtccgagcgaatcggaaatatcagacgcctcagcagatggattagacgaacttctttcctcttctttttaaatattttttcttctaaactacttatccgatctacaaaccgatcacaccgttgtattcgtttcaattaaatctttacaataatatatcatatgtgttgacgtttgatgtcgcgattccggtatttccatagtgtggggatcgttggtactaggatatatgtgagactgagataaaagagatggagacggggatttttatacaggttcaggcccccgaattatcaggtaatgaccctacatcctgttggccgaaatcggtgttgctctttattcatctggatcacacaagtacaatatttgaggtagcatatctaactgttgtcgacatggcggtctgaaggtctgactcgtagtcgacaacagggtagcatttctcctcgaatccgcatccggcgagatcagagacagtgctatatctctcctgacggtatccgtaggctccgtaggggactagccatgcctgtctctgaagtcgatatctgtcgtcttgtcttggcgtatgttggcttgtatgttgtggcttctgttgttccgtgtcccctctcctcctagggggccttgtatttatacccataggtgtcgccttgtccaaatagaactagaaaaaccaatatggatacaatccgagtagtccttgtcgtttccatgtagaactcagttgtctttccttatccggaactccatccatatccgaaggttgtttccgtataagacattgtatgtggtgggtcctaccgagatttagtcaactgctattaggtatgtggtatccataaccctgacaatatgattatattatatcaaaagaaaaacatatgtttcaaaccgttaaaactaaatgtttcatacatgacagtgatatgtttcaatgtgcgtctgcagtgtgttttacaaaactcctgatactacctgctactactctctcactcctctctctctccacttcatccatgcacacatgcatgtattttagcaagcttcaaaatgatttttctcaaaaattacttatccaatatatgatccgattagaccattgtattcgttttaattaaatctttataacaacatatcgcatgacttgttgtttcatacgtggcagcgacatgtttcaacatgtatcttcaccatgtttcataaaatatttaaatgtttcagttgctgattttttttttcaccatatataacttaatgtttcacttgttggtcaactgcaacatttgaccgtctgattttttgaggagcatcggacgtccgatgggtagctttctccctttaggtctctcactttgtcaccgagtcttagattcgatcctggaccacaatacccagttctcttctccaacaaaattagataaaattttggatacttgtggcagtctttttaaactgctaaacggtgtgtttcgtgcgaaaactttctatacgaaagttgctttaaaatatcgaattaatatatttttttcaagtttgtaatagttataactcaattaatcatacgttaataccacatcgttttgcgtaaaacactaaatcttcatctccaaaagaaaagaacaccacccgtgtaaagatctttatggcgggtccctcaactccccaaaccaatgtaaagatcccaaggtgatttggacgacggtttcggctgacgtggcacctatgtggtgttgacaaagtcagataaaaccgtggggacccacatgtcagtgagggttcaattaaaaataaaaaagttgcagtgggacccacgtacgtagtggagtgatctctacaaggaggtggccggagggaggtgatggggtgcaccgtcgtgtcatgctgcttatcgtttgtcgtggtggagcttgttgtcgttcgcggtgccaccgctaggagaaaggagatggacgagctccacacctaggtcgacatcgtgaggaggggctgaccccctggtcagcaacaaggcggacggaagactggtgtaggtcggtacggcagtatagattaggagacccaagacgaccacggcggctgctagcgtagccggttggagccagtgttggtgagctgggcggcaacccagatctagagcctgttgagggaggcgcggcggaggggatgtgctaggggtccagggcacgccgaccacggtgaagtgactcagggtgcatgcgaagatcgataggtgtgctatttttgttaattcaaatctctcagttcactcgtggccgttgacatgtggagcatcgcatggtggttctcgatgacggaggtgggtgaatccaccgtcgcggccccagcaaccccaccaccaccacttgaggaggcggcggaggaccataggggaacagttgtactgatagagtacttgtggggacccccggttttatacaccggtaatcccatgtgtcatacagtgccactccctggatcagtaggtggtacacacatagcacaatataatatcacaactgacatcgtttacatgtatttctacaataaaaatacaagggtaatctcattgggtcccgaaatagaccaagcatggtcacttacaatacaaaatgccaaagcaatagatagaacagcggaagcgaagcagcggcggtccatcgaactccacaagcaacgactggtgaacctatggtccctaatccatcatcttcaacatgtacttggcagcaacatggcataaatctaatcgacgccaactcctttctaaaagatttaattaagcaagagtgagtacatgcgtactcagcaagccaccactaagaaatgaatctagtgcacacaggggttcaaggatggcttggtttatttgcataaagctagttttcacaatccatttaacaaacctacgacatagcagttttaactgaaaaacaatgttaatgttgaagttgtaattacctagggttcatccacctctccaagcctcgcttggttcggtttaccctcacatttcatcttatatcaactctactatactaacattcccactctttgggcaaggttcacatgtctcttatatttactctaagtaggatcaaaatctatgagtctagtcaagggtattagccgcgagcacggctattcgaatagattggtttactcacactgcagtggatgtacgcttttaatcccacactccgtgacgcacccagcacatgagacttgtcacggctcgatttttcagttacccttgcatggcggcacccgctccaaggactatgaatccccattgcacccccggcgccacattcctccctcgagccggttgtgaggggagtcctggcgctcccaagatcagagattacattatacatatatatagttttgacgtcattaaaccacatacttccacatttccataccaatgtccagaacctaccatgtctggggtgccaccccacgagaataacctagtccaccgggtctaaccccgctcaagaagtgtggtcgtactcggttcgtttcctgcttagcttcttgactcggtccttaactgagcagggtcggcgactagccgttttcagaaccacccatattctatccatgccaccccagtcgaaattattttggttttattaagttttcgggtttcgcaaaggttttcatgttatgggtggcgcttatgtctccacccaattcccaataatcactcccatcgagtgatcagtataaccacatccacatattccacatatggagtgtaaaacgtctatgtaagcagggctaagcagtaagtaaataatcacgtgtaacgtaatagacccaggtaacaaaggtatgtaaatacataaggataacaatatcaaaggtaggcttaaacaattgtaggtaattttataattagcatgcaattttatttgtaatcaacacatttataaaaataggatcaacatgttcaaggagggtgcgtagtgacttgccttgctatcggtcctaatgtcttcgagataattgctccagttagataactagaattcccacgatcgaagaataacccgggtattcgcgctcgataaacggctaaataaaccacacacaatcctaaaagaattaaaataaagcaacattcaatacaactaatggtgccgttaaatagatctcgattttagagagattaccgaagttgaacggagttgatcggaattacagttggaaagatatgaattttcgaagttgggaagggcttataaaccgttgagggaacactcctcggttagggacttgaatcagactttatgagaggctcggagttgaatagaggatgtaacatggactttagtggaaagggaggccgacggttggctatgcccgaatgttagggaagggcattacctagactttgatagcagactcgatcctttgggcttggacagagcatagggaggtgatatagacttccatgggggaagtcaactcagtgaggaaggggctagaacgtgggtcccttcagtgggtcccactcctttcttctctcctatcctctttctctttctctcgatctcatccgctctgctctctcgtttcctcctcgcgagcgccagagggcgagcggccatagcggcggcttggcggcggcctgggggcgacggtggcagggcgacgctcggtggggaggcggcctggctagggcgctaggcgacggggcggcgcggccgtgggcgacggtgtccggcggcgcccggagggaaggcggcatggcggctgggcggctgggaagtggagagggccggcggccaagaggcggcgtgtggcggcggcctagcgcagtgggggaggaggggccggcggctgggtgacggcggcggcctggcacggttggccggtggtgagggagggagggaaggcctgtggtgggaggggcgacggcctggggcgtcgtcttggaggcggcggtggtgaaactggagtggaggttcggcggtgaggagatggagaccggcgatgggaggcagtggagatggaggggagggccggctgtgatggggacggagagggggcggtcgatcggcatggcgccatggtggagggaggcgacaaggcgacggctgattcggtcaaggcgtcgcggctgcggaggtgaccgtacgtcggcgctcggcccggcgccatggcggcttgggtcgggcgaagacggcggtgtaggttaggaggagaaacaatgatgccgcgcgtatggcagggacgatggcgcggccactcggcggcgtcctgggcgaggccaagacgtcggggggcagcggccggacgtgtcggcgcaggcgatggcctagcgacggcgcggcggcagccaggctaggctactaggcggcgcggccgggcgcgtgggagagggttggtgtagtggcaggggagtgacggtgcgcggtccggctaggcgtcggccacgcaaggaggtggcgacggtgcgcacgatggtggcaccgcgccgagacggcgacaagtgagtgggaaaacagagagagggcggtcgacaaaactaggaaagggagagcatggaagggaagggggaagatgctcacattgcggtagccgagtagcggcacaccgtgcgtggtcgacgggcgtcgacaaccggctcgcggatcatcctaggcttgctgttcgtcctcgcacaccatgtgttcgatcgtcgtcaacaaaggaatacataatgctaagggacaacgtcagcgggttagtgcaaggtaagagttagggagttagaagttagcgaaacggaaagtaaaggagtcagcgggttagtgagttaggggttagcgaatccaaaaagaaagagttagagagtcagaggttagcgaaactgaaaatggaagagtcagtgaaacagaaagaaaaaggttagctggttagtgagtcaagggttagatgttaaagttagtcgttctcgggtgatcaatggtgcggcagcctatccgtcctcttgctcaactgaggcccagccggagccggccgcggcggagcaaatggagggatggcagcttgtgcacgggactgaggagtgcagtggcagagctcgagcgtggaggtggagaagaaatggagaggagccgagctgctgctgtctttggtggggtttatataggtttgctggctgcctgtgcatgggaggcgatgtgagggtgggcagggagcagtgccaaaacgtcgacatcgccacactaccaggtacgcatggcccatcgtacttggctttgccacctttcggtgtgatcttggcgttgcccttctcagtgaacttggttctgtggttgcatgtatttggtggagggttttgtggattgggttcatggtgaatgtattgctgctgttggggagggctccagggcatttgatggctgtgaatgtttggtgcaagactctgtgttgtgccggcaaaagtgggtgtgaaaccctgttgtggcttgtgggcaatttatcgaacatgttctgtgcatgctgctgttctgagggaggcaaaatagacttctggtggttggctgagaaagagagcatgagtggctgccaggtcggctggggagggaatacagactttggctgaggaggttgcttggttggctgcagctctgagcttagggaggcaaaacagacttgttgtgagatgagctgggctgacagggaagggaggtagcctggttgcaataggaacttttgcatattgcagggattgaattggaatgacatactatgtattaatgcaacttgtaatttggactgtatttatattttggaatgtataatctggacatttatttggctctgtacatcggactgtgcttgtatggtactatggagtgtatggttgtgttcggtatagaaattccgttatgcacaaggattgaatgattggactgcaatacgaggtttggtatttacggaacctgcattgccaaataggaatctaggcttaacgcctgacgaacgaattcatcggtcgtcatagattattttgagaatgctcgtacgaacgaacgacagtagtgaattaaggatttttagggacgacgtgtggcatacaaatccaatcatcgtggtaggaatagatttgaggatattcaaatcaatgtacgataaataaatacgtcgatcgtttgtagatattcgagggaattatcgagtcggaatgatataacggtttgaaataaccggagggtaaaaattgagaaagatatgtcgtgttgtgacataagggaaggttttcgggttatatattcaggtctgtgatttgtttagtaccgaagcacttaataaatcagaccgtgaagacaagggaaggaaaggacgttggactgagggcgtccctttaagagataagatttaatcgagatctttggcacacaacctaaatacacacaaatgcataataaatcctagcatgcaaaaaggttttaaaaagatttttgattattccgaatttttaatttcgtattttagaatcgaaattttcagggtgttacagtactccaagcccaccaccaccgcgacggaagatgccatggcaagaggaggagagagatcaaaacaccaaactagttgctgttgtggcagccgtccttcaccatcccgcttgaccccatactcgttggggtggcacgccatcataaatttcacgactgacagtgacctggtccttaaatcgcccgacgagagagtgtgcagtggggagagcagtggcagtgagcgaccaggcgcacaagtgtggaaccaacctcgcgagccacgctcggagcccaccgcggttcctcctcgccgcctccacctctgtgtcggttgtgtcccgacgatgatgccagtgacatgttgttctcgtcatcttcccctcacctcgtcatcccgattctcaccttcctttttgtccacctcgccaccgccatcattagagtccgtgggcggggaaggtcttcgtcgatggtcactgtcagtgtccttcctccttcgagctagcttctcctaccagttgccattctcctaaccactcgccgctggccttctcctcaccgctcaccgcctggtgagatgggaacaggggaggaagagagagataggtgaagaggtcttgatgggcccacactgactcggtactattgatttggatgtcacgtcaaacaaaaccacccgctatactatcatgggacctacattgcatcagttttgacaattgagggactcggtgtatatggtatttctgttgaaggatgaaaatcgaacttgctgtcaagttaagggactaaaatgaacttattccttatttttatagtttgtgtaaatttcacaaaactatagatattttaaccaaattattgcaaaactatttaaggtattgtgttacaaagcagcacattagggctaattttatcataaaaggctaatgccataaaactacatatttaatagagtaaattgcgtgttgggccacaaattcttaccaaagtttcacttttgaccaccctttgttttttttaaaaaaaataggctaggtttttttgccaaatgtatcactttggaccggttggctcatatatcgatgagactataacaatctctattgtccatgtgtcagttacatgtgggccactcgatccaaagtgcaatttggccataatacttagtccaaagtaaaaaaagaacacagtaagagtgatccaaaataaaactttggtaaaaatatgtgactcaaagtgcaatctactcaatttaatattgaagttatcacagaacaatgatcttagagttcaaatccctaacaccaccattatgttgaggttataaacgttctagttttgtgattaaattggcaccaaccttgtagttttgtgataaaatttgctacttaatatatagttttgtgatacttcattttaaatctgtagttttaaatttgacgctaatatatatttttgtgttaaaataccttaaatatatagtttttgtcaaagtatatgtagctttatgaaatttactcttaaagtttttttaacactatttaatatataaaactatatatactcctctcatcatctagaagggttaattttcccatcatatactgtagtcttgtgaacacagcacacctatcacttgtcccgtaataagttcattttttataatcattacattaaaatttgtaaaaatagaaaataactatatgagagtagataaaatgaggaataattatcttgagatttaataaaataggggtattcaagtcattttgattttgtattggtatgatatgtgaaaaataaactttttcttaagaaacacagtagccttgtgaacacatgcacacctttcacttgtcccataataagttcatttttgtaatcattgcattgagatttataaaagtagaaaataattgtatttgggatagataatatgaggaataattatcttgggatttaataaagtagggtagggatttaataaagtagggtattcgagtctttttgattttgtattggtgtatgcgggataggtgaaaaatgaacattttttttagaaacatagtagccttttgaaggcacacacgttgacaagcacaccttatgagctgactatgggtacatcacctattattttagaattagctgtaaataaaaaacgttatgtctaagacttaaatctgggtaaattgatttcaccataagtatcctaccaagttgagatactttaacctaccgaaggaaacagaaaagccggagcttacggcgtccacatacggtgtactaaggaataagttcactggaggtccctcaacttaacagcgagattttttgacgtcccttaaccgtaaaaccagaaatcttcatccctaaactatacaaaaccatccaattcaggtcccatggcagtagagatgcctggtttcactgacgtggcaccctagtaagcaaataataataataataataataataataataataataataataataataataataataataatgtggggcccacatgtaagtgagaggaaatgatgtgggccccatatctcctctttcttttccttctcttatcttttctccttccctcacttctcttgagctggtgcgacagtggagcgggcaaggggagagagacggccacgcgacggcaccggcaggacggggggagagaagcggccagcgcaaccgcacgcgacggcgagagaggcgggtagcgtgggcatggagcgggcacgccgacccatctgctgggcggcgtgggcagcgcagagagggggagagaggcggccggcgcgaccactcctgacgacgagagaggcgggcggcacggagcgagtgcgctgtcccatccgccaggcggcgcggagagggggagagaggcggccggcgcccggcgctaccgctcgctccggcgggagatggggagaaaggcgctaccgctcatgacggcgggagagggggaga

SEQ ID NO: 74549 - DNA, 26602 bp, Oryza sativa
agacactaggagcacggagaacacgcccctttttcctcggcgccgatctgaacctgccaccgtcgctactgccgaatccatcctctccggtgagccattgctcgattcctcgcacatacgccaccatagggacctcactaacacttgatgactgcatgcatgccagttcttggagctgtcaagctatcatcgtcgacccagaggagattgccgccgccgagcagttgcacgagtcgccgtcacccaccaagctttgccagtcctgtctagcatctcggtgagcatcctggactccttaggaagcacatgcatgcatgtatctagcgaaaacgaggccccaaagcagcatgcagtagcagcctaagcacagccgtcgctcagacccgccgccggcgctactccaatgtcccataaccaagaaaactagaggaatggaatcgcgagagcttggtcttcattttatcttttgacctcaacctcaagcgagccaccgtttgccgccggcgagctcgagatcgacctcagccatggctagctctgctgtgtctagagcagagggatgacttccgtgaattagattaagcgcagggatccgtttacaattgtagaaacacactgacatatgggcctaggactgcgggttgattcctagaaaccccaagggcctttgtgcatattggtccctcacagccatgtggaccccatcctttaaaatctgaagaataattaagaaaatgcccaaacaaatatatgtttagcagaaaaatgcacaaagttgtaaaatctatataaaatcaaatatagctcattttgaagtgattccagttgctgtagattcttgaagttatgaactttattccaggaatataaaacttgacactcactgtacaaataatgtctctaaaatttatctaagataggtcatacataaaacatgtacaaacttataaaatacatagaaaattcatctcaactcattttgaaacaaactcaaaaactgcagattcatcatcatgcactctctggttaggtgaaataaaagtaattacttactttgcataaaatgcctctaaaactattatatctaaaatgattagttttagataagctaaactttagaaattcatgtagaacccaatttagcttcaatttgaataaacttaagttctataggatcaccaaaacacgtatttccatgttatgaaataagattatatacttactgtgtagtaaaagtctctaaatattcatataaggatttactaacatagagcaacctttaatttgtaaaacttgtagagaatttatttttagtccaaatgaaatgaacaaagtttctatagaaccagcaaatagttagcttcaacatagtaaaataaaatttggcaccttttgtagagaacatagatcaaaaccttaacttagtgaaataagaatttaaacacatagtgttatttaagtaatacataaacatgtataagtatatatacactttaggtataattaaacctaaataaaaacttgattgaccagtgaggccatagttccatactcatccactaaaacttagaagaacttaactcatatgacaatttctaggttaatataatatattgctagtttagattagagcatctctagtttataaaatatgaaccatagtagtacagaccataacatgtgaaataaaaatgttttagttaaccaaattattccttttattcaacttaaacaggaagtagcatgttctaaacctataactcaaaagtcatgaacatataaaacactatatgcctaaaacacgttgtaacttgtaaaatctataagaaaatcactataactccaaaaattgtgaaaccaaatgtgttagtcttagaaaacacatctccacacccctgtgaagtctaatataataaaaatcactttacaaaagtattttataacactacctaagactactactataaaccgataaaaattctaaaattcataactcccaaatggaataagataaaatagatattatttcacctaaattcattttagatcagtaccaacccactgtgcataaatcatgcattttagagcattttggattttcagctctttcggtgtttaattgcataacgtgtcatttatatagataattgcataatcggtgaaggactggattaggtgctaacgtttctctgatcaaggcaagttttctcctcccatcctttgaacacattgaatcccatgatttgaggaatgaaaatatttgtttgcaaagttgcatgtgaacttagactatatcggtatttaaaattgggttaaggtagttatgacctatttgctacatacccccaccttgaataattgatcctcttgctgtttgaaaccctagaaatggttagagtacactctttgtgctcaaatgggtttatatatgctctatgtgcaactacttgcttagccatgcttagaaatatgcaaatgctcattccatctataattaaaatgtgattttgatacatgaacctttgctagaataaaatgaatatgatgggtatttgcgaactaaaatgtgtaaaatgtgattttatacttgggcggcaagtggtgtgcatatggtgttagttgcataccgatagggggagtgtttgcccaagtccataaggaccgaacttgtgtcacccatttaaagttattcgtacatccacatgtgctagtatgggatggtctaagctgattaatctatttaggactagccttgcattctggtaggccggtgtgtatgagttcgtataattcagaggagcttcctatttaccccgacgtggtagtttaggtgactaaacatgtccaatacaacggtattgtgccacgtggtgggttcccgtcgtgtccgccaccacggcgttaagtttaaggcgtgggcccaccacttaacggttctagacatatttccaagtatgcctaggatggaggaacacgtatcgtgctggtgcaaggctagattctaagtagtgtaaaggattcgttgtgacctctagtccgcactcataatgtagagtgtgtggtacttggccggcactgaaccaactagagtgtagcctctaggcttctatcatatcatgtgggtaaaggtgtacaaactctgcagagttctttaaactaatcgattagccgtgctcacagtcaagagcgctttggtgatgtgtcatgagtatttaaactaatcgattagccgtgctcacagtcaagagcgctttggtgatgtgtcatgagtatagactatgttttaaaaatgtaatcatgtgacattggtttgaaattgataaatgtgttgagttgtgtgtgtggtgatacattatgacttattgttaagtatgacaataagagattgattatgatggaattatgaagaagttaataatgaaacttaaaacttgtctttgttaattgaagcatcaactcctttacaaaagaattgcgaaacaaaacttgctttatgctgaaattaaactacatattgccttcctttgaatatatgtcttacatgtagtatgataggattgatttgtgcttgccagtacattaaacaagttaacttgtttaatgtactgacttgctgttgatataaccttttgtttgcaggtttagatttagtctttgagtgatgcgggttccgattgcttcttctaggatgagaacttaatggggtaaacccctagtcgatgtgcttgtgattgggtagtcaagcttccgctgttctctaataagtctatttggccggtcggtctatgtaattattaagttgttgtaagtcttaagtttcttttatcttagttgtgtttgctatgtataatcatgtttaagatgaaagtgtgaatctagtgcactagtgcacatcctgggaactagatttacatgagtatgagttaggaatatttgagaggttgtagatctttagctatttttgtcaagtttcctgaatgtgtaacacatctggtcgccgccttcgagtggtttgacgggcacatatcaggctgaagttgactggcaggctaagggcttagcaatgtcttcaatatttctctctcgaggcgtccgatgtttcattatgcttgtttgatgacttgaattattcacttcatctctcaaatataatggaaggtctggagagcctacgacactcttaccgaatcactatcaaatcgactcaaataccctactctaattggcaatgatagtcattctaatataggcccagaccgagcacaagtcatatcatattggctgtatcggccatcagcctcataaaccttgatcaacttacactctgtcttctagcaaatacggtatccagccgatgcgcaatccgactccaaattcaactcgattccacaccaaatctgcttcgatcttcttctttcttctccgaatttgatgcaaaattccgttgttaacaatattatacaaaatctctctgatttgattttgtcttcgacataagcccccataggcttttatgtgggcttggcttcacttttatataatgacccatgtatatatactccaggggtgttgattacgtgaagaataacaactcaatcatgttaacatgaattcttgaggataactcttcaacaaggcatagtgctgaagctggtcaccaagcaaaaaaaaaaagtctaaaacaactacttataaaggtaaactaatactatgtaagtacaacgttattatacaatatttaattctggtagcaacaatattttgtgttgtatacatataaacccaagacttcatatttaccacttaagcagctattagttaggtctactatatactttttggacacaaccattgtgagccttatgcattatattgctgagtagatgttctcatcacttgagcatacggtacagcaagtaatggcattaagacctagaagaagtttgcttgtgtagaagaattccacaagaataagaaaatatctcaatgtgaattctagatgaacattaaatacacaagaagatgacgacgtgataaaccttgaactccactcgatacgctcacggctttgattggcctgatctttcggtgagttgagataactacgatttgggagcaacgttgacgatccgactacaaccttacaagacgtcgttgtgttacgccttagcgatcgatacacctcccccttggttgttgatcttgctggtgcagatcaatcttattcctgcaagcaaatcgaagaaacaagtaagaacaagataaaagcaatatgatattgcaaataggaattgaataaacatgataagttggggttctgaagacgagcaattaggtggtatagccaacacacgtaactacaaggtaaagtagcaatggctaaaactttaatctaacaaaacccgagaaattataaagaggtcctgttgacggtcgttatcgatcagtttcgactgtcaatattactaaaatagaggagaactagtgatgcttgcaatggataaatatattaaaataataatattccactagtattaggtatactaacatttttcagagaatgaccataaagtggaggagaatcgacatcaacacagacgataaatcaatcggacgatgtcgagaaccagacttatgtatgaatgggccaagaactcagaattgacacgacaaactgagccaaaattcacaagtctgcggagaaaaacaacagagtaggggtgggcataaaaaccgtgaaccgaagaccgaagccgaaaaaaccgtaaccgaggccgaaaaaaccgaatttccagttatcggtcacaacatcgtgtgttaggtctaaaagaccgaagttctttcggtgagttcggtcatcgtcgttaattaaccgaaaaaaccgaaggaccgatcaacccaactgcatgtattcttttccaggcccattagtctattgcgtgtgtacagcccacaagctaaccctcctttaaagagaaaaaaacaccttatcacttatccccatattcccctccacacagaaatcacggatgcggcatctctgcaagctctcactccgccgccgacggaaacgagaaaactgcatcccgcagtcacgcctccgcttcttcccatgagcttccattctcttctccccttcccttctaagcttcaattgctccactgcccagtgcccatgaggccatgaaccgaggatctgaggggtgaggcaagaaacgccgcaggcttaggctcggccacccgcagttggtcgccttggaggcgcggccgcgcggggttgagcaatcgtccgcgaacgaggagggttgagcaagctggtgcgccggaggtaggcaagcaacagatgccggcttggggtttctggtttattgatttagtcaatggggaaatgtaatctatgactttatgactttttgtttgagattttgattaatctctttgtgaatttgtatattcaggacgtaattgataattttgatgcattcccatgtttggttgttctgcttttgcttatttacttcgatgtgcaccttgttaaatcggtcagctcgggtaaaactgaagaccgacccgacacttcggttacccgaaatgtcggtccatgaattttttgttgcaaatatcgggttcttgttttcaaagactgaagttttaaaaacccgaacaaccctggccgatttttcggtctagaccgaaagcccacccctacaacagaggaggccgccagctgaaccatgggttggttgggccggccccaagtttggccaaacttctctcatcgccgctggatgcagggtttcttctggacggtgtggattagctctcaatgacggttggagggtatttctgaccattccaaccgtcacaaacatcattggggtgctatataaacccctcaccttctcacttcacccacacacctcaagcaatagctctctcatttctctcaagtttcctcaccttctcacttcacccacacacctcaagcaatagctctctcatttctctcaagtttagtttagtagtatctagctggtggaataggaatagagtagaaatcaggagtccggaagccttccgaagagttcgggtatgactctagtagcttttctcttctcttttgtaagctttgtacttttattagaatactcttctttatatatttatggtattaaaatacttgccgaatatatgaatatctactttatattatgttcatgttatactgaatatacagctaacttatctgggagatgctttggtgcgggtataatgtttacttatgcaattactctgtcatgacaatgatattagagtagtatctggtagtttaggcgtggtgtctagattacgggatattattatttggggttatatattgcggatgagaggtgggccgctgatggtgacagctcagtacgggtattcctccgcgccggtatataatcctaagttaattccctggggagggtattcctccgtatttagcccgggttgtatggtcatgacggactgtcgtaaggaactcggcagtcagtgatggcttctcgaagtaccaggaaggcatcgaatagagggtattagctagtatatcagttaactataatgtatgtatactatgtatattagaagtataggaatagattatctttctcttttctatccacttaggttagatgatatattatgagaatgagtagttaatgcttgtgtgtcactctacccttagattatcttaacccctgcttagaatatgattatcacaagtaatatataaattattagtcaatgttctctctatatgatctttccacgggataaaataaatacgataccattggaatactctcgggtgaaatgctacaatgttatatccgtgcgcttgcggatgaactctgtaaccataataaaccaggagtatttttgcgtcattgctgggaattatatttctagtaatgtcgttaagaaatactaacaggtacctagctatttaaggaggctatttaaggagttgggatgatgaccaaggggtctctaaggtcatgctccaccagattggggcgcaccccatatgggtcccacttaggctagggtccaagacgaagttacgggctcataggcccattatagatgacacaataccttgggcggatgactaagatggaattttaagatgaggttggatcctttggaaagaggactccgagatctttccatcaagtaatcacaggccgaaaacagaggttgtatgcatatttggcggccgtttgaagtcagcaatgtagcaggtggccgaatcagattccaaaactcatgtggcttgatcttgatgtctcccagttgagctatgatgtgagcaacggttgcatcaatagtggctatgatcatatcatgacggtaggttatttatgagttataaggcatgggatgttggccttaacatgggctggccagacgagacttaattactccccaaagtagattgtcatattgcgagcagctcgaatggaattttgacatcaatttcatggcaacagtgaagcacgtccgatcaggacagtctgactaggtcttgttaaacttgttgggattagcatgtgtatccaaggaaaaactttccttgtcatacaattgttctatataccactggtatgaaaggtgaatgacatttagcatcaacataattttctttatgaaaaatgttctaaaatgctataggtaatagtatatgcatgttttaattattccatcatatagatagtcctagaatatctatagttccataaaaaaaaaattagagcgtgacatttgttatagatctaatgaccataatacactgtaaatattgcttgggtagctttctatttataaattgactatttattatgttatacatttttaaactagaggtaaaggcgtaaatagttattttctattttatatatatatatatatatatatatatatgtatgtatatatgtatgtatgtatgtatatatatatgtatgtatgtatgtactactaccgggagcaactactcccatcttatctatgtggcagtgcaaatttctgctatttcggagtccccattggcgtgttaattagccatgtcatccaacccgtttagaatgataaccattattttcatgggatacaaacaattttgaatgcatgttagttcatccgccagaggagcagaatatggacactacgattggcagaaaccattttttctcccattgatgttctgttccgtttccaaataatgttctgctcctttccaatcgatgttctgttccgtttacaaataatgttatgctcctttccagttgatatttttctgcttctttttaatttcctgcctttcttaacgtcttctgcttagtgacgattttgttgaaggagcagaagatgtgcttctgttcaaattagttttctgctccctttctaaccgatgttctgctccttgcctcctttcctaggtcacatactccatactgcttcctttcatgtttctgctcattttcaagtcttataagcttcatatagacgatgagattcaatttaacaggcagaaggtattctgcactttttattccttgttctatgcgttcttacaaatttgaaatgacctgaatggacacaacagacgtcacaaattatgggccggggagcaaaagatgttctgcaattgtttctgccgagtcctatgtctaatagtgaatggaatcggtttgtgaaagagcagaagatattctgttatctctaccatccattgattcaggagggggattatagctttctgctgcacaaattctgttatgccgttgtgattaaaaagagtatcatccctcaactcggctgtgttgtacatccataccaacagaaactatcctgagcaaaatataacatacctatttaagtatgtaaacataaactgcaattagtaatcaataggcagaatatgaactgccgttacatagagaaaaaattggtatttgttctgccaacaatttgttttttcgatgatgttctgccattttctttttctgatgttctgccatttttttcaattggccagctacatatcttctgacggttagaagcagagcatattctgccaaggcgagcacataggaacaaactccaaccgaatgttttgcatgcagccgatgatttagcatttatttgaactaataaactatttagttaattacttaattaaacaacccggtctgcagaagtttagtagattcagggttattccgttaaatcgatccgttaagggaagggttactcccgggcaccatggtatcaaatgcacaaaatcattcaaatatttcaaaattttcaaattatgagtatatacctagttataagaattcgatttatacctacacctaacaacaaaacaactcaaatttaactttatctcacaatccatgattacatacctaactaattatatgtttggatgctatatacctagaatcaaaatctaacaaaaacaagttcaaattcagttcaaacttgctttgaactagttagtaaagtagttaatgttaatatctaaatatttgaaaaagtttcatactcatttgaattggatatatactcaatttcaacaatggtgcccgggcaccatggagcaccaaacaaatttataatatatatatatatatatatatatatatatatatatatatatatataaacatgtatcaagtgaagtacataaattttataatatatatttttttatataatataaacaatacactgctaatgactatacttacttaaaaagtaatgtagtagcattaaaataaataaaatttataatagtttaataatattatgtaagttttcagatttcatattaaaagaacctacgaacaagaaaatcgggctgcaagaaccggattttcttctgaattatctaaaattcagaagacaaaaataatcgaggaccaaacaatacctagcaagaagttgcttaatctctagagctatgatctttatattggtttttgccaatctaaactaactcatcacaactaatgaaaatctaaactaaagataatgaagggatgaattcaagagattcaacgcaatgatggaaccaactaaagaaatagattcatcgccggttgaagcgtcccgtctaccgcttctgcttgcgattcttgatatgccccgtcttgctggtgtcagcggcggcctgccaattcaagccaggaggcatcgctatctgcgtccccaatgatgctgcagtcaccttgcgtctccaatgatgctgcagtcaccttgaaagaggccggacacaggagctgctcagctggaaccgggaccacttctttttcttgtttgtcatcaggagcttcgagaggtctggagatggagattcttccgatcgtcgccaagctcccctctgctgctgccgtgcgccctccctctccttctgattctgcctgcgcccactctctccctcgctctctcttctactaattgacgatgaaagaataactcgaggagaaaatacaaatcggtgggctcccttcccctaccttgtaccattactagtaatgtaccattatatagagcgtcttgattcagcggcttagtttttctctctaactccaaataccacccttgatatcataaacttcaaaactcatttttttatttttctttcaattcaattcgttagtgactcaattatgcttccattttcattttcaattcaatttgttactgactcaattatgccaatggcgccctcggagaaatatgaatcggaacggaaggcagctgttctaaggcgatgtggcggcggagaggtgtactagctgcgctggtcaccggttgctacttgcggctcctgcatgcgcgcggtaggatggcagattggttgttggtggcttgatgactgtcattccgatgagggccggatccactggtggcgctccaaaaaagcttcggatctgatggtggtcgttcagggaggtacggtagtgacgctgacggtggccgacgtccaggctatggcggtgccgcttgatggctatcgaccgatgtgatggtggtgatggcgtcggtggtggccgagaaaggtggcagtggaggtggttaccggccggccttgcactccgatgatgtgtggccatgccgccgtggacgtggtggcagcgaggactagcggcgtcggcgctcttggtggtggcgacatagtgatgttgggcggtgtcgggggctagtcctccgatccgtccattcctcggtcacaggaggagagggctggtgacgacggacagcggtgagggactagccctccccctgcaacggcggctcaactaatgggtatggtgatagtggtggttggttggttcggccatggcagtttgtgatgacgatggcggatgctcttggtgttggtgtcctagggatggcggtgacttggcgaggtccggcgctggttctgaccatgaccaggtgaggacaagggatggtgatcatcgatgacggggctggttgacaatgcaatggtcgttggctcgcccgatgcagataaggacgacagcaacgaaagtttttgatgactgcatcataggaaaggttgctaccaagcaaacatcgacgcaaaggtctgggtacggttatgtctcgattgcagtggagcgtcttcgacaagtctttgattgtagaggcagtgcatgtcatgctaaacggctccacgacgctctagaagcgacagtgatatcgatggtctacagaagatggtggtggcgcagcaaggacgcttcgtgacgcggtaagggcgttcagaatgcggctgcagcttaggtgttttggacagggcgtaaggtgttttggatggcgatggcagacagaaagcataaaagttggcagcagatggtgattgtgttctgcagagggagagatgatgcgaatataggtagctcggactagttctaattctcctctttccccgtcttgcactgcgacggaaagaataagtcttcgatgaaggttggagctaagtcttctcgcttttttttttgtgtgcgtgtgtgtgtttgtttcttttcctcagtgtgaggtttagagtctatgatctcgtgtatgtgttttggctatgtatatcctttgtagatatagagaccggattaatgaaaaatctattatctaaaaaagatttgttggtgactagtattatgacaattatgcttccaatttgttacgatttcactacatgttgtacgagccaatttatttgaaaagcatccgtgcttgaccacaacattttcatcctcccaatcgagatgaacgtatttacaagttgtgcacttgtgtacacacaattgcaacgttttctttttccttttcaatactttgtttgtcggtaccaacacttgaaaattttgaaaaaacgccgccgctagcgcaggtgtcctctaacatcttcctgatcatgcccccactactgatatgttttttctttgagaactactactgatatgttcgtcttgtttttttattcatactagaaaggtaaagatcatttaatttgtatacatgtatcaacggataaataatcagacatgatgaagaaaaagaacatcaatcatacgggaaagcacgatatgtcgtcctgctttatctcaagtagagcaagaattgacggaggaattagcaactttaatcaaccttttcagttggcatattcttttagaaagtatctacgtgtcctgttaaccgtttggtataatacaaatggaatcagatgatacaaaagtgggcaacgatgtacataagatccacacggactttgcgagtctcgttcgcttgctatctccacatccacacggactctcgttcgcaggttgctcgcgagtcatgacccacgcagtctcctacgcataatgggaattggacacggatgacgtaacaaaagttttgacaaaaatatcttccattttataatagtatatatctatacaaatatttaacatttataaaataatttgattaaactttagaaattttgatcaccaataattttttaagtgtttagtttaaaagcagaagaaaatatatacatagttaaagaagtactatcaaaaaaataatccagttttgaaatgaaggggagatcatctcatacctcccgtttagtgttcccattagaatttagaactgtccatagtcatgcatgtgtgtgttggagagctgccttgcttgggggctgggcgcagcaggctcatccgatgggaacgatggacagaaaacccaggtgaccagggaagagcaaggagccttcggctgtgtctgggaaacaggacttatttcaagaccctatcacatcggatgtttaacattaatttagagtattaaacatagattaattacaaaatacattctataaccttggactaattcgcgagacgaatcttttgagcttaattacattatgatttgacaatgtaatgctacagtaaagttattataattatggattaattaggcttaaaaaattcgtctcgcagattagctctcatttatgaaattagtttttttattagtctatgtttaatactccaaattagcgtctaaacatccgatatgatatggactaaaaaagttttagccccatctcttcacgtacaagagggatctggggaggaagacgagtccgatcggtcattatctaaaagaaatatttctatgcatgccaccatgctcgctactcacatgattcctgagaccgactcaatgatgaggcaacgtaccaagcttccagcaacaacaattttaattgttataatagtagagatatgtgagatgagcggaaaatgaacttattttaggatagagagtacatgtgtaaccacactaccataagaaacgttatccatatgaatatatacttacttcgtccaaaaagaatcaaatcctaactataaatctaaccaaatgcttgtttaggggttcatagccagagttcgaggttttttttggacggattacatctcagtggaaatctgacattgtagtatctctgaactcaaatattgtcaaggttccatttacaatactactattgtacaaaacaaagttaaagcacatatcgacacggtagagcggaaacgcctaatgccgagtttcatcatagtccctaaaattttcaaattctacgagaaaacaaagttctgaacaagattgccaaacagcacaagattgtgcctgtctgcgtatcaatcggtgtaggacttttcaagtcaagtttattcagcatccactagcattttttacatcgataagccaaaagttttcggtactacatgctagctactagactgtgacagacgatctgggcgcacacttcctccatcgagacaaatttcatcatctggtagcggcggttcattccccatatccctagtcttgtgcaggagaaaagttcctgcaacgatggtcacaaaaccacataactgtgttgcaatctgtgttgcattccgtgagaatgaatcctggaatagaaaaggcaacgatggccaaatatatcagacaaaaatggcagattgtcagttgaattggaaatacaaaacagttatttgaactcaaaacactcttggtcattgcaagagaacatcaagctgaaaggataatgctgtaactgctgatgggatgtaattttgaaatagtaggatccattgaagtcagggacacaggccaaagcaataagtgatgaacaaccttgtggagttgtggtctagtgagtttttctttttctttttttttatttataaagatggtctagcagattaatttcctccaaatgagttatcatggaaacacctaaataaaagcctggaattcctacacccagcaaaacaaaacatgatcttcagatatagaaaaaaaaaactgaagttcaacctatacatttgaactcgtgagatataaacaaaccttaactgcctaaatcttattatctgcagagatacctggcagttatcataatgcaattcaaaaaacagtttaaacttttttataattctttaatgtacattcagaagaaaataagaaaaagtaaagcaaaagcttcatatattattgataagtttttttttcaaatatatagcttattgctaaaaagtttcttctaatttgtggcacagtgccagtcagtaccagggtttgcaatttcggttgccaccgaaatttcggtggttgccgaaaatttgaaaattttgtgatttccgggtttttcggaccgaaattatttgaacttttaacatgttttgactgaatttgaacgaattttgaccaaatttacaaatatttgagaaaaaaacagaaaattttggggagatttgtgcttgctggtgggggccgaaatttctgaaattttgaaccgaaattttaaaccattgtcagtactaatctggagcgcattttctctcagggagacaaacactacaggaatcacatttgcagatacaattttaaagctatttgaaagtaacaagtacatcaccttgtacataatcatgttagcaaaaatagtaagtatggtgaacatcacgtagtacacaggagagaccacagctgtattaaatgagtccagtgcctgcaacaaattaaatagtcagaactcaaacagagttcaaacacatatttctgcagcagcctttatgatttagaattatcaataaatagtactacgtatctattttagaaataactcacaatttggattattagtgtacaatcatatcttctcctttactttcagaacaaattattgacttgagtagttatgctttgatgataaggattgcaaaaaaaaaaaagacatattccaaagtgtgttacacctgcacttacctttggaaaaactaaagcaaataaagcatttgccatactttcataggagtaaaaaataacaagctggccgtaatatgctagactgcttgcttagtataggttatgaaacaaacatagggaaataaatatatttgagtaattgaggcttaggtcatgtcagacattatagagcgattatttgcatattgagttacactttttgacataagctgaaatgaaattggaagcatagaaggtttaaaagtttgttgcagaatagagcacctcatgcatggccaaacatgatcacccatttaagcaaactcacacataaatgcaaatttacacaaatggcatcaacattatgaatgcttaccttatttaagtagttcaactgcaccaaacaacaaactataacaactactatgaagaaccatgtttggatgtagatgaactgatttgatccaccaaatgacagcttcaaggcaatggcaactgcctttacactgataacctgttccaaaaaccataattgtattaatccacaatcactaaccacatccattcaattaactgaatccaaaggtgatgtatgtcttatataccgtgagagatcccattgttgaacagattgcaatataaacaagcatcttcctgtgtccagaacgttcagcaacccagaaaatcaaaaatagaacagacaccacagccacacatgaataaacaataaaacctgcagaagttatccagataacaaaaccttgtggttaacattctataagaagttccattcttagaacaagtgagagaataagtaaatgctcgcaagagaactttaagatcattattattgggatatattacccaaagttgcaaaattttgcgatggttgtagtcttgcaattttccatagtattggtcaagtcagggaatacattcagttttaccccataaaaaggggaaaaaattaaacatccacattggatacatcgtcctacaattagcagatttagtaataaagcttcctcacaaaaaaaaaagattatgtagtaacacatgaaaatactagtgttttttaaaatgttagcagtacaaaagtatcctacggtatacatattatattaatacgaaaagataaaaatggatcctgttggttctttattgacagaagtattcaagtagtttacctggctcagtagcaagatgccatatttcatctattgaatcaatctctctctcctttggggcatgcaaaactataccaacagagccaacaacacacaagatacagccaacaacaccaaacatatggagtttttctttcaagacgaagtgtgcgagcactgcactgcatgaacaaaatagtaaagaaacaaaaaacatactttgatgcatgagtaaattatagaatgtggtatggatactacctaaatataatgctaagagctcctagaggagtaacaagtacagcgggagcaaatgcatatgctgcaaagtttgctacctcgcccagaatcactgcaaggtaaaacaagatgattaggaataacgtttgagcttccggttcatatcacaaatattggttcacatctaagtatcagtatccagtatgttgatttgaactctgtattaatgagatggctaccctttttgaaagtgaaataatcagaaagggaaatgtaaataataattataataataggatagatcgcagcagtgatattgaattgcagggcatgatgctcataagcactactccctccgtttcacaatgtaagtcattctagcattttccacattcatattgatgttaatgaatctagacatatatatctatctagatttattaacatcaatatgaatgtagaaaatgctagaatgacttacattatgaaacggagaagtactttttagcgattatattctgcagataaattgctaagttgaaaaccatccatgttttttttaaaacaaaggtcctaatctgagtatcaagtgttcagaattaagctgatccaagatttgctttttctcaaactttgcaaaagtacctactccggattcctgaaatcctgaatcatatgataatttaattgaagtgatgtaaatcatgtggattggccctaggattactgtactggtggtggatctacacaaaacttaatgctataattatagcattcagtgattatgcttcacactaacccatcatccaccatttttttcttctattttttatggttgaagtaaacaacaaaaaagtgaaccagtacctatattcaactaggacttattactcaaggtgtgtgacacaattcagtcagtagtgagcagcaaatccacaatgcagaatacttgattttttaaaaaacatatgactagaatacttcaaaaggcatggttctaatacacacttactagttatcatccccaaccaccataatggctcatacaagtatgagaacctccagaacctacagtgcatattaaaaaatatgaacaagtaatactacataaaaggctgaaagaattcaaaactgcacttgaaaacattatgcaattctacatataaaaagcatttgtttgcaatgtcaaaagttcattcagtttatatagttgctggaagatgtacaacctgctcttaccccagaatccccagccttcttgagcccaattttcttgataataaagcttgatccgataaatgcacttgatgatatggccagggtcaaccctctcacattgtctatagatgttaccatgccttctggaatgagaacctatgaacctatacctacaatccaaaatagtctaatgaagaaaacatttcatatattgaacttgtagacagtgatgttcaacctcaggttgcttttgcattaactcccatgtaatctgtagagaaagtggaatagatgcctcaccaatgtggggaggtgaactctcatatatatatatagcagaattacaatcaatactagggagttacataagaccaaaggtctaggagagtaactatctaggagtgtaaaagtttaggagataaacagcctatagattaataaataatcctaatacccgcccacggtcgcagcgggaggagcacgaacgcacagactggaccgaaaatcagtaaataactgaaccggcaagcctttggtcatgatgtccgcgaactggtgcgatgaagggacatgaagtacccggacttgtcccaaagccaccttttcacggacaaagtggatgtcgatctcgatatgcttcgtccgtcgatgatgcacgggattcgctgtcatgtaaacagcactgacattgtcacaatagacaatagtagccgaagcaatcgggacatgaagttccagtagcagttgccgcaaccagcagcactcggcaacggcatgagcaacggcacggtactccgcctcagcactggaacgagagacagtagtctggcgcttggaggaccaagaaaccagattgtctccaaggaagacacagtagccggacgtggaacgacgagaatcgggacaacccgcccaatccgcatcggagtatgccgtgagggactgaatcgggccggagccgatgtggaggccggtggagaggctgcccttcacgtaccggaggatacgcttgaccaaggcgagatgaggctcccgcggatcatgcatgaagaggcagacctgctgaacggcgtaagccaaatccggccgagtcaacgtgaggtactgtagggcgccagcgatgctcctgtactctgaaggatcggcaacaggcaggccgtcggtggcggagagcttggcacgagtgtccactggtgtcgatgtagaatggcactcggccatgccggcccggtgaagaagatccacagcgtactagcgctgcgagaggaagaggccggcggaggagcgcgtcacagagatgccgaggaagaagtggaggtcaccaaggtctgtcatggcgaactcggagcggaggcgagccataagctgctgaagtagtgacgtggtcgaagcagtgaggatgatgtcgtcgacgtacaacagaagataggcaatatgatctccatctttgtaaacaaagagagatgtatcggacgccgaaggcagaaatcccatctgtcgaatgtacgtggcaaaccgctggtaccacgcacggggagcctgcttgagaccatacagggacttctgcaatagacagacagcatcaggggcagcggggtcaacaaacccggagggttgctgacaatagacggtctcctctaggtgaccatgaagaaacgcattcttcacatccagttgatgaattggccaagcacgggatgcagcgatgctgagaacaacccgtatggtggccggcttgacaaccgggctaaatgtctcgtcgtagtcgatgccatgctgctgcgagtaaccacggaccacccaacgggccttgtgacgagcaagagtgccatcagagtggaacttatgcttgaatatccacttgcccgtcacaatgttggccccaggggggcgaggaacgagacgccaagtgccgttgtcaaccaacgccttgtactcatcagccatggcagtgcgccagttgggatcagccaacgcactgcgataattggccggaacaggagaagcagcggtggcgtgggtagccgtgtaggtcagcctgtcaaccggccgtaaggagccagtctgggagcgcgtcaccatggaatgcggctgaggagcagtagccgtgacaaccacattgggtgaagatgatggcgggaccgtcacggtgggccgacgggtgtagacatggcggaatggtgacatggtgccggctcgggtggcaccgaccgacagggcagcgccgatcgaggaggcactgaccaagggcgtgccagctgagcgggcgtcacgtgccgcagggacggtgtcgttcggcaagcgtcggccgaagaggggaacgtacggttgctcaacctccgtggagggagccaccgtaaggcgtcgcggttgctcaacctccgaggagggagccaccgtgagaggtcgcggttgctcaacctctgatgagggagccaccgctggagggagtccctgcaacaaaaaatcaaaagacgagggagcagggggagttgccgcgaagggaaatcgtgattcgtcaaacacgacgtggcacaaaatgatgatgcggcgagtggagagatccagacatcggtatcccttgtgggaggccgggtacccaagaaaaacgcaaactgtcgaacgaggggcaagcttatgtggagtcgtggcactcaagtttgggtaacaaagacagccaaagacgcgaaggtgggagtagtctggggtggtgcgatgtaggagctgaaaaggtagtgagtggtgaacagaggaggagggtctccggttgagaaggtaggtggcggtggcgagagcctcagcccagtaggaaggaggcatagaggcctgtataagaagggtgcgtatggagttgttcatggtgcggagcatccgttaggctttaccattttggggagaggtgtaaaggcaagagagtcgtagctgggtgccacgactagtaagaaaggaagtggtggctgtattgacaaactctctgccattatcagcctgaagggttttgagtggtaagccaaattgggtggaaacatactcggcaaactcaacaagatgacgatgaacatcagatttgtgtcggagtggaaaggtccaacagaaatgactgaaatcatcaagcaccactaaataatatttaaaacccgaagtactcaacaccggagaggtccatacatcgcaatggacaagctcaaagggagcgaaagtgcgagacaaagacctatcgaaaggtaatcgggtatgtttgcctaactgacacacatgacataaagaggtgtctattttattacaggaaatagaggacatattccgaagactgtggatggcggctggaccagggtgactgagacgacggtgccaaagcgtggaagaagtggcgagggagcaggacgcggtgttggagggagtggcagctggaagggtgtagagttccccgtgactattgcagcgaagaatcacgcgccgggtctgaaggtccttaacagagaaaccaaattcatcaaactcaatggaacatttattgtcgcgggtaaactgacgaactgaaagtaaattacgaactaaggaaggggcgacaaggatgtttttgagtgcaaatttggtggttcctatgggtagaaaagaggtgccacgacaagtaacgggaatagtttgaccatttccaacagtaataaaagtgtaagagttaggcaagcgtgtaacgaggataccatcagtggaggacatatgagatgtcgcgccggtgtccaaaacccagttgtttgggctttggaaggccatctggttcagtgctgcaatgaggccagcttgctcccaattgggctggcctgtaggagcagatgtgggcgacacaaatggcccagcatatgtggtattggcctgggagtagtgggccgtcggagccggcccaagaaggccggccgaagaggggcgccaggcctgttgctgggccggccaggggttaaaacaaacccaaggcccggccagcctccagctagggttggccacccagccggtcgaactccctccagcagagaagccgccgccaccagaggaaacgccgccgccaccgccgccagagaaggcctggcgagcgccaccaccacccccactgccgccgccgttccctcctccatttccaccgccacgtccaccatttcccttgcggttgcggcggttcgtgttgccgccggtgcgggcctggccagcagggaagccgccgccaccagtcccaccgcccgggaaggtctggcgtgcgccgccaccactcccactgccgccacccccaccgccagaggagatgcagccgccgggagggcaggaaccggagccgaagccgccgctggccaccagcgccgtggctgccgccaccctggcttcgttggcgatgcgcaactccttcagcaggagggtgttgcgcgctgaggtgaagctgggaggacggctgcgccggcgatgttatctccggtgttggagaagcgctcgttcaggcctcggaggaggttaagcacgagttgggattcggtgacggcgtggccgacgtcgcgaagagcgtcggcagcggtctccatcttctggcagtaatcgtcgatggaggagtcgccttgaatcatggagtgaaactggtggctgaggaagatcgctcgaggctctttgttggcgtggaacatgtcctcgatggcgacccagagctcccgcgcggtctgatcgggctccatggcgaggtcaaggacgttgtcggcgactgacccgaagatccagctgcggatgcagcagtcggcctgttcccaagccgggtcattggggcgtggaggagcggaaccgtcgatgtgagccatcaacccgaacttgccgcacaaagatgtgaagaaggccctccatttgttgtagttcgggtgggtgttttctagggtgatggggacgtgggatttgacggcgaccgtggcgtaggggtggaggaattcgctggtggtgctggaagaagaagaaccactcgaggccgaggaggtggaggactgagttgattcagtcgacatggctgggatgcagctgtgatggcagcgtgctagagcagcggaaaagaaggtaagagcctaggctctgataccatgtagagaaagtggaatagatgcctcaccaatgtggggaggtgaactctcatatatatatagcagaattacaatcaatactagggagttacataagaccaaaggtctaggagagtaactatctaggagtgtaaaagtttaggagataaacagcctatagattaataaataatcctaatataatccttaagctaagagggaagataggagcaactagatgttggctgattacaaacaattgtttgtttgaccttctgaagatttcataatcaaggaataaatttgatttatttatgtttttcaatgaaattatttatgttcgaatgctatggtgcaaatccattatgagaagaaactggtttagaaagtgatacgtttctctattccttgctaaagcaacatggaaaggactgtaggcttcagacctctccaactcatagaacatgccagagaaaagaaacacttaaaggaaatacttgcataaaatcgaatggtcataaatgtgtacagcatggaatggggaagcagcttttgcctgttgatactacaaccaaaatgtaaggaaactgaactttgagacaaaactcgatctgtctactgagaaaaaaaagtagtataataagcatgacggaaaaatatcaaatcgtaataagcgttctacatggtgcagaacatagaagatgacaaaatccatgttttgtgcaaaattcttctttggtagaaattaaggagatctgaatttgtatttcactcgacagaaatgaaatgaggacatatagcattagcaagacacagggcaacaactttttttttttagataatggattaaaaacccggcctctacaacagggcaacaactacaagcaaccctgcggaaaaagcttccccaaggcagattgctgcttaagtgataatgccttacaacctgcttcatcgcatatttgcagcacaaactactacaagtagcagactttggcatatgaaaagattttttttgtcctttgagaaatgtttcctatgaaagagagaattttcttcttaatacatgtacagcacatataaggctgtactcatgaatcatgatcaaagcattcaagatgccaaaacacgactatggcttttagttcatccctacatgagttaccaagaacactacggcacgataattaaatttacgattacaatctagcaaaggaaagcacaagaaaccacacggattgaaattcaagaaaacactagtgcccaatacttgtaagataacagaaagaaaaatatccatcctctacgtcaaaagattacgcaggcacacaacccaacattaccatcagaatctccttacctcgaaattcagcaagaaaggaccactagttccccacaagctagcaacggaaagaaacgtagatgagattatgagaaaacaagagcacaaccggttgataaccacaaggattaaagtgcatgttattgccagcgattctgagagctggcacgtgaaggttaagggaacttttgaccacgccagccatgcacaggaaagaggagaaagctttaaatagacgttaagaatgtcaatgagcacgagaatgagggaagaacaagtggaaattaactgccggctacaattaataattgctttgccagattaaatcaaatcttgtgcaaaggaaacggagagaaatgtgtagtagtaactaggatcattgctttgagcggttaattaccatcgacttcaattttaaagcaataacgaaattaattatcaaagcacggggtgagaaagaattaaattcccatgaaaacgtttgcttgctgctgaaccatccatgcgtaaagcaagccaaaaatcacggaacaaaactgacgtgaacttgtaaccggtggaaggcaaagcgttcgaaacgaaaaggggataatccaatgaagaaactgaaaattttaaaatccctcggggaaggaaaaaagaaaacaagaataccaccgaatcctcagacaacatagaacaaggca

SEQ ID NO: 74550 - DNA, 34381 bp, Oryza sativa
caaccgaaactaaagtggtgatctttagtcccggttggtaacaccaaccgagactaaagatcctcggccccctgacatcaatctgacaggggatgaaccgagactaaagaaccaactgggactaaaaatcatagaatgcctcttgggttttcaaccgggactaaagatcatttttagtcatgggattattatggttttgggtcgacccagcaaagatcatttctccaccagtgtaatatgatctttctgggagacatcaactttctagcaagaaaaggttacagagattagtcaactgtgactacgattcatgcaaagacaaaaaatactactccttccatttcgaaatgtttgataccgttgactttttagcatatttttgaccgttcgtcttatttaaaaacttttgtgaaatatgtaaaattatatgcctacataaaaatatatttaacaatgaattaaatgataagaaaagaattaataattacttaaattttttgaataaaacgaacggtaaaacatgtgctaaaaagtcaacggcgtaaacatttcgaaacggagggagtactaaaaatagatgtaccgaccagatcggtttcgatggcacctctaagtttttcatcctcaacaatcaacggttttccacatttacagtatctcaagatgcgctcagcaatctcctcaggaagaccatcacaatgccacactgtcgactcatcaatcttaatgaatttgatcaataagatgagctggtaacaacagtcacagcatgatattaggtatacaaaggttaaggcgcaaagtcacaaatgaaacataggagccctgcatctttccaacagattgctttttgtcattattattttctggtgtagggtggctacttccgcattattattttgcagtctaagattatttgattttagtcgtgatgtacttttagttgtagcaaactctttaaatgacagtgatagccaaggaaaccacataaaactaaattaagctagtttatctacggatatgagtaataatcctggatgaaagtaccaagcagaaaactctctctaatgaaagtaaatatggtagaatcaggaagacccaacttgtctaacaaaatcaaacttggcaaaacgcgaccacagatgctgcaaaataacaatacagagtgaaaaatcataagaataattacagacaataacctgcaattaatgatgacttgggatatatattgcgtatacatacctgttcagaacaaagtgtttgaaatgcaacgaagagagcgaatcccgacggcgtcttcagcaccactagattgtccacgtattcgagttccatatatacgctcaggccttctttaattgatccagttcacaagagcacaacaaattaatcctagttagttcagcgcacactcaactcgattagggcaactattacagtgacgctttgcatctggatatcacaaaaaacgtacattaaaatcagtgggactgtggggtacaccagtttacaacaatatatatatatatatatatatatatatatatatatatatatatatatatatatatataattataatgattcgatcatatcaggaaatgcctcacacaggaaagaaatatttgctcatggatagatcgatgctagagatgactaaatcaacaagatcgttgacatggaccatcgataccaccacagctcgaatttgactacaatatcaagctactacctatatacgatatcccgatccagatcatcgatgccaagaaaggactcgacgatgcatagcaaaacgaggacccaatgctattacaggagaggtgtaggaaggaagaaagcccgtggacgcatgcgcccgcgtacgtacctcgagtgcaggctgcggattcagcccacggtgcacacgaggtggagggtggggttatataggagcattcctagccgcaaatctaaatttgatccgttatattttccatccaattggatggctatccagaaaaaaaaaatcctctccccatattcctttttcactttcttctatattttagtattacattccaactaacgttaataacgcaatatatactttataatggcaatatctgtaaatcttgctaaaaaatccaaatttattgcattacaaatctatatctatatttatatctatacctaattaaaaaatacataagggttccgacaattttttttcgtccgtgcgtattcttttcgccgttttttttttcgtcgtctttttcggttttattcccatccgcttcttttcatgggttggcatggctgttgggcccgaggatggtggcccgaggaggaggaaaggaagagaggtggctgctgggcccaagtagagatagggatgacggcccaagagggagggatggcagcccaagagggaggagaaggaagaatgggccagatttggcccagaattaggagagggtttttagtttgtttttactttaaattaattattaaaattatatttgtattattaaaattagcaattgagctttgaaaaattcaaaacaagtctagatagtatggttcattcgtgaagaatttaataaaaaatatattcagtattttattttaataataacatgttatttaattctaattctaatctatacctctatacctaataaaaaaatacgtaaggatttcgggtgatctgtttaattgtcgggtcaaaaccgcggttgatatagtatatgtatcttccatgtaatcacctctctcctttttacacatatattacttgcactgtgtatatgtgggcctctcctggaataagtctactttccctccctcctgtcaaatcatatttgcgcgcaaatttttttttcctcgaccactagcacggaacatgcacatccggttgatgaaaaatcaaaactatagcacctctttcttcaacaattttttgatgattataaaatcttataatgaactagtttttaattcaaaattttaatttaattatattatgtacacaaaaatcctaattgtaactcatgatttttttaaaatatatatattcaagcaaattcccacattgaatttcaccttaactagaccgtataacaacaataagattaaaataaatttcagccgttgcaacgcatatacattttttctagtatatatcaattaccctaatctcatttttatgttcctctgtcatatttgtccaatcatatttctcttcctctcttctttatacctatcgacatgagagagtgatagtgcaggctcaagtgtgggcgcgggtggagaacaaaatgtcgacaagggtggcacgggtgcgaggcacagtcggcgtaggcacgggaatggggagctagggtcggcgttggcggcacagcctcgagcgttggtggagcaggcataaggcccgggtggcacggccacaggcgtgggcggaggagcgggctaaatttgggggtttctttcaccgggatagtgggcgcgctaattttggaggcactgatgcgtatcagctgcaatttagttgatggattggatgggatagatgagctgctgagaatgctctaataagataatgttgtggtctaaaaatggtgaggtattggattcggttttgacagtgttagtgatatgccctagaggcaatcatagagatgattgtatcatatactatgtttacatatttatccgatattgttccttgaaatagataactcattattggttaatgaatatgtgattctttcatgagactctttatgttatgtgttactatttctaaaggattcctgatcaaatatcatatgtggaacaaatatgtttagatgatcagcatatgtattaattgatgatcatgtctcatcgatcatggtatagagataccaaaataataatgtggacacatgttagtgaacatgttattagatagacccaacatgagacactgcaagagccatatgtgttgtgtcatcagtgatctcatttagtgttggtgttgaatccatagacctgaggttatcatggtttctaacatgtgtagtaacttactcagggactgctaaacgctactccgtaactggatagttataaaagtagttttcgggtatgctatgaaacatgcagtgggatatgaataatcaagatgggatttgcccctcctatggagagatatctctgggcccctcgatgttatagattatggaagtgcatggccataccaaaggtgattgaggagtcaatcacaagttatataatctatcaacaggttcgagtgaatgattaagctattagaggatgacacatatctagccttgagcttaatcgatatcgtgaggcaaaggggttcatacaagtatacactataggttcatccgatatgatctttatgtatgcccggtgggtcaatacgttctgctaggggcagctgttgacgcgtggaccgaaaaggagttttcgggttacagccgagtatatatgaacctacagggtcgcacgcttaatgggccggaataaggggattgcatagagatccaatatgagcttaattcggatagggatccgaataggagtcctacgggccttggaggcccgagtgatagatcctatatattcgtgaggggtgtgaccggcagaggcattgcatcacgtgagaaaccctagccgtcacttccctccccgagtaaaaccctagccgcgcgcgggtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcgatcgactacttcctctacatcgacgcgcactgcttcgcgagagtttcttcgacttctcagcgtcttcttccgctgcgcagcgcgtcgagtggtaacgatctatgatctaatatttgcatggttcctggtttacgtgatagaaaattttgatttatgctatcgtagcctacgcgtatcccaacagacagcataatgtagcttggtgctctggcggcttggctgatgttcaaagtggatagtcggtgtcttgctcgtttttgcgatgcctttggcaacgatgatgtgataattgtggagttggagctgctgtgtcgctaagcgacaaggtcggcaacaacacttgcctcacgaagtcaaagcctttgaattacttgcaacaagctctttatcaatggctgtttttttgggctccgctattgtccttttttcacggtcttagttagaatgttgtggttgtggtttttgccagtttctcctaattaactgtgcattgtaaggtttggtcatgttttcttcttaaaatatgacacattcttctctatataaaacgccgcaacggcatgaccgttcgaaaaaagacaacataatgtaggggcctaatgtgcagcaaacatatatttttgcatacaactattggccaagttttagttaactccattaactatccaagctgtgttattttattggctcctttttgtgatttgcatactggtttacgctgatgtgctaatgacatgggactaaatgagcgggtatgttggatgtttagatgccatatggcatttaaactctcttggtgcgcacgagtagcggcaaaaggagaggaggaggatgagcgccattttataggccgggggaggaggggaatggctggcaagcaaggtggccggccatcaatggcgacagtttgtcggagattaaatttagcgaattaaatccaaattgaaaggggcaaacatgggaaaataaagaggaggaagagaggaaccgatttttacaatcaactagtaaggtagcccgcgcattcgcataggcatgtatcgtagactgtgtttgagaacttataatgatgaaatgttaatcggaacttataaaagatcattttatttatttatattatttgagcacatttaaaaaaacattaagtaattggactattttctctaattaaaggaactcgatgttttatgcagtggctcaaactattcatatttcagttagttatttttgtttacgaagtgtatgtttaatttagctatacatgtttcaaaacatagcatggtgcgactctatgttgttgagttatttctttttcttttggcaaattaaatataaaaattttgttctggtactattgatttaatttagctatgcatgtttgtagaatttttcataatgacataatatttattgtcaaaattttaaggtatttagatgtggtgcaaagtgcatgggtggactgtgcccaaatgctataattcttatgcagcaaaatatatgcatatataaatattacattgttagtttaattataaatagagaataattagatagaaatcagaaatgtatagcttataaaaaaattgtagttgtttcaacattgattgtttctcttctagtttagtagctacaaaaataaggaatgggagggcagtgttttctacatgtgagatagaggaggtggagggattttagtgaaaactgttgatgcaaaaacacgaggcctggaaaatctgcttaacttcagtgcaggtccaaaaatcttgcttttaggttcgtgagtgtgccagttgatttgatcctgcaatcaacaagaaataaagacagaaaccgcggttaaatccataaacgatagccgatcggctagttaccgatgacatatcaattatctctgagccgatgtcatatgttaattgatcggcaatcatgaataaataagaaagaactaaatctactcgatcggctgtagatattaacaatatgtaattcttatgtcgatatatacttaaatcaagtgattgggatagatcggtcgcgatgccgagacagtataattcacttagatcgaaatatatactaacaatgagattatagatgtttatagcatagccgatcagatagatctagcatgtatcggttaatactccgatactactctatgttaagatattaaagcaagcaaaatatatcaaacagaagcctaacatactttgttgtactaaaatcataacataaagggctgatttagcatgtcaattatgtcaattatcaattatcattcataagatataaagctaaaccaggtaagatcggctaaaactgctaccctaattggcaatcaaaagcaggctagagattgagattctaatcacgacttataaggtcaaactcaactgatgcagctataattatgaaaaaaaggacaatatctagacaatcaagccgttggatgtttcatagagtggtggatatcctatataatctaagtcaacgttggtatttaacctaatcggctgccttctagcaacagatgttagccgattgaaggttagataacaatattgcctaagattatatagaatatatgataactcgacgaattacataaacaagattagagtatcataaagatggaggcactaatcccgagaacgcaagccgccataacaagttttacctctagttgaagatcgaaaccgatgcagctcaactcgagagcaagaactcgtcgaaacaaaacgaaagtaaagggtggcgatgcgccgagattgtattgaacttgtgttgttgtattacatggggctcggggtctatttatacccgagattacaaaatatgtccgtgtcggacacgactcttatctctaacaaactctaatataccataagtctttgcggcagacttttgcccaaacatatctataaggaaattacatgaaatatcctaattaatagatacaattgccttctcaggactcaatccgtgcatggcaatcctcatgaagcacattaactcaacccgacaacgtgcattacatcatattgtcggtattggctcaatcggccaacctagtccgacttgaactctgtctatcctgatcatagccgattcggactttagtcgattctcgctctatttccgtaacgatctccatctcgaattccgctttgattctatcctcatctccgatacttggatttccaaatttggttgttaacacatgcccctcaagtccggaatatttggtaatgtttcggatttgccatatccgtgtctccgagagtatcgctcattgccatttttccgaccgttaccgcctcgctttaaatactaaccgtcgtccccgagaaatttcacaccattagctccgttttcaccgcttaagccaaccttgtttctttctctccggcgatcccctcggagcaccatacgtccccaaggcgatttcccctccggccaaatattctgcccgcggagatgtcgtcctccgctagtccgttcgtcgcgccatcggccgaatacgcagaggtaagtatccatcggctagatcctctcttttcgcaatagattggttcttccttgcctcatcttgttttcatcttctctgttcttgtttacatctgtagcacttgtccaatctggtcgcgatcccaagtttgtcacatgagcatcactattttcttggtccgatcggcaatcttgatcccactgagttcatcatcgccgaaaccaataggatcccttttagattggccaacccgaatctaggtcactagaagaataccttcaaatcttggccttctcttgagaaaactttccctgagaaaagttgggctgtgtggtataagtgtgtatcggctagcaagcaagttcgctgggacgaattaggaatcggccaagcgcttgctcttactctagcaaattcggccaaggatgaacccctgatggcctccgcagcatacttttggtccaacaccctcaacgctttcttgttcaaccaagggccgatgattcccactctgctcgatatcaccatgcttactggattggatgtaactgcatcggctaaccccatgagcttgaacaccaaaaaccagtttgattttaggaccaagagcataggtggctggtctggctatgttgctgcatacacgggcaaaggatctgtcacccccgggagcacacggcttttcttctgatgtggcttgagaaattcctcttccgcggatcaagctgtggccctaccaccaattggcaattcttagccgaagcccttgagaccaagaggcagttccctctgggtaaaattcttctcagctatctgtaccaaatgttgagcaatgcatcggccaagatagccacaggctcagtagtgggtgcaggtggaccatggtggcaattgcaaacatggcttaaccttgttgtcatgatggttatgaatcgaccacctttaacatagtctgaatttccaaggttggagcccactactaatgatgatggggcgccgatgcctatcatatggtgaagctgcatcaacaccagccaattctggagcaaagctatcggctaaactgctcaaagactggttctgcagtttctatgagggcttccagagagatgtagggtttggttcccatatgaggattcagtgaattttgatctcccggtagacttcacatttgaggatatcaattctgaaaaatttgacaaatctagagaagtcttctcgactgctattagtccatgcatccttcctgtcggcatccatcaaggaagaaacatacaagcttcttatgagttttaccatccaatgagctcagctagatagtttggaatgggacagctatcaatcgacttgttctttgccgataagatccagtacagaggagaaatctcatcaacattgatgatggatcggctgctcaacatcccaggacctcctttaggcagtatcgagaacatagagctggcaaggttcaggagtaggaattttgacagatggtgggggtgaatggaagcagcatatattccatcagccggcctctatgtacatgatagatttatttccagatgttgtccctcaggtatatttttactttgtcaattctgttggaataattgttagccgacttgaatcttgactaacttctttctttgccttgcagacaacagaatcttctcctcctcgcaagagcaacagtggcagggacatagaatatgctccaggccttctaccaaatggaggtggattagctcccccagtcatcggctatcatgcccccaagacctcaagtctgcttcaagggcaaatgagagaaccagccgatgttggcaggttatgcattcgaaatcatgaatgactaatgcataaaataaagatatagaatatagggcatttatgctcaaaggagaggaataataacttgccttgctccaacgcaataaatccgagatagccaacctgattatccaatgcttgaaataccaaaggttgccatccaattataatagactctactgaagaagaggaagaactaaattcaataaaagatcgataagcggctaggagagctagggttcagggtatagtatctcctttatagggtatagggattattgggctatcatttgttggcggtaggtttaggtagtataatagctagggtttagttatatgagagtcgattgtggaataggatagcatatcggctaggctctatattttatatggaggttccagagggttggaggctagaggggattaagcaactactgtcacttatattttatgtgaaggctctcgtggtttggatgatagggaatatactagatatttgatatggttaaataggtatgtggctaatatgggtcaaggttgggctttggtagaatagtggttagggtttagttgtttaggccggtatcgagataggataaatatcggctagggttttgggtgtttgctagtcgtcattagagttgggcaacatgacgactagatttggtatcttctctagccggtgtcggtggataatatatcagctagagaaataggaggtgggtgcaggtttagtggggcggaagtgttactccgacaaccgtgagttgtgacggagtggctaagattacacagagcttgagagcaaactgtgtggcctgctgtggaggtcgaggaaatagtgaagctccaaccgttgtacgcgtcgaggcgtggggtgctagagtatcaattcaaccttgggtttgggttttgctaggttttacaaccaacagtttgacgtcatggccagtagaccgtacggacgtccacatagaaggtgtaaagttttaaccggcggcttttagtggctaaagggtattttaaaaataacaggaaatatttgaaaggtaaatataagtttcaattataagtttaaatcaaatatttattcaaatggtatttgaataaattaaggaaattcaaataaaatcttaaaatagcaaatttgatatcaaaatgaaggatttgaatttaggtccaagttttactggaatcggattacggtttaggagatatgggcttctaaagattggattttgaattaaatctagaaattgcgaaatagtactgtagggggcccacctgtcattagctgtcctttttctttttcttttttttttctcttcttcttcctcccgattcctcttctctttttctgttggcaaccgagagggagagagaggagagggcgagcggggcgccggccctccggtggccggaatgcggcgacgccggtggcatatcgtgttcccgctcgatgcgtactcgaggaggtcggtggctggtagagaggaagaggaaggaaaccagaacggaggcggcaagaacttgctctgaccgcttaaagaagtgatgatggtggctgctatggagtgggagagaagggggaaacgggaaaaatgggctcgtcggagggaggcgaagccggtggtgcgaggagaggggaagaggagctacggatggggagatcgaccgacgacgtcgacgatcggccatgggaagagagagacggagctcgaagagatcggtcgatgtgggaaaaacagagggggttcgttcacttatataggccatgagaggcggtggcggatgacggttgtagaggagaaacacaaggacgattttgcgacggcggcgtggaaaagaaggaggcggcgccggcttcttcctgcgattggttgggcagtgatggcgtgaggacgtggcggccgtggaagagttgggcggcggagtagggcgcacggtacggcatcgacgtcggcgtatgaggtcagcaggtgacggtggcacaaaccacggcgacggcgacgctgtgggcggcggcgcactaatggcgcacggcagcggcggctgtggcgctacatgcgcccacaggaagaggagggaggtgggaggatgcggctcagcagtctgggccggcttgggccgcgtgagtgagagaaattcggtccaaagttaaaaaggaggaagtctaattttcctagagattcaaataattgatttagaggaatttggacggctagattttgaaaaggatttgaattcggagatattgatacatggagaaggattttaaaataaggatgctctaatttatttgagtgcaatattttgagagatagaatataacgggatttatttaatgcactcaaatgagagggaggggaaataaataggatgttagccgcaaattatttggcaaggattttggggaagtatttgaggctaataggggacttggattttggatgaaaagataaaacctattttcttggcacaagagtaattattcacaatatttgtaataatattattcttgcaccgagaagggtattctagccacacgattcaaatcggtggctaggtcaaaaggaaggatttggatatttgaattgaggtttaaggataggtttaagatcaaaggattggttaacaattaattccaataagattggaattgctttggtttaggttctagcacaatatgggaaggtttcttggaccataattcataatagtaaaaaggttttcaaactaaatttaaataaaagaaattttaggaaaaagaaggttttagattgaaaccaaatcaagaaatacctcaagataaatttaaaataaaaatcacaaaagattttgaacatcaaagagagattttatgcaagttaattttaggagggccctctaattatattgtcctaggtttaggaggttattgagaacataagaatcatcatgatgcaagattagaaaatagttaattttcaggatgttacatgtcacttgaacacatacatgacgtgtgaaggggtgggaagtgggtcttttccgtttttatattgttaagatagcagtagaaaataataagtataccatgtttaagttaaaataatcgatggttaggtgtattatgtaatttctttagaatttctaagatttattgtaaactactggaaaaaccatctttggtcggtcgcccaaaaaccacaatagtcccagttcgaataggaaccgggactaaagattatttttagtcccggttaaaaactttttgatctttagtcccagttgatgttaccaatcgagattaaagatcatttttactcccggttcaaagaagttattgggtcaagttaggccccaatcatcttagatctttagttccggttctttatactacccgggaccaaaaatcctcccgagcgcacgtcgagtcctctctctcagttttatagataagaccgataaaaaccatatccacttcctctctcattaaaaaccatctccactctccagcctcctcgatcccatctcaatctcaggtgttctccttctcgatcggctctagcatttttagtcccggttagtaacacgaaccgggactaaaagttgattttttttttgtctcggttatttcaccagggactaaagatttatactcccggttgcaaaaccgggagtatagggggttgtaaaccaggaggaaataccatttctccaccagtggtagtgtcacatggtggcttaggagtgttcataggagtcccgtgtggtggtttgagagtattttgtaggaattttagttgacttttagcatataatggatagatatggcatgctaagttgtcgaaatgtgtgcctaatatatctctacatgtttctttagggaatatatttctacaagtaaaattatactggtgtaaactacatttttctgacattgtagatctattttatttacatgccagtgaagttattatatagcatgaaacaatataataatgtcactttcttttcataatttttacaagctaaattatagttaagaggtgtattaaattctaatttgtgattttagttataataatgacacaaatagaacatataatttcatccgatagcaaaaaaaaaaacttcctttaaagagaaacagagaggagttatgtacatgcgtatgcacgggaagaggggacacctctttgtaagaaatagaaaaatcaaactaatccaagtatccaacggcttggagtggtgtgcctattaattttagtgaaatcaagggctaggtttttttctcagattttttctaatttattggagcgtcacgtggcattatagaagcatttatataagcatcatgtgacagcttagaagcatttatagaaattttcacggacttttactatataatataatagatagattggatatcatcgatataatttagcgaaacatatttgtagaattattgaaggtgacatataatataatatgccaactagagatgaggggagagagggaatacgtacgtacaggaggccaggaggggaatgtacaggtggtggggaccagtgtggagagaggaggattttatttttttatttgatctaatggttaaaaatgttggagccaccaatttaaaagaaaatcaacggttatatttttagactgtcacttggcatcttaggagcgtttgtaggagaacacgtggcggtttaggagtacaggtggtggggaccggtggggagagaggaggattttattttttttatttgatctaatggttaaaaatgttggactaaccaatttaaaggaaaatcaacggttagatttttagactgccacttggcatcttaggagcgtttgtggagaacacgtggcggtttaggagcgtttgtaggaagtttaatggacttaggaggattttattttattttatttgatctaatggttaaaaatgttggagccaccaatttaaaggaaaatcaacggttagatttttagactgtcacttggcatcttaggagcgtttgtaggagaacacgtggcggtttaggagtacaggtggtggggaccggtggggagagaggaggattttattttttttatttgatctaatggttaaaaatgttggactaaccaatttaaaggaaaatcaacggttagatttttagactgccacttggcatcttaggagcgtttgtggagaacacgtggcggtttaggagcgtttgtaggaagtttaatggacttttagtatataatagataaataatagatttggaggagaatcgatcatgaagcaagatcaagggattggaagcgcttgagttcgtcggctgggagaagaacgggtggcggctggggaagacgacaactcgtcgcgtccctgggtcggctgggccgagcccgagcaaggagggaaggtaactggggtgaggcggctgcagcccaagggaaggaggggagagggggattgttcaggagagatggtccgagggagaggatggccaagagggagggagagaaggaacaaattcaccttatatccataatttgtcaccgagtttaaaattcatccacaaaccaaaatactagatataatggatctctcaatttacaaaactggatcacctgaggttctaggtagtattatgcccggttttagctaacctggcaaactgagtcagcgtgagacccatgcgggctccacatatcaatggcctatcttcctctctctctctctctctctctcctctcttctcctctctccgccctctcttctactctcttcccaatcatcctggatgccgatcggccgaccgacgccatgaggaagctgttgctgccggccccacgccaacatgaggaagttgctgctgatgcatgattggacacggcctgtgtgaactggaagttgaggggccaagcgcggctttggccgatggactccaacaatgacgacggtggctccgatgggggcacacgacggtggtggcacgggtccgcattccagcggccacactccataagcacccgatattggctctgtttaaaaaggaaagattatgaatttctgacatcaatggtcacatggcttaaattacaactgactaattcctgagaggggcgacaacgacaactgacaggtgggccccacacggcgcgcccagaggtagccagtatggtgcaatcagtgggaggaggcgcctatgcctgatgatcactgccagcaaccatcggtgcggcaagacaaggagagggggcaggtcaggaagaaatgggtgaggcctcgcaactcactgagacgtggcgggggcagaaacgagatgaggcagggatgggcgacaagggggacagtggcattccattgatctccaggctcaacaaaggggtggatgaggacagcgaggatgaaggtggtgaaaccggcgacgacctgtaagtggctgcggcggtgccggccgcacgcacatgctaggccggcccaaggccaagcggcgaggaagagagggagggaggtgtgtggggtcaccttgctgttgttggggaggaggaggaagaggggcagaggctgtccctcgagatctggcacgtggatgtggtggggccagcagggactgacgacttgttgacggtccataagtaaaaaatatatgaccatcaattattgcataaaaccaattggaataaaacatcaaacttagtgatagtggtcattactaatcatttccgcacgagttggtgaatatttgtttgtaggtgaattatggacgaaaactactagccatgcgatgaaagacacccccggacaattggaaacgagtacatggattggaggccccacatgttaatcaaaatcacctaaaattaaacccatgtaaggtacaacatgcagatggcccaccatgcaacctctcagccgaaggattaagtttgttttagttgcatttaatttaactttccttcacaaaattgcgagagcatcgccaccggttggacagagcaccactgtcggggtgtgcagccatagtcgctagcatcactagagcatgcattgcttatcacctgatgcatacccagagggcattggttaacacctgatgcatacctagaggttagacaaaggagccgacaaatgcattccaattggacctccatgtagccgaataatagattctcactgcatctagtgtgttgttactgaaaaaaaacagatatacggttttgtttggaatctatagagctggacaaatagaacattttctaactagtgtagctttatagcaactagattgtctagtgtagctttatagcaactagattgtccagtgacgttaggggatttcaatataataagaaaggaaagtgagaaaagtaaaaagggttatagtagatagagtttcttaatgcaataattgagcaaaataatttaatacagtttatgagaaattagatagtattttggtctcaaatgaatcattttcccatggtcatggtgaaggttagaagtttagaaaggttaatagagcaacgctccgctgatttctacttgcagtattctactacaagaagaattaatctcgaccctttattttaaagggtagattagtaatctcttaataaagattaggggtaattttggcatgggatatttctctgtcttgatcgctcgcatcaggtccgatcgctactcccctaaaaaaagattattgctactcctggccggtggcggagcgactggcggcgctgccagcgttgatggaaaatcgcttcaatctgcttgcacacatcgggcgtccctcgacgcgaaggaagccaacgcggtgatcctgcaatcaaatcaacaagaaataacgacaaagaaaccatggttaatcctataaacgatagccgatcggctaagtgccgatgacatatcatttatctttgagaagacgtcatatgtgtatcgatcggcggtcataaatagataagaaagaactaaatctactcgatcggctgtagatattaacgatatatactcctcatatcgatatatatacttaaatcaagtgattgggatagatcggtcgtcatgccgagacagtataaatcacttagaccgaaatatatattaataataggactatatatgttcatagcatagccgatcagatagacctggcatatatcggctaatactccgatactgatctatactaagatattaaagcaagtagaatatatcaaacaaaggcctaacatacttaaatgcaacaagatcttaatataaagggcagatttaacatatcaacgaagcatatagagtaaatatagttaaatcagataagatcggctgaaaccccgatactacctgttggcgatatagcatgaggcccttcgaccaaacctgccgaaaccatgcgaccagtgggcccatgaacctcaattatattgtgtacccatgtaaatgtctctttcataagggcaactatgtaaattcccctgtataaccaaaaccctagtagtaagaacctataatggggctataaacatgtaatagggggatcccccaagaaaaattctcaagttaatacacttcttttccaactactgttgagtaaccacgtctttcgacgtatgcagttgtcgtttcgacaacactaccctaatcggcaaccagtaggcaggctagagattgatattctaagcacgacttaatagatcaaactcaactgatgcaacattaagtatgaaaagaagaacaatatctagacaatcaagccgctggaagtttcatagagtggtagatatcttatataatctaaatcaacgttgatgtctaacctaatcggctgctctctaccgacagatgttagccgattgtaggttagatagcgatattgccaaagattatgtgagatatatgataactcgacaaattacataaacaagattagagtgtcataaagatggaagcactaatcccaagaacgcaagccgtcataacaagttttacctcttgttgaagatcgaaacagatgcagctcaacccgaaagcaagaactcgtcaaaataaaactaaagcaaaagggtggcgatgcgccgaaattgtattgaacgtgtgtgttaattgattacatggggttcggggtctatttatacgcgagaattacaaactatgtccatatcggacacgacttcttatctctgacaaagtctaaaataccataagtctttacggcagacttttgcccaaacatatctctaagaaaattacataaaatatcctaattaatagatacaattgccttctcaggactctatccatgcgtggcaatcatcttgaagcatatcaactcaacccgatgtcgtacaccaagtcgtattgtcggaatcggccgtatcaccaaaccaagtctgtctcgaatttagccgatccaatcgtagctatcacgcccagaaatttagcccaaatttccagactattttgtgtattaaatccctgtccaggactagccagggtacacaaaacgacaagtaataaacagttccaaacgtaaataaagcgtaaaatacttacaggagaggcacttagtcctcacaccgaaacaaaagcagcggcagcggaaaagacgatcctagcggggcttcagcaccactccacaggcaaaactcaactgaggtctaagccttggtcctctaacttcgtcctcagctcagaagcactacacttctgaaaagggggaataatagcaaggctgagtacaaccaccgtactcaacaagccacaccaatgatgcaggcgtgcaaggggaatacaaggacggtttgaggctatttgcataaaggcggttgtaaaacattttattgagcaaaaccgtaaaactattgagtaattaaagtagcattaaatctccactgatcaacgctataccacgttgaacaggcccaaccaacccacctgaactacagtgcattgagtcgatttattaaggtgggactaatcacggtgaatctggtcgaccgctcataaccgcgggcacggctattcgaatagttttactctgatcagagatgtacaactgtacccacaagacacagccccacgacacgtttccgtgcgctgacatgccaccacgacataccggaaagaggccgtgacaggacccttcgcataaccccctctaaccaagcacaccacacctcaggtttcacccccaatcctcgcaaggcagcgggcagtcccctctcgtgcctaggtgaatccggaagccgcataggctgtcgcagggcccatccaaactccatcacgcccacccttgtctggatgcgtcagctagaggaaagctacactacaagcccagccgttgcccacgctggcttgtggtaagcacgataaattcttccagggtttccgcgaaccggtccttaatcgccatgggcacgactagcaaaaccatgcagccacagcctaccatgtagtcacattttagttggataattacgaccatgaagcatggccagatgtctcgagcacgcagctcattctgatactaaaaaggtctaatactgtaatcagctcatcaactgagctagtggtaattaagcatggctaagcatatagttctagctaggtcacataagtaagatgagctagtcgatttattacccaaggttgacaaaggacagatatcaagtaaatatggcacaagcaaacagataggtaatacccggatcccatgtaattagcaacacatgcaattttatttgcaaacgataaaacatttataaattaggatcaaaatgctcaaggggaatgtgtgacttgccttgcttcttcacttggatcttctgaactcttttcctcgcgaccgcgatcttccgaaacgacggattctacacgctggcaattctacacgctggcacgcaaaacgaagaaaaactctaataaaaaccaaggaaacagtacataaaaagtaaaaaaacatgtagatctcaattttagatgaattttgcaagttgaatggcccaatttggagttcgaatgaattagatatgaattttagaagttctgagccatttaaatgaatttctataattaataccaatttattgcgcaattattaaatatttttccaaaggaaatgataagtgctgacgtcagcaaaggggaagggtgccgacaggtgggccccacacgtcagcgggtcaaagggggtggctcatggtggactcggtccaccgcagcacaggcgcgcgggcacaccacgtggaagaccacgtggcggccacgacggcacggcggggcgaggtggcaaaggcatggcgccgaggtggcgccacgtgggacaccagcgcggggcggcgccagagccacgtggacgacccggatcgccccgaaggggatcgggcggccacagctagcgggaacggcaaaactcgccggccgaccggccggggagcgacggcgagcagcccagaggtcgccggcgacgaccaccggcgcgacggcacgcgcgagaggcagcggagggaggcagaggagggagatggggagctcaccaagcgcacaaggcacgaaggcggtgcgggagagcggccgacaacgaggaaaggcgacggcgtttcctcggggaggcacggctacggcggtccgatggcagtccgcgagcgaggagtggcggatgacaactggaagagcctgaggaggacgaaggggggattagaagagggagaggacgggcatggcgaagggcaatagtggccgaaggccgaccgtgagtagaggagctcaccttgcgcggggaagatggggttcgagcgacgattgatggaggcggagggatggccgggctgcgggcgacggccgcggtgccggggaggacaacagcgcagcacggtgtggaccggagaggcggcgcgacgcggccggaggcagcaaaagcggcgccggcctcgggcttgcggtggaggtggtgattcggcggtggatcgaaggagcggtgtggtggccaggcttgcccgcgcaacggcgaagctagcggtggcggcgacgcggcgcggcgacggctagagcggcgagaggcggcggctggaggcggtataggcggcggtggctcggcctcgcggtgggacggtgtttcgcgggtggaagagggaagggaaacggatgccggggtgaagcgtggggcggcgatgccgatggtggcgacgacgcagtgcggcgatggcgagaacggcggctagaggcggccggagctcgccggagagcggcgacggctcgattttgcgtggggagggcgggggagagtgcggggagtacgggaaaattggggaaatggacgagggtcacatgggaaatcgtggccgagaggggcggaatcgggcggcaaccggccggcgacgtggggtggtgtcacagcctgaattttcgttttaggatttataaattatctaataaattattaatagaatttttattaaatgttctttaatttacaagtgaagttaaatgtgggatataaaatttcctaaatataaagcatggatggatttaatttttattaaattctccatgattaattacactctctgaaattttctcggatttttcagagctcaattcctaaatgatacaaagaacagttcagtaattagttaatcaattaatgatctaattataattatgttaagtgcttttcttgtttaaaaatccttaatttataaattgttgtctaaaaggaattattagaaatgatcttaaaagcctagaagagaagatctattttttttaaaatttgttaaatctcaatataaaagtgggctagaaaaaaattcattaaatactttacttgattctatagttcctagatttttctgggatttatttgagccaaggaagtatttttaatcaatggaatatcatttcatgaataatttaaatagaaaaaggttttaaaatctttcttttggttttgggccgaaagtcagcccaagtctctctttctccctctcctcggactgcttgcatctggcccagccggcccagtccgccgcgcccctccctcctctctctcagccgctgacaggcgggacccacctgtcggggtcgtcgccctcctctcgtcgcccggccgcgcccgagccgccaccgctgcccttccaaattccgttgcccctctctatttccggtcaaattgattgagggcaaatgatccttgagatctcctcttccttttctcttttggaaacattggctaattttctttggaaaccagtggatttgagttggattcggattcatctctctcctctaaccctagagtttccttctcgccgccggtcaccgtgggcctccgtcgccgcctcctagccactataaaagcatccccgggacctcctctatccgccgccacctttgccttagcccgccatcgcgtctagcgccgcctccgcgtagccctagccgtcgccgtcgttgccgtcggtccagccgtgcgccgccgtcgctccagtcgtcgccgtcgctcggggaggtcgccatcgtggtcgccgttgcgtcgccgtccccatccaccgcttcgccgccgctgtagcacgccggagcaccgccgtcaccgtcgacccgaagaccgccgccgcttcaacctcgtcgccgtcgtcatccgtcgtcgtttgtcgtcgtccaagagctcggtgagttcgccgcgtcgctctctacccgttggtgtcctccttttgcgtcgtcgcgccgtcgttcgccggcgagcatgtgttgccgagccgccgccggtgatgacgtcatcgtcgctgtccccgtagacccgctgtggaccattttgaactcggccgcccgttttggatagaatcgatctcggccgttcgtttccttagactgtcccgtgcacccggtttaccgtggaccgccttggatgacgcaataatcctccttttccttttcaaaaataattcattattgcgtcataattcaattaaaatccatataaatgctttaatccggtttaatctttaaaaattcatatctaattcattgtaactcggtttaatgtggttcaagttgcaaaagttgtgtaaaataaagatctacatattaaaattatccataaattgaattaaatttatttaattctttttaaatgggctttaattagatttaatctagtaaaattcataataaattcatatgaagtcagaatgaggccgttcaagtctcataattcatctaaaattatgatctacatgtttgtttactttttatgtactgtttatttggtttttactagtctttttcttcgttttgcgtgttagcttgtcgtttccgtcgttttgaaggttcgcgagtgcgccggaagtattatttaatgatggcttaataatagttcacgatggtcaatcgtgattggttaattaattacttgccaactaaaacttgataatggtgggttgtgagcacatggttttgagagtcgtgctcatgacaattaaggaccgcttcgcgagctactattgtgaaacattaaccgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccaggaacggtgcactgctttgagttgtgttgtgcgaggggtactgtcacagctcctttccgaggtaccgtggtggtattgaggcgcatggtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggggaagacgtttggtttataccccagttgagctgcttgtgggagtggagccggagcttcgctagaccgttattccgctgcagttttcttttcttttgtaagtatgtaacgttattattgatgattctgtatattaaattgtcagtttgtgtacctcggttgattcctggacgagggttttatgcacaaattagttcggaaattactagtgaatttctgggcgtgacaggtggcgacgtggagcttgagagaggtcaaaccggcgtgatttttggggaaaagtgggggaaaatgaggaggagtgggtggcgaccacgtccgcacggtcggacgtgcgcgcgggaggcggcggttttagcggcggggtggggcggcaatggcggcagttgccagtccatggcgatggggtggctggaggtaggggaaggggatgacatgtggggtcgcaggtcccacctgtcaaccaatggaagagagaggggaagccgggtgggggttttctagactttgggggggagaggggagccgagctgggccgagcggcccaaagaggagaggggagggaggcgggccagaggggaagggggaaggaatttgggccgagcccgaaagggaggaaggggaagattattttcttttctttttatttaaattgattaaatgaactttgtattattataattatttcttgagctttgaaaattcgcagaaaaatcctgagagtattttagggcacaaagaatattacaaaatattctcggccaatgatttttaaaggaaaatttcaaattctcccattatttcacttgattgaattgacttaacttttatttaatttctagaaaatgcattatttaatgatttttaatcctgaatgaaaatcgggtcgttacagtagccgatccgaactccagccgattcttactctgttctcgcgataatctttatctctgattccgccttcctttccaatgccgatgttaccaaatttggttgttaacaccgcggccggcgtgccagtgcctcgcagcgtgcgcgcaactgtacatgtccgtcatctcctagctccaggagaaagatgtacctataaattacaatagtacccctacgcaaattattatccctggacgaatatacccctccatatttctactaccactaactttggtggaagtagaactaaatcgcaaccctacaattaaatatgatcaacgtctcagattactttctactctaagtagaaagcaccggagcaggactctattttctgatcatgtgccaattctggtagatacagtacatatgtttgtccctcagatatacataggtttatttgagcaaactttattttaacttaggttaggttagtttttttaagtgtcctaatttacgctctttccattttaattagcacatattcattttaaaatagattcacttttatcctcttatctacccttcgttaataaatccatgagttttatttccccaataccccttatctacttattcactaacactgttttcttgttaattagaaatactttggtcttttccctattaatttgaacttaattggcaagaaatgaagttagtttcacgtacggaggtggtaaaactttaaaaggagtggggtcctggataatggcatggatgaatcgggatagtttagactgtttttcctcacccaaataactataacttgaccaatatagcatccgtaggaaatacgtagtccatcttgacgatctagctagatacgtaccatgtcgcataaattgtcacttggggtactattttttgtcttgaaaaaatgaaagaaaagacggtacatacaggactttttcatcagtttgcaaacttttcatctcaggcttgtaatcattaacgcctggcacacgtggcgtagagtggccgacgcgttaacagccaacgaaagagtcatcagtcacggaccgcatccacgactgttttcacatgtacgttttgctagctacaacaacaatttcaccgtctcctagctcagatacgcctgctacaacaacagagttgaaagcatttgcctcatactcctccgtggtgttggaaacgcccatgagtcaattgggagcccaagggacaggaaactccgagtcaaccaaggcggctgttggtgaggtggtgtactccgacgaggtttcgacacagctagtgaagttggcaacgactaaggtactttctactgaggttgctgtgcagctagcaggaacagatgaggtggttacgaatggcaaagagcaacaacaagaacctgtcagcattgcacaagaattacagcatgtttcagctagcttgttgtctcccgtggagcatgtattggattgcaacgtgcagtctgaattgttccccgagaatagccggcttgcaggcgatggaagagtagcatcgactaagaacttgatggcagtactagcaaccaatgaagaccaacttagtgcctccagggctgccacatctaaagcccaggattcagcacaggcagttggagctcgatccccgacaagaaggcgacctcgtcgcccagtggaccctattccaactaggcaaagtgaaagatagaaggcgatagcaaatgcagatgcgccggtggcaaaccgggcagagctgctaaaaaaggttcataaccttgagacgctaacaggtaacaagtttaataccacaaattctgttgtttcaattccagataagactcttgctacaaatttttctaaattaggggtttctctaggaaagaatgatttacaaataaaggaatccattaaccagattaaaatttcagaagtggatagatttgctactctttatagtagtgctgtagcgtctactagtaatgtagataaaaacaacgatgaattgttaaaattgtcttctctccagcacttatgtagtgactggctagaagaggctgagagtaatgacgatgagtctatggattctcaggccatacctcgaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatgtgttaaggagcaaaatttggattttattgccattcttgagactagaaaaccatgattcaccccttcaaatcttaaaaacctttgtggtggaaaagattttctttggcatgagaaacctcctatcgggcgatcaggaggaatacttttaggagtaaatttaaatgtttttgatataggtgaaatttcagaaggggacttctatgtgaagtttcttctaagaaataaagaggatggtttcaaatgggtttttaatggcagtagcaccaataggattacaacggttgctcacaaagtcattcgcccgacccaaacggcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcatgatgcaattggatttctaactgagttgaaggaggaactgtaagtgtcaaagtcaatgataatgtatgaaaaaatttccggacatgcaaaggcttgagacaaggggatccaatgtccccaattctttttaacatagtggctgacatgttagccattcttattgaaagagccaaagccgatggccaaattagaggggtaattccatacttagtggatgatggtttgtccattctccaatatgccgacgatacaataatatttcttgaacatgattttgaacaagcaaaaaacatgaaggccattgtttgtgtgtttgaacatctctcggggctgaaaataaacttttataaaagtgaatttttctgctttgggggagccaaggaaatggaggaccaatatagacaactgtttggttgtaattctggttcctttccattcaaatacttaggaatccccatacactatcgaaaactcagaaattctgattggaaatgtgtggaggataggtttcaaagaaaacttagcacatggaaaggcaaaaacagctcctatggtgggagattggttcttcttaacttggttctttcgagtcttcccatgttcatgttatccttttttgaaatacctcgaggtgtacttcaaagactgaattactatcgatcgagctttttctggagcagtgatagccagaaaaagaaatataggttaagaaaatgggattatatatgccggccaaaagatcaagatggactgagtgtcctaaatcttgatatcatgaatagatgtttgttgagcaaatggctattcaagcttcttaatggtgatggtctatggcaaaaccttttgcgcaacaagtacttaaagggtaaacccctctcccacatgtcatccacagagagagagccatctctctggactgcactcttatagtcgacagctctatgtggcttgtcaaccaccggaccgtagctcctcacaccaagaaacccagtcttcccccagaagactgtcttcctcgactatacattctcctaccccaaacactctaacccagacagcattcgttaaacggtagcttccgcgcccttcctgcctgctgaaattgatgtgaatgatcgtgtcttcgacatcaatttcagtctgattagatatgtcattgaaacaaatccgttttgtctctgttttcttttcggatgagccagaaccaggaacatcccaattttgggctggcctaataaaagtaaaagatcaattttttcagtatggatcttttaaacctggtaatgggatggaaataagattttgggaagacatggttgggcttgcaacctctcaaatatcaatatccttctctgtacaatgtggtccgaaaaagacattctactttggcagaggttatgagcacaacaccgttgaatgtttcattccgacgatcaattgtaggaccaaagttagttgagtggaatgatttgatctctcgactagctaacataaccctgtcaaatgaaaaggattgctttatttggtcgctacataaaaatggccatttttcggtcaaatccatgtataatgcgatcatcaattccaatgtaagaatccacaagaggatcttatgggaggtaaaggtaccactaaaaatcaaagtatttatgtggtttcttcacaaaaaaaaaagtaatcttgacgaaagataatctcataaagagaaattggagaggaaacaagcaatgttgtttttgtaatatacaagagaccatccaacatcttttctttgactgtcatgttgcacgttttgcttggcaatgtgtcttctttgccttcaacatcccccctccccacaatgcaaaagatatttttggtgactggctaaggggagtgcctagacgcacaaaaaaaataattttgtttggagctagtgatttatgttggtcaatttggcgttgtcgtaatgatatagtttttaaccataaaaaatgcctaacatcatgcaggttatcttcatgtattccaattggctccactcttggtgtatgatgctttcacaggaacaacaggatactatgcgcaatggtgctacacgcttggaattagtagccaaggaacttttattccagtttggatggcgtagtacctacagaatttcgtgatagaatctacgtgattttgaaaaaaaaaattattttagtagatcatatcatcggcagaagttgggggtttgtcccagctcgccttttttaacttttctgttcacgtctgaattttttggctgtgtgcctacgagcagaggctggagatgtaacccatttccattatctaaaaaaacgtttttcgagctacaaatcgttgtgtttttaaaaggaaattctaccttagagattgttgttatggagaattaattactccattttttttaatttaaaataattaatacttaattaatcgtacgctaatgactcttctcattctgcatatcttcatagttctctcacttttcattcactccgatggtcacacatctcatcctgacaagtatcaattacagcaattgagcaacgaaataagtgttaaattgtcttttttttccgtcaaacacacaccctaagttgtcgtgttccaaacataaggggcttgtcttactttctaggatcatcatcgtcacaattcgatggacttgactgatgctagagctaccgagtcattggtgactgctgaaatgagatgtttaaattaaggttgaatttaatgtagtaaggcccggcggctatgggcatcagtacaagcaaacgataaagaccttgtacatgtctaattatttaaaaaataaagccaaatcaaagctctactctataatactcctccgtgacaatgtctagaaatatagctacctaacactacgtatctggatagggttatgtttagattcgtagtgttaactagctactccctcgatctattttaggatttttaatttttagtaaatattaaggttaattcctctttagtaaaaagatttctttctaactaattgattggcttttaaatcattgaaatgatgaaaataattgaaatattagttcaagaacctataaagcatttatatttttgaacagatgacgggggattatcagtcaaagaaaaaccaaagagactgcaactagtgcaatgcaaacacttggagacgatggaaaatggcggttacattctgtcgtcagtcgacctatacaaggttgcagttattaattaaataccaaggtttccggtcaatccttccagatcatctactcactctactacgtcagatacgtctccatcaatctgtgattctaatgtaaaatagtactcacttatactatttttggtcaaataatccctctaggcggctgctaacaggttccaaatatgtccaaattagcctttcgtcatttattctttgaatgcgatgtaactaaattcacacagatctgttcacattggacatcacttcgcctatagaatatcacacatgtattgggtcatggtttgatggtattaaaagaactatttcgactattttaacaggtactagtgctagtcaagatgccaccttgtaaaccatgtcaatttaaatgttatacatttataatagggtggatagtcaaactagtcctccaaatttcacctacatctcagtttgatccttaacttttcaattctaccttccatattagtccttaaaatttttattttagttcagactcatccttagagctatttaggaagccacatgactaaatctaatcaacatcataaataaccctaatacctctctcacacatatataagaaaagaaaaaaagtatatatagaaactatatggcaggcatcacccttttatttttactggcggaataacaaaacaaatgcttggaaaatttattggaggattctaagtcacgagacgacagcaaaaaccaacttcccatgacgtgcacttaggaggtccgccataaaaaataactctatttttttaggtggacctcttaagtgtccgccaccaaaaaagggtagataaagagcaccgttgtgaaaaagattcatggttttaaaagttgcacatccactgcccaacacccaccaaaccctccctctcctctccgccctatctccgctccctcgcctctcctccttcctctcccttaccctcctttcttcagcttctcctcggtgctctcggagatggtgatggcagccgtggtgatgacgacgacaatgatggaaacgagaggtttgttcacggcggatccgacagtggggcgggacgtgggcaatggatgtggcagtgaggaggcatccaggcggtggatccggcggtgggaggtgcgcaggcggcggatccgggagcaggaaggcacgcggctatggatccggcggtgggaggcatgcgggcatccgatccagcagtagggaggtacttgggtggcggatccagcggcggagaggctcgtgggtgggccggtggagcatggctgcgcgtgtgggcgggcaatgaagctcagacggcggcggatccagtggcagggaggctcgcggtggcgagcgggctggtagagctcgggcacgactatgtctacggacgaggcttgcgtgtgcgggtcctgcggcatgtcggccacagcaaggacaactaatcagcgacatcgacatcgcccctccgcaccggcaagaggagctcgacgccggcgtcaaagagtgcgttgaggtggtcgatttttttatcttagtgtgatacattttatggtttgttatttgtgatttcttgaatttgtggttgtgggattggaggatgtgatgtttaatttgtggatttgttattgtgggattagatgcaaattcatagaatctgtgattgtgggatgtggtgttcgatttggatttatgattgtgggactagagacaaactgatctggactgtgaatctggtttggttggttctaaaaatatatatatattttaccaaaaaaatattttttctggtggtcggttctgaaaatgaaaaacaaaattgccaaaaatatttttgctagtcgtccgtataacctagccaccagtgaaactgattttggtaagcgggtgaggtctccctgcgatgatcatcatctattgtcactgacccatgatcgcaagcagctaggtggtcccctggtgaaaatgtgtagttatatactacctccgttttttaatagatgacgccgttgactttttctcacatgtttgaccattcgtcttatttaaaaaatttacgtaattataatttattttgttatgagttgttttatcactcatagtactttaagtgtggtttatgatatatacatttgc

SEQ ID NO: 74551 - DNA, 1685 bp, Oryza sativa
  unsure (1)..(1685): unsure at all n locations
tgttttaatataacacggtaatccatataacacattaatccatttttcatctctctcctgaatatgatgccatcatatataggtggtaaaatataagcaattttgcaaggtaattaacttgcaacaagtgatagatgatatggacttgaattcaatagtcagatatactaccctttctcacaattctttggcctagtatcacagtaaatacagttcgctgcaaagtgacacttctctatgcgctctgggtaatgttcttggtggcattttcgaagcgtcatttggtataatttgattttggaggataatgattgtgtataaataaatatagaacaaacgttaaagttagaaattagatcttgttaagcagttaattagtccttaattattaatatcattgcgaacttgtatacttctctatgtctcaatatatagctacttttggctatacatacacataactaaaaatagctattttctaggatagagggtgtcggtgacatgggaccgggggtatcttggctagaggtttggggcagccgcggtcacccacgtggcctgaccccctcgggggggggggggggtcgggcccgagggtgatgtgnccgcccctccctctgtctccccgaggggtcgggccgctcccgtttcggcnccgagggctggggcgcnccgaccccctgtgggtttggctccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagccggagccggcgtgctgactcctggagttagcacgtcagtcccggctagattcataccaggtttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcagagggtcattcggacaacagccatggcaaatctccgcccattaatgagggagtaacagggagatccccggtgttaggcgagtgatgacgctgggcctcactcaaagacaagctgtgatttagcttccaggcgaaggcgcaagccagttttttcttttttgggaagatagggtgagtccccacccaaaagaagagtaggtagaagtggtgcatgtgggatccccttgagatataaaaggaggaccttgcccactttgaagaagaggggagctcggagaggagagaaaaagaggaagagggtctctagagtttgaactctcttgctctccagctctttgtaactccttcacacacagatccaccagaacacaggagtagggtattacgcttctcagcggcccgaacctgtttacgtcgcccgtgtcttgtgcgcttcttctcgctgacaatcctcagatcgggggcttagaaactcccctagcgcccccggccgaaccgg

SEQ ID NO: 74552 - DNA, 1979 bp, Oryza sativa
ctgaaagagtaaattacacctacggtgcatcaacttagcagatgggtgtaatttggtgcaagaatttgagaaatgagcgttttaacgtaacaacttggcagataggtgtaatttagtaccagaactttataagtgatcacataaatgcaacaacttgcaagatatgtacgatttcgatacaataagttaacaagttatgcggcaacttaattatttggagcacttttttatacatatttaatttttaagtacttattttgacaatatactagcgtggatttgtatattttaagtacctagcatatgcttagctaagtttatgtatcaaatactaaattgtcaagttcttatactaaaacgcacctacttatcaagttgttgcactcgaacgttcaattctcgagttattgcactgtatcgcacccacccccgccaaattgttgtaccatgtgaaacaaggaaacatctttgggattgagctattcccattatcggaacgaaaccattgtgattgaggttgcgccaggccatatatagcttagctctaaatatttgcaccagccagagacatgtttacatttgtttaagccagcatattacaatactcaagcacatttaatttgtcaaagaaaggaagtacatctatatggtactgatatcaaccatcaaatattctatcagataaatccaatagcaggaaagctcgttgcaacaacagaacagctcttacgctcgttagagagagaatagcttttacatctaccgattctcctagggagctcagcgaccccattagtgtcttgatagatttagacataggtacattgcaattactgcgtcatgtacaaatttcacaacccctgtatgaaaatttcatggcatagtgttgtggccaagattcgtgggctagaagaacataacactgattacaatgttccaacaacctgtgaccctaaatatcgacatgtccagagtcaatacattgttgataagctaatctaaaactgaaaaattgatgctgatgcagccacctgagattatttagtttttattaactagagaggttgccccctcccgtttctattaaagaaacatatatttttacagcagaacacctgagattatttagttggaagtggaaagtgatgtggcaacttcctagtgcatgcagtgcagagatggtttttttctgtacaatttcatttgcgtcaaaatttttgtttgaaatcagttttgtttagttgctaggagatggtatattggtagatatctccacaatatggatggagacaactgaaaatcagttcttgaaatttgatccccttttgtttggtgtccaagactcatgataatctaatacgtacctgcttggacgagctgtcctacatgcacattgctagtcattgagtaggcatagaaaagtgattttataaaatgaaaatgctttcatatgtgtatggatttagctctttgccaccataccatttcatcaacctatttcgatctaaactggaaactatccgtatcagcatttgtatatttaccagatttctacaggccccaccatatcctcatttcgaacagattgggagtggagcggataggacacaatatctgatctatttaaacctatatgaaaaattgtctggtttgaaccaaagacatactatgaagtactcctaggcgaaaatctatagtatgtgatactgttacatactgcatggacggaagtacaacttttgatctctagagaacttgaggtacttccctcgttcctctaaatacatagaaacaatatatacaatttttataacatttagtttgatttagctaggaaacgtatacggtataccatcctaaatgttcaagtcttaattcaacttgaatgcaatgtcaaaacattggagagacaaatccgagatataagcaatacaagtattattcacatccaaattgattatgaaatagaaatttgatga

SEQ ID NO: 74553 - DNA, 1371 bp, Oryza sativa
  unsure (1)..(1371): unsure at all n locations
cgtagaactcattgagatccatgaacgggctaggcccacccgccggtgaaacgagttcgttctcccccccccccacgatgaagggcataagctccgccctcaaaatctaaagggacaaaccgggggagggcggtgagggtgtttttagagtttgaactgtcgggggcgcgtttccctttcctnnnnnnnnnnnnnnnnnnnnntgcgcctaaaaagatcaatcttcgcaggcgacgcttatatggcccgcctgcaaagatgcccctatatagtcttcttcctccccgagccctgttcattctccccgacgtttctctctcctaaagtgacttaaatatagggggggaggttttgaacttcaaatcttcgggggatttttctacggtacttagatctactcatttccacactaggtatgcatttttaagcttttagaccttaatttgtgatggatttatgcatccaaaattttgaaggaagagctccatgttttttaattttatttcttgtcatatgtttatgttagatgtatgcgtaatacttgatgcctttttgtgtagtggtttaatgtggtaacataaattctcgttttttaattttttgctatcatatccaccacctagttctagatctagatctagatcttgtcatgtatagagagagaaaaaaattttaaatgtctattcttcggtggaatcacaaaaatagtaagagtattttgtaaaacccccatgaatttgattgtgtaagattttcctaatgtactaatttggcatgtctgtgtaaaaaaattgaaataaactatgattttttattactttacacttaacttttagttaattagtttttaatagcgataagtttttcaataaaccctacaaatttggtattaattgtgcaaatattttatgtgtattttttagagatatagaaagtcgggaatggatgtatcattggccgaggtttttatctccatatagaaacgaagtggctaaatttattggtattgccaaggttcacgctgagaagaacaatatgaggaagataatttgtccgtgtgctgactgtaagaatgaaatagcctgggactttgacgatgcttttaaagtgaaggagcacttagtaactcgcggatttatggacaagtacgaaatatggacacgtcatggcgaagaacatgtggacgagcctgaaaatgtagttccgaaacaagttgaagacatggtgcatgacgatggttctgttgaggacaaaatcgacctagaggaaatgttacgtcatgcagaacccgaggtgctgatggggtcggcaagagggctaaataactttgaagcttaacaaaaggcagcaaaggaagttttgtacgatgag

SEQ ID NO: 74554 - DNA, 20361 bp, Oryza sativa
tatataaaaaatatagtaataatatatgtcatacaaatatagatatttatcaagagaaaccacgttggctttaatatatttaactgatttctatataaacttgagcatatttatttacattttttcaaaccatcttattttaaataatatttgtagtatcgtagagatcgtagaatcaggataccacctaagatttcgtaggatggtgtagtaataaatagtaggatcgagctactatgaaaattttgatactagataggatcggtatcattttggtttagtaggatcgtagtatcgtaagatactatgatacgaatcattgtgtggaagtactatcttttgcatgcaggtctcctagctatccatcggcgaaaataaaaatattttataggcaggccacgatttttgcattcgggtcttgtctccctcgggaccgatagtattggatatgttactgtccgtctgtgaaaaccatttctatagcagtgattgcctgttggcgtaaacctctagggatgtacggagtacatagcaaaagggaaaaacaaacaatgaataagaataataattatatgtaacatgaataagaatagtgattatatataagaatataaaatactatttggatatcccattccaacgccattgccctctgttctaaaatataagtattttttgttgacatcgatacagtcttcaagatactactttgaccaacaatatctataagaataaaatattttaaataaaaatagttgcatattataatattttgattaatgataaatcgagtaacatcaattttacatgatatatatatttttatttttttactattaatagttaaagttaaaaattgttaacttaccattatgctaaaaatgcttatattttgggacggattgagtagttaataggagtaattaaattgagaaattatgatggaggacgaatatgggctgtcataggccttctttctgcgcgctaaggcccacacggcccacctagaatcggaaaataagaaggcaggccaaggcctccaccctccatcggatcggaaaggaaaccctaagcgaagcggaggagagaaagcaatggcatccctgagcaagcgcggcggcggcggcggcgagggggagggcatcctggcctccttctcccggtcttcggtggcggcgcatgggcgcgaggcggcgaccatggcgaagaagctgctgcggagcacggggaaggcggcctggatcgcggggaccaccttcctcgtcctcgtcgtcccgctcatcatcgagatggaccgcgagcagcagctcaacgacctcgagctccagcagcaggcgctcctcggcgggccgccaccgcccgcgcctctcaaatgatccatccgtccatccttagcttctactgctgcctacctatgtcgtcgtcgtcgtcgtcttagtctttttcttcttttcttcttctcttagtgtacactgctgctactagtgtttttgcctgtctagtcggacaaatcaaaactttcttgttttcatcatcgatctatgctatgctgctctgatgagatgtcgctttttctttcctgctgctactttattttcacgctcatcttatcatgccgaataaatcgatcggttactatatttcattctgtgcgattcctgtgccgtttattctttctcgtcatatgctgttgtgatgagatttcaatttgcatcaccagggttactctttttcttttatggattgacatctccatgttcatgaacaacagttagtataataattaaggtttttttaaaaaagaaaaaacattatagtctgtaataaaaaagagaacattgtactccagtttctaatgttggatcacaaatgggaacttaagaggatgatttcttattcataagagtaagactcgagcaatgcatatgttggtttgttacgcccccaaaactttgggaaacagtcatgtgtgtgaaggtaaccaaacattttgatacaaacagcactactttattgcattttgatacaatcaacactggagtactttttattgggtactcctacttcctccaaataagtgtactagggtttatatgaagtaaaaccataataattcgtccataataattgtattccttctgtcacatcagaagaatgggagagcaactgagcagagcactagcagagcaagtaagctattctctcaactctcatccttattcatcctttttttttctgaagtaaagcagtttctaacttgtatatggccataaattagagatttggtgtttgttgttattggatgcacaactatttactataatattttttagaactatacatggcgctatactcaaaacaaagttgggaacccctctcattttactctagctctgcccctggctcctgtggtgcaccgccgttgcagtcaacatgtttcgggggctcatggccgaggccttctgagtgcttcgcaagctcaagctgcccggctcatggccgaggccttctgagtgcttcgcaagctcaagctgcccgtctctgggtatgggatgaatattacgttggtcgaggtaggaccggtggtgactggtgagggaggttgtgccgtggcagcggcaatgctggggctgactgaggtaagtttctgtttgtccctatctccaacttggtgttgaaaaagaaaaggatttggatggtgagatttggacgattgattcagtgatttaccttgctccctgttgtttgtataaagtttgtaatctgcgaatctgaatcattagacagcaagatactaagttgtataccattaaatagtgttgaaacagaagcacttccctcataagtcttaacaataaccatatttctccattgtttgctctgctaacagtattaattaagattgtaaaactgtatttattttatgtgccttagttctaatcttatggagggggaaaaccataatgtttacattttaagtttggcaggaaagttggccgaaattgcagcctacagattttatttctagattctatagtcattgttctcaacttgataagagcaaaccctgctctatttgatagctttctttggaaatgcttctttctaacatagaattgttcagctgacatcagtgttaaatgggaataggatatgcacaaaagcagaggttgaatccatacactcaaacgatgtagatttatacagaaatgttttttctctcaagctttgcaggtcggtttttgccatttgttactaattattctgatgcataactgcatttgattctcatttttataacaaatgctgccctgctttcttcaagtacagaggccaggatcatttttgtcggccatgattgtggatataatttctagaaagctgccaatggcatcaatgctcttcacaagctatgttttcttaatcctgctaattttctctcaaatggacattctaacaagaatctccctgtttggagcctggttttgtatatctgctagcttcacaattgtatacatatatgctggagtgcgttcagttctctctcacatacttcactgttacttgcacatagtagtattttttgtgccactgttctgacaatgatcatttattggtttcactatacttacatgactgctgcccatctcttcagacttcactccctgaggagattcaccataacaatacagtgagtttccatatatttttggcattgattttgttacttaattatgggtttaggattgattggacaacctaccttgcattgcttaattgaagtgttactacattgttggttacatgattacttgtatgccattgtagctttgatttggggcctaggaccctatttcaccctctgtgccacggtgcaatttctgatatttaattgtgtttgcacttgtttaccagaatggcatcttaagtgcaggtttcgtcttgttgaagaattcctataagctttgtcattaggattacagcttggctaagctattgtgctattgaccatatcaaggaacatgtttcttacctctcccacggattagctgcagttgtaccgtgttgatgatgtgagattgggtagcctcttccctgtcagtcgaaggcctctcccgtgccttgtcgggttggtcctctggattaccaacctgcggtaatgtgtcgatgtcgttgcccagccaaggcggtgagggtggatcttgtagagcatcgacaaccctgcgcggtggtattataagtgtcaaaacggtcgagtaaatgatggattttggctgattttgagatgaagttgcatatacgcagtcggtgttcttcggggttgaatgtagggtttcttgttgctttggggggggggggggtgatttctaggttcgggtgacttgcgagacgctgtgacttcgttgaggagggaaaacgaagtgctgtggaaggaggttcaacagagtagggcatagggggaagaacagaggaaagcggtagatgatgtaaggagtgtggttgctctgaacaaagaagaaattagaagtttgaaggccaggaaccaaaagctagataatgagagaaatgtgcttgtaatttgtgttttgtcatgtctgtttgtggtgtttgtgttgttgtttgggaagaactgagattatttgatgtgtggtctataatttgtgaacaagatcgtgtgtttggtatgcattggaaacaacatgtttttcatgaactatatgtatcctgagttgtggtaaccatttggaatgaatgttgtgaatgaatggtttatatgtgcaatttgtgcagcaaacctaaataatacaccaaatgttcaatttttgaacatgacaatggcatatgtttcagctagttgcaaacaaggcacttttggtatttgcaaacaagcagaaagattggatgatattgcataatggaactgaaatatttttctccatcattcatacaaaagcaactgaaattgtctgacattacatctcagataggtggcatagttagccaaattgtctggcatcacaacaaacatagcagaagttctaggctaataggtctgacattacatcacacatagttggaatattaacccaaatagtctggcctcactacgaagaaagctgaaatactgggctaatttgcttgccattacatcataaaacaagtacttccattactctaacagtagtaaacgtgccatattcagagcttgttagtttcccatgggggcagaagaagaagtgccccaccagatttcttctttttcttggtttgtgtaggttcttgagttgagacacaaacagatgctttgccaaatgtgagtctcacatatgaagttgtagagctctaggaatggggaactatggcttgcatatcaactctagctgaaccaccatgttctatagaaactttagccttggcatttaaccctgaccagctcctgggtctccattggtgcctgcagtcaaatatatttgcatatgttgaacttgtagtgattacaagtaaactttgcaagggagaaagatttgcacataccttgttcttggtttttttttgggccatggattgttgggttgtacttgttgtacacagggtgactgtcttcgtcttcgtgctttgagcagaactccctgctgtgcttgacaacaccatttgctgaccttgagatagagctgggacttgggccgtgccgggctagcacggcccggcccgacccatcgtgcttcgtgctagaatgggccgtgctggcccagcacggcctgctaatcgtgccgggccatgctaggccgaggtggagaagacaaggcccaagcacggcccaaagacatgtcgggcctcttcgagccgtgccggcccaagcacggcccagaattacctgaggagtcgtgtcgtgcctagggttttcgccggggcccgcgcggccgcgccgacccgccgccgccgccgcgtgctccctgcggcgctgcccgtgccagccgccgacgccgagagccgccgcaaaggaccgacgtcgtgcggccgcacatagccgctgtcgtcgcgccgcgcggcccgcgccgagggcttcctacgccgagagccgccgccgccgccgaggaccgacatcgcgcagccgcgcatagccgctgtcgccacgccgtgcggcccgcaccgagggctgccgacgctgagagccgctgccgccgaggaccgactcccgacgccccgggtgcctagggtttttgcctctgaccatgtgctttgcccgatgctgattgataaatgaaataataacaggggaaaaatcagggtaaatgagagaggaaactgaaataagggagggaaaaaataagagaggggaaatgaaaaaacaatgagataataatgtacatggcttaatgaacacaattagaattgacataatatcgtaaataacttgagacaataaaattgggggaaaatatatatgttaataatttgaatatatagttgttgcctcgttaaaaaccttacgccctaaagtagggttccccgtaaggaaaaaagagtacaacaactattttacattataccatcaattactccagatcaacaccaccatcatctttggtaaggcaaatttccgccaatgcgtcttccattgcatcggcaaactcttgatcatgtagacagtgttgcgttagttcgtctgcttccatccagtctttaagacaaaatattgacttaaccgtctcgggtgtcaggcatgaccattgttcttcaataattcttccagtaacgttgaatgcttgctcggaagagacggaggagctggaaccagaagaatatctcgagcaaagtgagctaacacaggaagagttcgctctttctctttccaccacccaaggagatcgacatcgtggccatcaagcgtcggatcatgctcagtatgattggtggcgaggtagtggttaagctctgaatccgggttccatgttgatttgttctctgaggatggagaggcttggtcgttgcctatatactgcatccacaaatttactgcacttgacttgcttgctttcttttgtgaggtctgctcaggaactcggggagtaccaccaagcttggttcggtatagacggaaaaccctatagagctcatcattgacatgttgaaaagcttcagaataatcaagccccactgcatcacctattgagttcatggcaaccttggcggtttccaacttttgcgaggatcaagtatcaaagcaaagcaataaaggtgaggtatagcggtgaagtatttgagaaatttttcttccatgggtttaacaatggaagacaatacgatcagaacggttttcatcaaaaacaagtgccagcttccaaatccactcaagcaccaaacaagatgtaggatagtaaattcctgataattgagctatagcattataaaagggcttcagaaatttatgcacacgtgtagcgatctcccactcatgattggtgagaatcacaatctcaccatcgccgttgtcatcggtatccttcattcatatttttgaaacagtagacggtaggagatctaccggatatattagaagaagagagttgaccctgtttataaggaaaaccgggccttacaactgcatggtttgctaaggggaaactggcaaacccttacacagaagacacaaaaaagcctgtaacaaaactacgaaccactaaagagaccgagggaagagcatgacctttaaggcgaagcctccaaggaggtgaacaacgaccaaagccattgttgacgcccgcccaaaagttggactgggttttcacccaaaggtgggagagagtccacaaggaaacacctccaaggagggaatggcacccgtaggagtcgatgttgctgatcctgaaagaccaggcaaggcttacacccaacactctcacaaaaggtgcaggacctccaagaagccaaagtaagagtgttgagtgttatcgttgcccagctcatcagctgacccgatgcagcagctccgactccgccttaacacaagaactctcgcaccctagaggtaagcactccggtccaaactcggaaatacagcaggttcacacggtcacagggcacaagaagcaccggcgaggcccaaaagccctgattacagtcagactggaccaaccccacggacaaacaaactcctcaaccactgagagactccacggccggatctggaagcagactaccaaaagaagggaggagcaacaaggaggaaaggaggcaggcaggcctggggaagaactgagagctggaagcagggcaaatgggcatcggtgtcaaccatgtaaccggtgaggagctccaggcttcgcgggatgaacctttcgactgcagcaaccacctccaacttcaccaccagcacagagagaggggcactggggtgatcagcaaggctcctagacaactaagaggaggggggcggcctccccaatagcttgtgccaagaggcggcaaatagagaagagagaaagaaggaggaaggaaagggagacgcatgcctcccccaactgctagtgccgagagacagcagcgagaggaagagagataggagggaaggaaggagagaagagggtggtttcaggggaatgggggtggccggagacgctagcacaccccccagtatgacccgatgtgccgcgaccgcaagagccagctgccgccgcagccccacaagagacggcctctgccgcccacatgccggccaccacccacatgcaagcaacaccgccgccgcacaagccctcacgctgcaatagccacgccgcctcaccccgacgcgccgccgaccaccggagctggcagccgctgcaacggcaccgcgagcgccggcaactgaccacacgcgtgaacaccgccgcctcaccacccatcgtgctgccccgtgagccgccacgggccgcagcggccaccgctgcatcgcgccaccccacgatgctgccaccagagctttcccagatccgatgacagcggtgccggatctgccgctgcctaaccgggaggcctccctgactgcactccttgacaccagcgaacgccaactcccccacgtagagagggggcgccgccgcggaagaggccctgccgccgccatcctagcttgccagtcggctttgccggcggtgagctccggcggtggtgaggtagagggagggggagaggggagcggcggtggcggcggtagggtttgccccccgtgtcgcctgcgcgtgggcgatgcgggggggggggagggggagggggacagactctcggataattgtctagttgtatccttcattctgacatgcatctaattgatgaaaacagaaattaactcctcctacccttttaactgtcgcagcaataggtatgttttgttccacctatgtttgacatcaatgccaaacatccgtccaggtttcttcttcgctttacagtagtcctggaacctcgctttgaccactgtgttacctcctatgatacgaacagaatgacgaattttgtttaacaatttatccggaacaattatgcctgcaaaacaaataggtcgcatacattaaaataaataagcaatatgccgcatacactaaaatcaataaattattaataacattactacctggttgaacgatgagattgatgatgtgacaaatgaatctctgatgaataacgaagcctccaacataacttcgcagatccgactccaaaatcgatatggccgttgtgtttgctgatgcattgtcaagagtaatagaaacaaccctagattgtaaattgaattctctcaatacctctaggattgtcgtggctatggcatctcccgtgtgtgacgtcatgagttggaaccctatgactctcttatttaatgaccgattgttgtcaagataatgaagaacaacactaaggtaagatgttctttggtgttgggatgtccagatatccgatgtcacagcaaatgaaaaactagtagtactgaaagtttgcttcaacacactcaacttagaatgatatatagctgtaatatcgttcttggtggttttcctagaaacctttttgtactgtgggcaaaaagctttttggatcattctctcaaaatgtttgctttcccccattctaattggtagatcctcagcaataataaacttagcaatctcttctctagctatttttggatcatagatccatgtacttacagaaccgtcagagccgaaggacaattgtgtctgtcttgctcctgccggtgccttgttcttgagatgcgccaagtaatgccggttgagatggcctgtccctgaagaagtagctgcagacaaaattttgtcgcaatatttgcattgagcacgaggtatacttttaccgtcaaccatctcggtgaatacttcgaagtgctgccaacactccgctcttctggcagatggctggttattggaatttggtgtgggcaacgtcatggcgttggtgtcgaaggagaagttggcctcgctaggagatggctgatcatcgtcgtcgccctccagaccatccatgtggcgatcatgcatcccgtagtcatcgatgcccagggatagctgtcgggcatcgaccgacctctgggatggaccggttgttgactcgtgttgacgctttttggacctccgcatattttctatgaaaaatagatacggtggggagatgtgttgaaagaagaagaagtgtgttgaaatcaaaaaaaatgggtatggtttatatagggtatgctagggctgggcgccaggctcttcacctctcccttgcctcctcggttatcagccggcgatgcgtctgaactctgaacgactcctcggcggctcgacgccttgactgatgacagatcgaccaatggccatgccgtgccatgagcccatgacacgtgactaaacgactcctccgtgctgaatactgatcgaccaatgatcagtcatcagtcgacacctcgaccgttcgatgcgtctgaactctgaacttccacgcaaatgaacatgctttccataattccatgcatgcaccattgcagtaaacaaggacacaggtaattagccatttaaaaagttgaaaaaacacaaacaaaaatttaattgactagacagtggatatacacgatactaatcgccaatggtaagtgatcccagaattaattagccaaaaaaatcatgctttccatgcatgcacggctctctgaattctgaaagactgaaagcactgctcataagttactgatcagtattcagcgcagccgccggctgacctcatcagttactgaacgcatcactgaagtctcaccacgcacgcacgcgctcggcggctcggcgctcctgcctcctgatctcctcccggccggcccgaattgcacgcactcctaactcctcgcgcgctcggctaggctagagctcgggccagcctttgggcctttttcgtgctgggccggccttcgggcctacgagcctttttcgtgctgggctagcccaagcatggcccaactacgggccgtgctagcccggcccattgccgtgtcgtgctgggccgtgctttccctcgtgctaggccattgtgccttggaccggcccgagaaagcagggcccaagtcccagctctacctggagatactactggttaagaaccaactatgcctaaaccggctataagttcaagtgccttaatttggtttcggtgattaatgacaaatctaattatatgagactaacgtttttatgagcctttctttgactagtctcatttggatatggaagtaaaaatgatgagaggtatgtattaaacttcacatattctaacttggtctctcttgtggatccaaaatatagtgtgagcttcctatttgatctttattgattatgtgcatatgtgttccttcatatccatatgtatgcacatcttgagggggagcttattctatattttgtttattataagatttctatcttgatttgaaatcatttttcatctcatctctctgtattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtataagttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgaagttaatgaatactcaacaaacatatccatatctttcatatgcaaccggttggtcttcaagtgaaggatgacaaccgatttgttgagactaatgttctcctttgaggtgtgaaaaggaataggtcccactatgatgaggctaatgaatgacaccatgggttagtggtcatcaagccaaggacatcgtcatgttaacaagaatgaagtcaagcttgtgatgagaataaagtcttgacaaaggatggacaagacctcagcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagatagacgtcgtactatcaagaggggtctatgaagcgagcttgtggatgatcttgtgccatattagttcatatgcatgtaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggtcggttgagctgaaaagtgacctgcggtctgaccgtgggcattaggccggtctgaccgggtctgttagccggtctgaccggcgtggtaaggccggtctgaccggccccactggtttgttgcactggtctggtttttggtggcgatacagagctgccagagccgcaaccggtcagaccgagccgacggcggtctgaccgagccgtggacggtctgaccggccactacactgcggtcagaccggccaggttgagtgggctcaatgattgccctgtaacggctagttttctagccgttacaaagtagtccggtctgaccggcctcacaacggcggtctgaccggcagagcacaaagttggggatttcggttccaacggctagttttggtggttgggggtatatatacccactccccagcagcaagggtaaggttttggcactccattgcattatcttgaaccccccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctccgaggagattgtggaggaggcccggcaccgtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgttgcatttacatttgtgctatttacattcatagagatatatttgagcccatatcacttaggtttgcaaaacttaacttagtttcttagttaaccttgcacctcaccttgcctagcaacttatgttagttttgtttaagtgccattaagttttaaaaccgcctattcaccccctctctagtcggcctccttgatcctacaccggcaacattatgctttgcataccaagatttttggtgcccaacctgcttgcaccttgtgcatctggtcactgtcccaaacttggacatttttgttggcttgggtggtttatgcatttttctgctccttccagtccttggtatgcctggcatctttatgtatctaggagtattgagtggctctctatcatcctggggccaagaacatatgtacttctgaaggcttccacagagtaacaaggtacaatgtagtcatctagctcgttggttctataaaagatgcatgatattacatagggcatggctaccagtaactataggagcattctttcttgtccatgtgtactgtaaatctatgttcatggtgcttaacctcaaaacgatcacctccattgcaaatggcatggcagaaagctgactcactgatgtatacattaagtttttttcagaatacctaggcatacaacagttgtccatctagcaccatttgttttctgatcactgatcctaaccatcatttttctcctaattttcttaagcattgtgattattagataaaacttagattctagtttccatttgttgaaagattcacacatgttgttgtccactaagtcacagttagaatctaacctgaaccatgctttgcttaggatgtgtgttgaggatgggttgtgctccagcctgaatcagctgaacaagttttgccctagcaaggttaaataacatcccgcaaggagcatttgcacacttccaaaacttcttttggaattgcttgtcatggaagtgtctcttccgattagcatgtgcctagcgcagttcctgtgtttagcctcaagtgcccatttctgcacagcattaaggataccctgcatagcaagtaaaaaattgagtcaggaacatgttatggaaaatgagaggggactgaattagttatggaaaatgagaggggactgaattagtgtgtgatcatattacctcttgttggtctgaaatgaagacccaaccagctccagtgtcaatttttaggtcactgcaaagcaaatccataaaccaatcccattactcattgttctccttggtaaccactacccatgcaataggatacatctgattgttagcatttctccctgtagcacatagaagctctccattggttgctcccttgaaaaagcagtcatctagtccaataactctcctgcatccagctgagaatccttttttgcatgcatctaagtagatctaaattctcttgaaaacttgtggattcaagccaatttccctgttcacaaccacaatgctaccagggttacttctgagaagctcaagttgataattgaacaacttttggtactgccccctagtagcatctaagtgtttcttcataaaaagccactttactctcttcagctttgaaacagaagcttatgcaaagattgatttgagaatccaaaatagagccctacttatgacacatttgcacaaattttacagcaaagctcatgtaccttgggtaaatcttatttggtcctcttattacaaggacacagttcctcagattgtgagaagttgtggttcgttttggtggagggacatctttcagtatgatatattgtttagaggcattgcaaaacaaattataggctctgggatagctattcttttttgggatgatttatgggagggagttatacgttccgtcaaatatccccgtttatactccttcgcaaagcacgggaatgattctattgcacaacacttggccagaggcccccaagatcaattcttcctacccctctcgcaacaagcgtttgatgaatatatggacatgcaagaaaatctccaatctcttaccttacggaggttgatgattcatgtacattcatttggggatcagggaaattcacttcgcagctctgttacaagctcagttttctagctctgactcccccacctactatcaaatggatatggcagtccaaagtcaatatgaaaataaaggtctttaggtggctcttcttcatggatagggttaatacaagggatctccttgatagaaaacactatgcgccacccaatacttcagtcctttgcctctcttgctcagctaatgctagagaaactagagatcacctgttcttcctttgtccttttagtttggcttgttggagtcgtctgggatggacatggaaccctaacttggattttcatcaaaggatccaggctcaaaaagtggctgtcttgcatccttgctttatggagctattcttaattgcctcatggaatatctggaaggagaggaatggacttattttccaaggcatccaactctcagtgcaaaactggttgatgaacttgaagttagatttgagcttacatttaattaggctcaaagaatgttataggcccctagttcaatcatggatagatcaattgtaatttaactgttttttccttcccttttttgcctttttccttctttgtacatatttctagaaaattaatataccgtgggggcctcccccactgtctttggttcaaaaaaaaacagaagcttatgcaaatatttcttctttgactattgctttcatgtcagccaggggccaagaaggattgacagatatgaagttaccatacttttcagcaatcctaacagaggtaaccatctagttatccctcctaggtggacaagcatgcaggttctcaaatataactatctgccaactgtctgaccttgaattcttggaaagaagacatacccggggaatagctaccccaatcacaatttgccctaaccctcttggcatcatccctaacaaagttaatgactttcttctcagcaagagcatatgttgtgatagctttcttcaattgcttcttgcagttgaacttcatcccaggttcaaatgtaggaacacatgccttcttcttgtaccttggatgttgactacttttcattctcacctccccatcactaccaatttcctctactaactcctcttcatcattgtctgcatatggggttccattcccttcttcatcactagcttgcattgtcggttctgacctctggctttgcaagaaacaatcatctaggtcctctagctgccctgccttcacctttctcttagtctccttgtagtgcttctctatctcagcagcctcctcctcatcatctgtcacacccagaaattcactagtaatttccgaacttatttgtgcattaaatcctcgtccaggaatcagccgaggtacacaaactgacaatttaatatacagattcatcataataataacgtaaatacttacaaaagaaaagaaaaacaacagcggaattacggtctagcgaagctctggctccactcccacaggcagctcaactggggtataagccaaacgttttctccttcgcaacttgtcttcaactgaggtttgattgattattgcaaggtgagcatatgacatactcaacaagccacacagcaaatatgcaagtgcacaaggataccaaagaatggcataatatagggctcatttgcaaaagcagcatttagcaaacatttgaggattataaaacagtagagtaattaatcatcaattttaatcaacactaaacagcacacccatgctgctcaggcccaaccatcctgaacgaccatacccggctgtacagatctatctccaaaccaggaatataccattccaaaccaggagctaatcaaattattaccaattatagcatcatttattatggtgagaagtgtgagactaatcacgaaagacattgttagacccgcccataaccgcgggcatggctattcgaatagttttactctggccagaggtgtaccactgtacccacaagacacagccccacaacatgtcaccatgcgcctcaataccaccacggtacctcggaaaggagctgtgacagtacccctcgcacaacacaatccaccatagcgcaccgttcctggatcataatcacccccttataaacaaggcatggactccccagcgacccccgtaggcttatctccgctacttctcagtctgatgctccgcaatgaaccatgctatacaaaaggtaaagccgttgtccacgctggcttgtggttggcacggttaatgtttcacaaccgaaactcgtgaaccggtccttaattgtcatgagcacgaccatcaaaaccatgtgctcacaacccaccattatcaagttttagttggcaaattaattaattaaccaatcacgatcaaccatcgtgagcttccattaaatatccataagtgatagtgaagcatgatttatcccattagtgagctattgtttctaagcatggctaagcatctattataagcatctagctgaaccaaaccaatatataaggttctagctaatcaaattataacccataggaaaataaagtcatctttggccataattaaatgggaaaggctcaccacccggtgacattcgaaaataaatgcacagttcaaataaatagagaatttaaatataggatcaacatgctcaaaggaattgtgtttgggatctgtgtgacttgccttgcaatattcggtcttcaattagtcttcttgaatacttccaacacctcacgaatccttcgaaacgacataaacgacaagctaacacacaaaacgaggaaaaagactaataaaaaccaaataaacagtacataaaagtaaacaaacatgtagatcatgattttagataaatttagagacttgaacggtctcattccgatttcgtatgaattaattacgaattttacaagatttaattccaattaaacctattaaagaaaaagactattccacattaattaaaccatttacagatgatttataacggagatgaaagattaaaacaaacttcggaaaaagattagattatatttggtagatgacatatgataaaaagaactaatatgccattggaaagagtggaaatgatttatattgattttgggcggctgagattaatcttgaccgagtcgaccaagatcggatgacttagattgatctggcaagcgagcctcatgagataccgactcaacgagtcaactctacgtgacacgggatcacccaaatgatcaaccgaaaccggcgaacggaaccagcggctctgaactaaaggacgactcaacatggacgaacgaacgaagcacggggaacacctcgttcgaacaaatgagcgaacgactcagcaacggctgcaactaaatcggtgagctagacacaattcacggtaaagccccggtacggcaaacgataggccggcaggaatttagggatgcacctacagctagacaactcaactaccgagcaacgggctaaagcggcggctaggtttaagcgacgcacggctgcgacacagtacagcagcaatggcacgtcacagcacagcggccagacagcagctagcggcaagcagttacgcacagcagcagcaacacgactgtggcagggagcggcacaacggcagctagacgactagcgcagcggtgacagcaaacaacagcggcacatccggtagcgacggtgcacgggctagggcagcagcgcggcgaacaacaatgcaacaggcacggctgcggctgtgacaaagcggcttggcaagtgcggccgatgggttgaaatctaaaccaaggagacacggatagacgtcccaccgaaccaatcggggagagatagatgacgacggtgaaccggcggcaacacatggagatgacgacactagggccaaacaagattagattagattagatgggattaagaccctagggataaactacactgggaacggcatgggagcggcggttgccggcgaatcac

SEQ ID NO: 74555 - DNA, 57538 bp, Oryza sativa
cggcgtcatctattaaaaaacggagggagtatgtaatttataagtagataaattttacaatatttagtataaactaacagatatcaagactaaaaaaaatatgtacctactggtaacttaaatcactcttgtaattagtagcccaacaactccctgtatgtgtggtgccggttcgataaaaaaagaaactttttgtctatatggttaaaatgacatgagttatctcccctaaagagaaatatattgtactctctctgtttcatattataagttatttgatttttttaaacttctttaagtttgattaaatgtatagaaaaatatagtaatatttttaacacaaaataaatgtattataaaaatatttaataatgataatttcatattttagatgtttttaaatttcctataaacatgatcaaacttactaaagtttgactaggaaaaaaataaatattttgtaaaatgaaatagagggagtactggttggttgggtgaggaggcgtggggctagacactagacaaatacttccttcgtttcacaatgtaagactttctagcattgcacatatcgatataaatgttaatgaatctagatatattatatatctagattcattaacatctatatgaatatggacaatgctagaaagtcttacgttatgaaacggagggagtagtatcatactatcatggcgtccggctccggtctcctggaacatgcaaagcaaagagcacagcactggagcagccgagcagaacgcacatgtagatctagtgatcacccacctaagcaagcagcatggccggcggttggtctacgccacagatggtgctttgcccgatcatcgactgtctccctccggagtccggaccctcccggccatgcggacgtgggccaatgcccaatgcctgcatcatggcgatcgagtttgtggaaatccggccgtttttgctttggtgtcccatacgaccatacgcccgtacgtggcgaccgagcaagctacatcccgcgaggcgcgcgcgtaaacaaagaagctgctaagagcaggtacaataagtctagtcagcagactatactaatactattgaccttgctctaaaggcaaaagccgcgtacaacctattggtccctggcctctctccaacaaatcatgagacgcgtgaggaccctcaaaaaaaatataagaaattataaacatgttagaaattaaacacgggatatcggattaaaacgtcacacttcttaccactatatgtcaaatgcatcttgtgagacgtgaggccccgccggttgagagggagagcgagagctgctccggatgcgcgcggttgggttcactgtggttgtgattctcgtgtccaacattcaaccgtctctcttatttgatgaatttataaaaatatatttaagaacaaaagtcacacgtaaattactattcatgttttatcatctgataacaataaaaatactaagcatacaattttttcaaataaaatggaacagtcaaacattgaatataataccattttttaaggtaaagttgccaaaaaaatatctacatttaatttgttgctaaatttgctaaatacataaaaaaatcatgctaaaatttggtaagattattttaaatataatctagacagtccctaaacaatgtaaaactatggtcttttttagggagggtggaagtactgcagaatcgatttttttttccggagctcctgtagctgacgtccactcccacagtcccactcacgcgaggggcatggccgcagccgcggactcctggtgtggtgtggtgtggtagttgggaggctcgatttctccaagaagttgccggttttgacggtcgtggccgtgactccgtctagttgcgccggtttactactctacggagtactactaccacagagagcgcggcgggctgcacgagcgacgactgaccgaccggcgagattagcgtcaatttgcacggcggtctcggactctcggtccagtatacgacacgactcggttaatttactttttacctcatcctttcagctagttgtctggtacagctagaggggcaccataggggaaaagcgagacactcatgttttatgttatgttcatgatgatctcatcagtacagtactttctctctcgatcggaatctgtcaacacggtacaaaaacgtcaaacgcgtgcacaatacagtatatactatagtagtacttgttaagacaaataatcataagaatcataagtttaatcatcagtaagctactgacctactgtactgggacagaaacagtactacggctgcatgggcgtgatcaagccactgttcattcctgtgcagttccttcaccggcgaattttcctgcatgcgagggtggaaaaaacgtgctagtatctacttttaatttgcctagcttggcgactattcttcaggtttggtggtggattctagcagggttcagagctcagattgtcaagttttggcagtttcagttttcagacctccagtcgcttcggtgaatttagccggttaattaacttcctaaaactggcgtacagctcgaacgtgataaagcacttgagtaaaagacctgttagctgcatgcggttaactcgcaaatggggttttctagaagagcacaaggacgaattagaacgcaaattaagttcattgcttgcctgtaaaaacgggactcgtgtatgtcaattctcatcaggatttctgcttccgttttccctcctttttctcccatcaacaacggcaacaacgaaaggagatgtgcactaaattattattaaggaatattacgtgagatttactgtgtacaccggtctgcaatatgcgtcgcttgttactccagctcatccgattggagaagagggacaggtagtgaaatactccttactaaagttttcggcatgcatcttttcccctaaattaatcaatcccgagagccgacagtgactcctgcatgagttatgatatgctgaaacaactccacacgtcgaaaattcagacaaaattctcgcacgatgcaggagaataaatcgtgcacccgctggacccatctccaatgggtgctaaatcctccggtgtgagatgccgcccgcgtgacggaaataacagggaatattcacctcgtgttccgttggtagcacacgcttacacgtacaggggattaacgtggtttgggcactctgatcaatatttaaaaaagtaattttttcccttgcagccaagttattaatttccttatcattacttgtaagattcaattcccacctgataattgatgataaatcagccttgctacctacgtactctctacgtccaaaaataaatcaatctaaaatatgatataaccctattctaaaataacgaatttggacgaattcttttagggctggaggaagcatactgggtggtgctaggagtgcttccagtaaactggagatgttaggtgtccacttcactgccggatcatgttctgcactactagtagtactatctgttggtgccattgctttccgacagggcaaacaggacaacgggagcatatgcagcataattggcacttttggcacttttggcacttggacaccggagactactcgttgtcggtaaggcgaccggccatgaccggcgccggatgcagcccacaaaagatggttgccaaagtgctactccgatcctgcactgcccaatacccatctatgtgcatcccaccagccttttactatttgctattccacgaacgccgcgacgactaattcgaaagtggcatactcttatctttgctttgctttctttctttcttaatttctttccttttgttcatcactttttttcaagtttcttttgctgtgtgtaatgagcttactggcggagtatgtagggctgagtgctaatacttcctccgtctttaaatatttgacatcgttgatttttttaaacatgtttgactattcgtcttattcaaaaacttttgtgaaatatataaaactatatatatacataaaagtatatttaataataaatcaaatgataggaaaataattaattattacttttttttttaataagacgaacggtcaaatatatttagaaaagtcaacggcatcaaatatttaaggacggaaagagtactatttgttattcaacgattgctgtgacgactaattcgaaagtggtatactcttatcgttgctatctttctttctttttgttcatcacttttttttcaagttccttttgctgtgtgtaatgagcttactggcggagtatgtagggctgagtgctaatattatttttcaacggcgtggagggaacctttaaccgaaccgaggacctagctaggaccatagtggcatactggcatagtgactgaatcttgattcgatatggaccgccaatgtatgtgggaaaatgtcgatgagtggggattaatttgggcattaggagtactttttaactttttggtgcctgtctcgcaccgaccttgcacgttcttgaaaagatggtttggtggtagggtagaacattctaggcctttccaaagccattacctacgagcattccaggcaaattaattgatttctccggaaattaagcagcatcgacgtaaaagaagatcaacattcagcaaagaccaatttaggacaggagcttcattagccgctctactgaacagtttgcacctaccaacatactgtgacatactgtatcgtcgtggtatcaccatgcatggcccatgtgtacccatccatttatttgctagtagtaaaacatatcctaacacttataatattgttacagtgccacagatcaccgaggatatgtattctttaagagaaaaacggaaaagaaaatggcgatatggatctgattgatacggcaactctctgagtggcaagcatgcccctagtgctctgcttcctgtctcctatactcaaaaagcttgatggcgaggtgcaaccaccaccatccttagagatccatagcctgagtctgggtccagaagggtatccatctgttaaaaaaaactcaacctaaataagaatataatacattctaatagaacgaatcaagataatttgctattcagatttgttacactcgaatggatcatatttctaaataagaatataatacattctaatataatgaatctagataatttgctattcagatttgttacactcgaatggatcatatttccttttaggtaattttttttaaggacggagagagtctaatcacaatctcaaatacttcacctataaaaaaaaactctccatacgagcaggccgggccgaacaatggtgtgaattcggcccagtattgggccgtgacggagaatcacgcgcgacggcccactcacctcccgacctgggagccacggcccacaatattacgagagtagtgtttttgctgggccggatgcggctgcgtgtgctcgtgcgggctccgggccgcaggcttctgatgggccaattgccgataggcggcccaggcactggcaacgatcaatatttgggctctgggctggatggcggagaaagaggcggcatggcccaataacacctcgcctagatgggcctcaaactctcaattccgctgatggggaaaactaaggccctaatcccaaagacaatgggggacattcagattcttggtagatgaagtcaatataaaggaacatgacttaatttttaaagaaatcatggagcacagtgcgtttttgcactggaagtttggaacctgacattaattccttctttgattggaatagattatatcctagtagtattaggtatacttttttttatctaattaattactctagttttcaggttgagggtgacggggaatgtcaccccatatcaatttttttggcatgttatccacaatgctattgcattgtttaacatttcctttcctgctgatgaggatcctaattcctaaactgaatcgtcagatatcattaactgtatcagaggtcatcatcaggggatgataagatatgtacgcagccgcacgtaaatcgtaatatgatcatctctgctcgcatactgagactccacatttgttcacatccatttgagtatttgacctctgagccaatcatattctgacttatcatccgtttctgaagcttcaacgtaagctgctcacgctacctgtttattcaacgctaattaaccggagttaattggatggtgactgatccagccagagttagccgctgtgcacacacacacacacacactgtctaatctaatcatctcttccttttgaccatctcccggcgttctttccggtgacgagacatatatatacacatatcgcacacacatctgaatcatctcattgttcttcttctttctccgtctctctctctctctctctcgctgtctttccgagcagcaagcagcaatggcggcggcgatgattctctcctgcaggtatctgctcatctgcagcgcgacgcttgcgctgctgctgctgcgactgtgcagcgggctgagcctggacacggtgagggagttcctcacgagggaggaggacaccgtcgtgttcggcctcatcgagcgggccaagcacccgcgcaacacgccggcctacgaccccggctacctcgccggcggcggccatggccacgacgcctctttcgccgagatgttcgtgcgcgagtccgaggcggttcaggccaaggtgcggccgtttttgatatctcaactctggactctagcttgctcctcttctttcttgctcctgtgtgttcttgttaggattcgaacttgcaatgcctgaactctgaagcagtatttgagttcatctcgtttttgtatctttttttatgctctttgttttgcttgcattgtcaaatgtcaacggtctgctatgtcatctggcggttgggagattaattgtcgagatgttgatgaccagaagttgttgtctaaatgttttgacttgagcgtatgaaaatcggagttggacaatttaattaattatctaggtgatggcctgaagttgttgctgtctaagtgttttgactagttgagcatatgaaaatcctagtcaaatgtttcatgctctcatcaaaattgtttgaataaaactaataatctctttcattttactctctccattctaaaatatagtagtaaggcttattagtttttggcttgttctccaacattttgctttgattattattttattttataatataattatacatcattaacaactactgaaattaacatcatacaaaaatattttcaaatatgaatacagtagtaccacttatattagcactaaaatatttgtattgttagtttcattattaatgaaaaaagttacaaatgttgattttctaataaatatacacgctttattaatcaaatcatgcatgcatgtctgatctgaaggagtgaagaactagagtagccatgccataaatgtgatatgtttactttaagcaaagataaagaataagcatcttgcagtggattcaaaaagcacacgtcaacattaaacggcacgttaccaatatgatgcgtgaattgtgacaaaagacatcaactaaacgttatttcagcatcactaatccacattttctgttggacttgtctacaggcaggaaggtaccaaagcctgcaggagattcctttcttccctttcagagtgcctttcacattggcacctccatataacttcacaaccgtaagcgttcagcttccatatcttttaaaaaaaatcatctagaacaatgctgaaaaaaatctcaaaatgatcttactgaaaccatggttcatataaatcgtaggagctgtattctgcagccgcattagttaatgtgaatgatgccatatggagcatgtatttcaatgagttgctccctctcctggccaagaatggcgatgatggcaactatgctgcaactgtttcatcagatcttgtatgtctgcaggtaacaatacatgctacactgcagatcttgaattcatatattcacatttcatcctaaatttacatggaaaggttcattcttattgtaggcactctcaagaaggatcaactatgggaggtatgtggcagaagtgaagttcataggcgaccagcagaactacacaactttaattcgtaacaaggtaattttatcatttcacctactcctacataataagtaacaagctgatcagtgttggagtgatcatgtacaacagtacaattattttttggagatgaatcatccaagtgaaatttgtccttcacaggacacggatgccctgatgaaattgttgacatctgaagcccaggaagatgtggtgaagagaagggttcagaagaaggccatggtgttcggtcaaaatgtgacattggatggaccagttgaaactggcaacagcaacagtagccaaacaagtttcaaagttgatccttcattagtgtataaactgtatgacaaatgggtgattccattgactaaacaagtggaggtcgagtacctgctccatcgtcttgattgaatcaagcatttatctagctaacctatttgttcaaagtgtaactaagttgtcacatgaaagattgaaatgatacaccaataataacatgcagcaaggtctgcagattgttcagttcatcattttttcagattgactagattggctcaataaagcattgccaaaatatattaaaaatagtatgctaaacagatgaaaagaaatcaagaaagaccacatcatcatgctttcaacaagccaactgagtgaaagccaattcatgctttgtagttcccatgtgagcagtacaaaatgagcaaaaaggtattaaagcagcataagatctttctcatggctactaacagttgccaattcatagcatcatatccaacaaaagatacaacatcagttagtgacaaaataatcggagtcctaaaatccctccagaacagatgttaacactcttgtagcttcgaaaactctggttagatgggcaagagacgaattatttcatccattacccagtaaacacttgcagaaactaactgcaacatcccctgttggtgtaaataagtgatgttcctaggacccatttgtaaatgttaagagaatagaaaggaggagatgtgggaacaggggagtaaccctgaaaaaacccccaaaattagacaatatggtatcagagccgagctcctggcgaccagcggcggcaaaaccctagccggcggcggcgctcgtgccggagcaggacgaagtggaagacggtgtggaggcgaccgctgggactcgcgaggtggcggcgcgacctacggcgacagcggctgagcggcgtgccggggtggtcggccggtcgcgcggccgtggcgtgggggcgacggcgcaggagtggtggcggagctgcgaccaggtgagccggctggccgctgttgcttgctgttgctaccccgccgcggctggttgctgcgccggcacggaggacgacaagaagggcaccggctgctgtttgctgctgctgttgcttgttgtttgctatttgcggctgctactgcttgctgtttgctgctgctgtggagagaagggactgctgtttgctgctgctattgcttgtttggtggactgctgctgtggagagaagggaaaagagaggagaaggttgctgttgcttgttgttggtagtgtcttgtgtgctgaaaaattacaggagcagagagcagtagcaggtgaggactaaggaagcttagaaagggggaggggaaatgtcttcaggggttggaaaggaggttgtagatgcctcctcggtggttactaagggtgatatgaaagatttgctagagaatttgttgaagatgggcatgataggtccgaagagtgtagcagggggattcgaactgaaactagaattgatgccaaatgagttgaggttggaatggagcaaaaattatttgagttggtgtaggagagcccaattaatgttgagagcaaagggggtggatcattttttgcaagagagttgtgaagagccttctgataaggagagccaagcatggagaatgtggaatacaacaaattccaccgtggtatcttggttgatgacctcggtggctccttctattagtaggatgatagagactattcagaatgcagcaattgtgtggaagacattgagcaacatgtattcaggagagggaaatgtaatgatgatggttgaggctcagaacaaagtagaaaatttgaagcaagaagggagaacagtccaggagtacgctagtgagttgtagcagttatgggcagatcttgatcactatgatcctctacagttgaagcatgaggaggacattgtgattggaaataaatagatgcagaggcaaagagtcattcatttcttaaaggggctgaacaaggagtttgaggacagaagagcggctatgttctaccaggctacattgcccactatggaagaggctatttctgctatggtgcaggaggagatgaggttgaaactgatgagaggtacaaatcctacaagatcagcatacactgtggctgataatagagaatgctacaactgtggacaagtgggtcatgtgagctacaattgtcccactcctcggaacattggcggtagggggttgattcgaggagggtatggtggatttggtggaacccgtggtggatttggaggagaccgtggtgactttggggggaaccacagtggtagaggaggtcgtggtggagatcgtggtggtggaggtcgtggtaggggcgaggtgctcctcaggccatgtagccatagaggagggtaaagctattaccttaacaggtgaacaggtgacacagtgggaggaatggcagaagaacaagatcaatgagagctccaacaccaccactcactttggtaacttcgccaactacgctcaagtgggcgaaggtattcaggcacaggcacttgcatctacatacagacatcctatagattggatcatagactcaggagcatcaaagcatttcacaggattgcataataccttcacatcatacaccccttatgtccactctgaaactatccaaatcgctgatggtacatccaaacctattcatggtatagggtcagtagagtgcacatcatcaataaacttatcctctgacttgcatgttccttcctttccagtaaaccttctctcagttagctcagctattgaccaactcaagtgcattgttgtatttgatgagaactctcatctgttccaggagaaggggactgggaggaggattgggactagagtcaggtgtgatgggttgtggtacatcaatcatgaggaactggggctagctgcggtggttggaaatgttgagaaggagatcagtttgcttcattgtcagttaggacatccatcttttgagattttgagtaagttgtatctagatctctttagtaaagtggataagcatagattggtgtgtgatgcttgtgagcttggaaaacatactcggtctacatatgttgggattggtcttcgtaactgtgagcctttcatattaatacattctgatgtttggggaccatgcccagttacttctgtgagtggttttaagtggtttgtcacctttattgattgccacactcgtatgacttggatttatatgcttaagcacaatagtgaggtccttcgttgctttcaggactttcataaattagtgacaactcagtttgatgcaaaagttaagattattcggactgataatggaacagaatatatcaataatgaatttgtgtcatatatctcagatgaggggattattcaccagactagtacccctcctcaaaatggtgtagctgagagaaagaatcgacatttgctagaagtggcaagatctttaatgttccagatgaatgtgccaaagtacctatggagtgaggctgtgatgacagctgcatatcttatcaatcgcatgccttctagaatacttggtatgaagtcccctgttgaacttttattgggtaagcgagagttcaaggtccctccaaaggtgtttggttgtgtttgctttgtgcgagatcatcgaccttctattggcaagttggatcctcatgcagtaaagtgtgtgtttgttggctatgcttcaagtcagaaggggtataaatgttgggatcccattgggagaagactgtttgtgagtatggatgtgacatttcgtgagtttgagccctattataaaagtaaaggagatcttgaccaatttcttgaggaattctcgactgtcatggaggttgatagtcgagagggggagatagagagaggtgacacacataggaaaaatgttagtgacaagaatggggagacagtggtggttggatcaataccatgctctattgacaatgcaagtaaagaagcagtggaagttattggagatacacaagacaaggatagagaaatggttcttcatgaggaggatggagaagatggagaagatgaagaagtggttgttgggacaattccatgtcctatggagcgagccgaaaaggtgaaacaaaaggatgtgctagtctaccaaaggaggcggtttgatagtcagggggagaaaagaaaagggttagtgcaaagttaagttgaagagttatcacatccagaatgcccagtccctgaatcctctcagaacctctctcctacagtctcattggctccccttgagataattggtaatactcctcccattcttgaacaagtagaattacctcttgcacagcgtagagagactagatccaatgctggtagacctcctatacgtcttggttttgagcatcttagttctatgcatgacattgcaaactatatcttatattctcatgtttcactggcatacaaaacattcattgcatcattatagacagtgcccataccaaaggattggaagtgtgcaaaacaagatccaaggtggaaagatgcaatgagagaagagttgaatgcccttatgaagaataagacttgggagcttgtaaaacttccaccaggaaaaaaggcagtgggatgtaagtgggtttttacagtgaagcaaactcctgaagggaaggtggataggtataaagcaagattagtcgcaaaaggctacagtcaaacatatggaattgactatgatgagacatttgcaccggtggcaaaaatgggtacagtgagaactttagtatcttgtgcagtgaactttgggtggcccctccatcagcttgatgtgaaaaatgcatttcttcatggtgatttatatgaggaggtctacatggagattcctccaggatttgggaatagccagacagttggaaaaatatgtaaactcaagaaatccttgtatgggttgaagcagtttccacgtgcgtggtttgaaagattcaggtgcgcagtgtgtgatatggggtattctcagtgtaatggagatcacacggtattctacaaacatagggggacatacatcaccatcttggctgtgtatgttgatgatatagtgatcaccggtgatgatgtagaagaaatcaggtgcctgaaggaatggacacctaaatgtagaaggatattgtgatgctgattgggcgagtagtatggatgatagaaggtctacatcaggttattgtgtgtttgttggtggtaatcttgtttcttggcgaagcaagaagcaggcaatggtggctcggtctaccgccgaagcagaatatagagctatggctttgagtttgagtgagatgctgtggatgaggagcttgttgactgaattgcgagtgttaagaagtgatactgtgatgcttcattgtgacaataaatcagccatcaacattggaaacaaccttgttcaacatgatcgcactaagcatgtggagattgataggttctttattaaggagaagattgatagtggggtacttatgctagagtatatcaagtcatgtgaacaactagctgattgtctaactaaggggttaggtcctagtgaaattcaatcaatatgtaacaagatgggtatgattgatatcttttacccatcttgagggggagtgttggtgtaaataagtgatgttcctaggacccatttgtaaatgttaagagaatataaaggaggagacgtgggaacaggggagtaaccctgaaaaaccccccaaaattagacaatatcccctctgccaactatatcttcaggtctgcaaccgcatctcagttgtatgcagtaatgcttatgcacggagcattaccacgtttgaactccttcctacgttctgttggtgccttctaccccggaagtgattctccaagtcagatgcagatgtgcaattagccttgcaagtgctgcaactccatcttggcacaaacttttggttcttttcaacaaactgcgccacttcctttgcatacacctttgcttccatttccttgtcttctctcttcagggcttctaagttttcttggtgcctcctacctcttaggtgattttttaagtccagttcacttgaacaattggctttgcaaataccataattccatgttggtggataatgccgtgtgacagataaggactctgtttctactttcttcttcgtcccaatagcttcctttcttgattccaaagcattgttttcctcgttcctatggccagcagagtgctcctcgaaataaaattcattgtgtattcacttggattccatcacagctccttggcacacatatttttttgttgttcatctggaaagtatctgcaccccttttcctcttcactccagatgacacctttctacgcatcttggcctgtgttatgatgaaaaattattagaaaatagaaattacatggtcaatcttttttgagaaaaggcaagaataatattgtttctatccttgacataaaaatcatatctatgaacatattattgggcaccggtaaagctaccgaattcagtaatatgatctgcatagcttcaggttacatttcccttggagataaatttcccttatctagttatattgttttccattcaatttcaactgccaacaaaccaggcaacatatgtgatcgttgagactgatacgtgtagcttccttgtagagctgaacaacatgcaaacaaaaaaataggtcacacttcatcccatacatgaagtcaaattctttgaaagtttgaactcacctgcccttttgcatattgtatccatagtctacatattagaaacgtcccatctccaagaagcatcgattcactttaccatattatagttaaactaacaacatttgtaaactgcattgcttgcctctagcgaaggaattgtcaagaatgcatacaaaaatattaatattattgagattatggcctcaattttatgagaacttcaaaactagggtggtattaactatcaaatgtcaattataagaagtacaaaatcaatggtccattgaaattaggaataacaaggactaccactagtaatagagaccagaaggcaaattgcttcccagtacagatgattcacatgagacacttttttagtgaaagatgcacaaaacatatcaaatggcctgcttagtggctagtcatatttttgcactacaagctaaatcaaacatagttaagcatgcatggtcaactggattagaaaacaaaagaaattgagtaagaaacaactcaacgctaagacaagtgggtggctccgagaatacaactaatatttgggaggacacaaaccaagttttcagtttatgtgattcagtgatcactgaggaacaacatagactattataactagaacactacagtttataaagtggatgggggaacaatcttgaacatggaacattatctattcgtaacatatggataatcgattaaaagttttggaaaggggacaaaaagcaaaaaaaaaaacaagataatcacagacacatggctcaccgcattaaaagatgcattctcttcatctgctgtcctatcccatggaggtcgataccattcctcgatccgatctttcacaggcactctaaacatggatgctcctgcaggcattgccatcggtcctcctaaccaaagctcaccatgaggcgaagggaatgtgtcaccgcggaccggctggaagctgacggacaatcgcgagggcacatcacagagcaatccagtatcgcgctggaccttggcctccagttctctctgctcagcaatttcagcagcaatgacctcctgacgaatgccctcctcccagagctcccggcggagcgcgtccatcgtcacctgcactgaaactccccaaccccaccgctgtttagtttctgcgcatgagtaatttactcataatttcgcatgatcaatctatctctcagtcaatagcacatcatttactcaccttcttttattattatcgtcgtgttcttataatatttcgcaggaaataattttgatcttgccataaacaaattcctcaggaaattgaaaaaaaattactactggaggcagcatagaagaattgtaacgggggtgaagctctagattagcgaaaacaccaaattccccccttatttcagaggatacgaacccacattgttccttccacagaatgactgaatgagaacagcaggggaaagtagggccgtattaccgcgcggggacgggtggggaacgccgcagccgtcgtcggcgtcgaccggggcggtggctcggcgagcgaactccatggttggggtgggtggggttagggtttggttgtggtgggagagatgatgcgggaagcgggatggcttctccgctgctgatgaacgacgcgatggttcagcttctgggctggggaggcgtgcgctgcgcagaggtggtagacgagcttcgaagccttgggccctgtgcacggagtgaccgcgagccgttggatcagacaagaggtcatctttgtaccgtcggatgggggaagcccatccgtcgcacggaggcgccggatgaaagaacacggggtctgatcccctacgagcaagtttaaaatatcgtaaaatctataacgagaggcctctcgatctgctcttaagcagcgacgtctggcgcggtcatccaatttagtcgagaagcatcagagtttagaatttgagagaaacataagagtgttaggcatccatgtcttttttcccttcttataaaattttctctcaaattacttgtctaatctacaatctgagtacaccattatgtccgttgcaattaaatctttacaacaagatctcgcatgattatattatgatgaaaaattacaaattacttttataatatatctaaattactttttagacatataaaagtaaatttaataaattctaaaagtaatgaagtaacttgagacaaaaaggaagtaactttgtcgtcacattagaaattaatccgttgtagggataaaaacataattctatctagaaactaaattaatcagcacaaattaacgaattgactaaaaacaataataaaagtaatcacttcatagcattatgaatgtataggaagtaatttaatcaaatctaaaagtaatttatatatatgataaaagtaacttagtatataataaaagtaattttcaaacatttttttcatcataatataatcatgtaagatcatgttgtacagatttaattgcaacaaacacaacgatgtaatcggatcgtatatcaaataagtaatttaagagaaatttttatttgaaatttagatgggtaatgaggatgcaaatggcaggtactactacttttaggtgctactacttttagtaagggcatccacaatgtagaaataagaggggtctttaagcctccaaagaagtctatatacattgtggaagtggtctatatagaagacatttggatgagctatccttagctataaagaccggccacaaggattaaaaaattggtacatcctctccaattctggtacttgccgctatgagaagaaagaggaaggcgggaggagcaccttgcagccgctgccattgaagccatccgtgagcgtcgacgtggatctgctcacgcgagctccgccatccgcgaacacaccggggatcaacgggccgccgcggaaccgctcgcgtgtgcaagctgttgccgttgtcgaccgcgagcgccatcgccgcctccttttacgagcaccacccgcggccgtcggatccgttgtaacggtgccgtcggatacatctgatagttttttataggtcatagactgccctcacagatcaacacaagtcttttctgcacactttgtcctcactcgtgcgcacccgggaagaatttcccgatcagtagcacgcttaaccctggagttctttggaaatcggcttccggaaaagaagttgcaacttgttgatatgagtattctattaatcctattaagccatgggctgggatgtcacatctgtggtccaccgccaacgagcgccgccgtcgtggatccgctctcgcgagctgttgccgtcctcgtctgccgctgccataaatgccatcgccatgtctttcatcgatgggttgggggaaggtgtggggaaagtggccggaggaaggggttggttgggatggtaggtattttattaaaatgtggggtccaccataatgccttcttcctcccatatacattgtggagatgaaatatatttttgtgggacccacctagggcccaccataaggcctacttatgccatatacattgctcatgccctaagaagggtaacgagttgatacacactatattgtttttggtaaaaaggatagtcgttggttagcactaacgagtgcatgcgctctctgtagtcgcgtccttaaaatatagtcaatccgcaccctcttgggtaccaaaccatatagagaaggcactctgttattttttgtactcgcaccctctaaccatggatcgtcccaaaatagaacagccttgccatcaccaagctgccatcgcgttgaggccataagaaaatccttctctcgccgtgaaactggcatcggcaagccttgccaaggcttgtctggtgctgtgcgaagcgaccaaagccatcttgtacggagcacaacccctaagaggtcaaggttgaggatgccgaggcccccaagttgttttggagtgcaaaccttcgtccaggctaggcggcagtgacccccttttgcctccgccgctccctgccacaggaacccacgtcgcacctcgtctatccccttcagaacccacttcgtttttatcctgctgtttatgcatatcgaatttttaaaatgcacatatatgagggctcttctacaaaaagcaaaaaagaaaattcgcattttcgaagcggagaagtattgcatatgctaacgtcgcaagtacattggcatgtttggtagcgaaaaatggaaaaaattgacttgccccatctgaaaattttaagaatttcgtgggattttcacaagaaacaacttagatactagaagattagagaaaaaaaacacatatcctcttttctatttccccatttctctatttcctttccaatcggtttgttaacaagcaaaatactatacaatgagaataggtaaagagggcagctctcgtcatgactcatgagaggaacaccaaaactaggagtggaggcaatttgagtgcactgtacggcgaaaaaacatttacacttgaatcaagcatctcctatcttccctaaacacaataagacgtactccctccgtccaaaaaaaagccaacctagacacggatatgacattacataatacaacgaatttagacacgctcatatccaaagttgttgtactatgtaatgttacatctgtacctaggttgacttttttttgggacggaggaagtaaggaagtgggtcttaactcacttggcaaggaagtgagcctaattcactcggtgagaggtgttggcatacacccctaacacccaagttagaagtattcttaggttcaaagacacctgtttcttcttcaaattctttacgcactgtgagatgttaactgcagcctgcacagcatcgccgctatgcattgtccccaggggatgttactccaggattttgtatgtacgctccatttttacaccgtgcctgtacatattgaaagcatgactggtttcttcaacttggattatcaaagtcatcctaaaactccttccttcagttgcatcagatgagtacggaggctggactcctgtacctgaatcaacaccatgcaaagattgaattgatgttagtacattgcacagttaagtaaggcagatcatgttgtacaaatgaagtctggggtgtatgcaaggacaaagtatttctgcaaatggccagaactatggctactgatgcctactagaaattgtcagtttccaatcagataagaaccagatgttcatcccatcaaataaatccaaatcagacaaggcatgcaactcttgcaggacatgctacagggattgtggatatctatgctgccctctggctgtgtctgcagactgtttctggcaggttgaccaactaaagtggttggattaatgcagaaaacaagtcgagtaaccaacaactagttttccaaaggtgggtagctactgtggagaactaatggttaggagtgcaaatggctcggctcatgaaagctttgtgcaagggaagctcggtttggctcggctcgctacgagcaacgagctaaaactaaggctctgctcagctcgttaatgggctcaagcaggtctaggagaaatcaagcaacattttaacacatagaatgtgcaataaagtgataggtttcttcaatatgtcatcccaacacataaatagacaatatgacaatcaattttaccattttcaacaaataaatagctagaaaaggtacaaaattattgtatatgaccctattgtactgagccaaatgagcttgtgagcggctcgtgagccagcttaggcttggctcatttcaaaaatgagctaggaaggagcttgggcttggcttgtttggctttcgagccgagctatgcgagcatgaaccaagcttgagcctgagtttattgtccaccctactaatgggggttttaaagtggaatgttctttcgaaagttcagacagagattcataaatacctgtagttttgctgccgtagctaagagctctctacactcaccaagggcaaccttttcttgccttgccatgtctgaaagttcagaaaccaaagacgtcctaccttcaacctggtacacatatcctaattaatgttactaaaagcaacaaagacattgtatcctaataaattgcgggcaaattagagtatgtactaattttaaaagttttagtttatcaaacaatattctgaaaaaaaaaattgaatgttagaacctgagctgctcctctttttttgaaaaagaaaaatatatggtacgtttatatctaacctttgataggaggtacaaaattgaggaactcaaagcttgcataacatcaaccgctgagcttatagaattcttaactgcaacagcatctgcctgttaaataacggtattgtcagcataccagacaaaccaagataagagtattcgatcaaaaaaggaacaagataagtgtaactacaaatccaagatcatttgacattaagcaatgatggcttgatcacgtacctgtgctcctgatgtaactggaaggcgaagtgtgcatgcttgtaaagcttcaatagccccaatcaaagtactaccgttctctccttctagtttcggccaatgttgaagataagcaatctgaatcacaacaatatggcgagaagtaacccaccaaggattttttttagatataaaaaaattgaaatgggctaaacaccccaaatcaccaaataaccgtactttaatcaaaatctgaaatttttcaatgaattcaataaatttcgaaaaaaaaaatcagggggcacaattaccaaaaaaaatcactgaaagattaaaattgacagtacttcttccctgaatttgaaaaaatgtcagccaaatcagaagaagatttttccagagggacggtattacccaatcaccaactttttttttgttattttcagccccatatttaaaaaccacattttttttcaaattttgaatgacttcgaatcaaatttaaaggaagcatatttagaggaaaatttcaaccaagtacctgctcttttaaaacgtagtacagtttgagctcttgttgcaggagttgaacatcaattcttctgactgtaacagaatcccgcagctgcacgatacttttccacacactgtaaagaatactctgttttacatgggaggagagaaatactatattagttgaacattgcttgcccaatgaaaaaaataataataaagagaatgcacccactaagaaacaatggcttcatcaggcacaaacttgagcaaagcaattagagaacagacaggagcaaaaccaatatagcatacctctatgctactcttttggaaggttagtgtatcttctgaacgagcatttacaaactgccactgcaggcatctattatacagcagacgtaattggtgaatattctcaaactggcttgcactcttcttccctttcctcgcatcaactatatagttaaacacaagaggtgcaacgcctgattgacttgttgaacaacatcgtgatcggcaaggtgccgaaggccttgtcctcaaaggactttgaaaggctgtagaagcaggggatgcagctgacaagaccttgtttggtgacgacgagcgatgtagaacaggtgaagacagagtcctgctcgggcgagtagcagctttagagttttctgatgtctgtgaagaaacatcactaccagattctgtcttatcctctcttctgctctcatgtgtagccaatctctttgccaatccgttcaatggctgattcagaccattggctttgacttcagctggacaaatcctccttggtgaaagcccccttgtagggtttgatggagtgactgacctgataggcgtgttggcaacaccattgcttctcgaagttaagacggcagagccacggccacccatcattgccgccggccatcggtgttgctcaacgaccctcttgtttggagtctctgatggccgagcattctcacattggttgccaatgttcctccctctaagaggacttcttttcctctcagtctcggtcacgtttcttgcctgcaccttggtctggtcagaagatgagccatcagcaagcttgtgtctcttcttggcagaggttgccattgccatggactccttctgaagcaatggaggcacgctacgagctgatgcccacaagccatcagggggctttgtactggctgcacgacgagagatgccatgtacctcggtggctgccgcaacacgcaccggcgtcctgggcctcgacgcagcgccgccaccaccaccggacggcgtcgagctggaagaaggcgtggaagacctcctcctctcagctgactgtgctctgtttgtcgatgctgtgccttcagctgctgaagccctgctcagacttggagacgtgcatcgcctcaccgaggaagcagcagcctgtggcgccggcgtgccgccggacttgaacctggaggccacctccctcctccgacctgccggagcagcaatgttcttctccggtggcaccagcggctgccgcaaggcgcagtcgacggtacctgcggccttcctcccctctgtcttcacggcatccatggagtcgagtagctgctccaagaaacgcccacattgatgtactggccagctatcaccaaagctacccaccactctcctcagcaggcaatatcaccagagagatctaccaaaagacgacgccaaccaccaggataaactgatacaaaaatccaaacatgcatgcgtgcattaaccttctgacacaataacacaaacaaacaaacatgaaggctctccgcctctcccctcccccaccaggccaccacgtcaaagaacggcaaatgcaggcaaccaaacagcatggacgattgcacattattcacaacgatggatgacgacaacctagtgtcacggccatttacatgcaaaggattgtccaatttgttgctactgcccacccggtccctctcgtcgtgtgggcgtaaagtgccccaaggaagaaaaggaaagctcccgtgtttgcttggttggggcctagtacaggattgcaacagtgcagtaactgcaaatctgcaaattaatccaacatggcctcttgatgtgaaatgcgaattgctgctgctacatggtactagttacatggatgagttcgaccaaggacgaggagagaattaggttcaccttttttttcccctgaagttgttggagccgacagggacacatgcgtccacgcaacatggatctttgtatctagattctagaaagtttattctactgctttcactacttgttttcttcatcggaaacaaacattatgggaatgggatcattcttcgaagagtaaattactctttaagagttaacacctcaccattccagaagaccagaactacaaacttgcaatgcatcgtaagatttttgtactgttcgatgcaggcaagaaaacaaaatccaaatctaccagatacctattcacatggcaccagccgatgcaacagtcacatttcactcactggaaaacatgagcagaatctccaaaattctccaaaccggcttcgcgatcaaatgtggcaagaaaacgagaaggaaataaatctagctcgatggcgtatataagacccaaattgaagggcctatccgtgctcacgatgtacagcgaatcggagcccaatcgcacggaaagggacgcttagcttcggcgcaaagggctcacccttttcaaagctcactgtacgtctggatcgcgacgacagcgcacgcacgcaggagcacgaacgcgaagcggctgggccaactcgaatcgtccactacccccacaaaaaaaaaaggcaaaattggttatatagcatcgaaagttcactttttagttttatagcaccgaaagttaccggttcactttaatagcatccaaagttcaccctgttcccatttttagcacttccgttaatttttccgtccgtctttatcattattgatccagccacacacatgatattatatttctacccctcattgacatgcattatacttgtacttgtgaggggtagaaacgtcatatcgtgtgtgtggctggatcaagacggacggaaaacgatcgagaattgacggaagtgttaaaaatagaaacatggtgaactttaggtgctattaaagtgaaccggtaactttcggtgctacaaaaccaaaaacgtaaactttcgatgctatataaccaattttgccaaaaaaaaaaatctccgtttcgaaacgtttcgaatagtaataaataaataatgaacggggttttcccgattactcggaactgtttcaaattgacgagagcgattgcggaatctttgaaacgagaaaaaaaaattgaaagccgtttggaatctcgaatgtggtgaagaatgctacaaacggaaacagatggaaacaaatttctccaatgcccccaaaaaatttcacgaatccctaaagcatttgggggtttaaggatgaggggattaggatttaggaaacgctgggagaatgcagcttcacgcacgaacccaatccgatcagaggaggcgaagcaacgaacaggacgcacgagcagtggagcagtatgctactaagctgcaagttgaactcacctcggctcgatcggggatcgcggcgcgaggagccccctccgttgccggaccggcgggtcgccgccgccgccgccgcctcgtcggcctcctcgccgcgcgcgagggatcggaggttagtggcggcgatgggatcccgagctgttgccgtgcggcgaactcctgcagattttctcgcgtgcagaggaaggaggtggcgtggtagagggaggaacgcgccgcacggttactactgagggtggtggtggggccgtggagaaaaagagaaatcgtattagggttgtgtttagataaatgcgtgtaaagttttagcgtgtcacggcgaatatgccggcatacatttgaagtattaaacatagactaataacaaaacaacttacagattccgtctgtaaattacgagacgaatttattaagcctaattaatccgtcattagcaaatatttactgtagcactatattatcagatcatggagcaattagacttaaaagattcgtctcgcaatttacacacaatctgtgtaattagtttttttcatatatttaatactccatgcacgtgttcaaacattcgatgtggcagggtgtaaaattttgcgagggatctaaacatgccctaagttcatgatggttttatcagggcttttttttgtttgtttttttaattttgagaaggatttttttttacccaacctctacattcaaccgaatatatgcagccatttaaattgaaaacttagccccgcaaacaactcaatacgaaatttgctcatatggaggtttaagctcaaggcccaatctgaaattctataggcagccattttaatcggaaacttagccccgcaaacaactcaatctgaaattcgttcatatggagatttgaactcaggacctaatctaaaattcacttctatggatatttgaactcataaccttgagccgctactcatgtcactgcaattactaggctacatgccctttttacctttggttttatatcggcatatcgcgaggacgaaatttaacgattttcaaacagagatgattcttttttttttcgagtgatgattctattgacctcactgaacttgtatcgtgtgagctaacgtgttcatgacagtgaactgtgaactctttttctatgtcctagctaaatactcgtgcattgcaataaagttttgtaaagagatctcatgatagtttcttaagttgtgttggttattatggattaggaactaaatctctacagaatacacataaaatgaagcggtggattaacacataattaattatacattagttaaaaaaaacttaaaaataaattaatatgtttttataataactttcctatagtatattttttaaaaaacttactgttttagaagtttgagaagtgtacacgcaataaacagagagtggaaattaggaaattagtacatgcaaactcaccctaagaccatttcttaggagtgtttcgagaggaggagaaagaactagatacgtaaaacgagatgagtcattagcgtatgattaattaaatatgaattattttaaacttaaagataaattaatatgttttttaaaacattctttataattttttaaaaaaatatacagtttaatagatcgggaaacatttgcatggacaacgagatgaatcatctctctttgtccctcgctcaaacgcagcctttctaatgacgaaataatatttgcattagtcgagtgttagagattaattttgacacgtttcataataaccatttctcatcgtctaataaagatgttatacttatatcaatcatattatttagtgattaacttgacatatggtccatcaattgtttgagatcttacatagcagtgtggtgagtaactgggagaatcactatcaccatcaccaacatttaaagagatgaatgtcttctacatccgagagaatgtcttcctcacccatactaaaagagaggtaaatgttcaccaaacattttgtttttaaaaaaagaaaaaaaaatctaccaatagcataggtacgtaccagtgtaccagcaccactgcattatggagagttgtttcttaacgtaacttagctaaggttgtgtttagttactaaaattgggaggaagtttggggaaagttggtaatttggaaaaaaaaagttgggagtttttgtgagtagaaaagttttggatgtgatgtgatgtaatgaaaagttgagagtttggggtagtttggtgtgaactaaacagggcctaaacttgggtgtgtttactttcatttactaactttttactttctccgttcttcatgtgcaaaatattttctgaactattaaatggtgtgtgttttttttaaaaaaaaatctatacgaaagctgcttagaaaatcatattaatctaattttttcatttttttaagttaatacttaattaattatgagtcaattgagccacctgttttatatgtacagggtaaaggtttccaacccctcctcccgaacacacccttaaccctactgctagcattgtaagggtctgtttggagaccttaagattttgagaagcagctggttagaagtcagcttctgagaatatggaaaagatgggtttccctacttctgacttctaatttattttctggattctacaactacagcttctcagaatttggaccaaaaactagactgattagggagcttttgattctgggagaagctgcagcagttagaagcttatccaaatatgccctaagtaggtactatttgcacaataagccatggaaaaataaagaaagcaatgggtaacaaagggtttttttatccgtgttattctaggtttaaaagcttcgtttcaaaattatgggcttataaaaaccaatgctggaaaataaataatagtcttaaaaattgaaatcaactttgaagttagaccctgttctgttctccaacaaaagttggattaaactttggatactcgtgacacgtttttcaaattgctaaacggtgcgtttcgtgcaaaaactttctatatgaaagttgttctaaaatatcatattaatctattttttaagtttgaaataattaaaattcaattaatcatatgttattacaacctcgttttacgtgaaacacttaatcttcatctttatctttatcttcagaacatttaaacaccataaattttacgatcaaattttgactatggagggtaccatgggagaggaaacatacggatcccacaattcgtacagtattgacttctcaagtcatctgcttctacagttccttgtaccaccaccttgttgttgtgtcctcggccgatcgagaccctcgagaattcgtttcagctctgatttcgcggcgtcatcgatgctgcattgctgcgtgctacagccacgcccttgcacatgccgccctggtcccgtcgtgtcccgtggactgtagcgacgacgtcccactcgatcgggcaaccgccacgaaagcccaccaacgctttggacggaggcgcatttacgtgccgcgtgagcgggcccgtcgtcctcccgtgcacatggcacgtgggccccgcgcgggtcgctcgctactacgcctacgtgaagttgctggtcgccgcagcgctggcttttggtgttggtggtctctggctgcaatgcgtacggtacatgggagggaggttgagctgcaatgcaaaggcacgtatggttgttttaggccatttctaatccaagacactagacatagtttaaataaacttcacattattaagaaactagtactagacaatatttttctaatgcaaacaccactattccacacttaaatttaatgctacttatcccacatgatgccttggatgttgtatagaaacagtgtctcatgcaagacatggtttccttctctttcctcatttattcacttgccacatcattttttatcttatgtgacagcttatttaatgctatagacaccatcatagtcattgggttgggaatagccttagttatggctgatttgatctgaagccctatcaaaatattgataatatccaaatctaaataagtccaaacactataagtagggtagatttttctattagttaggcaaaatttgatcttaatcaaaatactattaaagtactatttgaagctaccaaaaaattggtaagccacattacggtgctctttactagtagtataaagcaatttgaaccgttgatcttatttggccgaggggtttaaatctgtttgtaccaccaccccatttagtgatagtagagatgtggaggaacattattgtcaaaaaaaaaatatacgggtgacagtgactaaatccttttttttctcctttttggctttttcgattgaacgatgccagcggaatcgattaccacatattgatatagatatagacccataaaaacataaatgatagttacctctaatcactatattagtaaattactaatttacccttaataatgaatggttcagatcatttctactggtagtataatattaccagtagagagcaccggaacatcgctcatccaaacatgcccttagtttgtaagggggtgtttagatctaggggtgtaaagttttgacgtgtcacatcgggtattatatagggtgttgcattgggtgttcaggcactaataaaaaaaactaattacagaatccgtcagtaaaccacgagacgaatttattaagcctgataaatccatcattagcaaatgtttactatagcaccatattgtcaaatcatggaacaattaggcttaaaagattcgtctcgcaaattagtctcaatatgtgtaattagttattttttagcttatatttaatacttcatgtaggtgttcaaatgttcgatgtgatatggtaaaaaaaatttagagtgggatctaaacagggcttaagtaccttgatgtagatgtggaaaaaagctcgaagctcgtggtttggattggctcatggtgagctactgagctcgactctgattgactcaaacccatggtcttaatgagttgagccaagctagaaatttaactcttgagcttaatgaactagcttgtgagttgctcattactacaaaagatcaccacatcttcatatatacttagtgtttcttaactagcgagtagtgactagtccattagttacatcaaaactatttgtattttgtgaattcttcactagtgtttattattaagtttatatgttgtaaacaaataaattactaattataaaggtgatataaatacgttaacaagcttgacaagagccagctcatgattttttgctcactttttctctcacttctgtattcaatgcatttgctcttgtatgtgaaacatttcttgtttttcgttgtctctattctccacatgtgcttaaaataagtttaatagtatagccaatttctagctataaaattaacacgtcatctacaacaactctattagcctatccatacaatagtttatataaatatgcattacaccgttaatacttaacccaccttgcctacacacataatattgtagagcctgtgctacaactagctataaatctaaatacaactattcttctctctcctctcttattttagatgtgtttatagctaacttgtaacctgctattgttcttattatactcttatagttggcatagagccattaaacttgctctaaatccctctttcaaaaaacatttataattagcaacgacgaaaaacatttataactagcaacgatgcatggcacgtgtgtggtgacgtgcatgaataaataagtgtggcatgcatgtctggccatcttatcatatatgggcagaactgtttgcgagcttggatcgagcatcatagaactggtcatcagtatatgtgtagtgtcgggggtgccttagctagccggccattcattgtatcacgggcccccgtaagcatgtgccgcgtgacataatgacatggatgcaagaacacggtccaccggtcggtactgcacgtacgggagttgatcaacccctgtgcaagctataacaaaacaagcatggttgattgggtacgtaggcgcggccgcatgcgcgcgtattgacctcctcggccggctgcgtcgacgtcggcgcgtcgccatcgcgtccggtactccggtgtgcgcgcggccatgcatgcagcatgcacgtacggtcacgcgagcgaggtgacccgcgcgtgtgtgttagccaggggaggcctagctacgtacgtgtgtgttcatcgtgacgcgcacgcgcgctggaccacccggttaaattttgtccggtcgcctagcgagctagctagctatcggtagctcgctccgttgcacgcgggattaggtcagatccagtcattaaggagggagggcggtgggctatcaacttcaatttgtagttgcgcggtgttgctttccctccgttgttcgtaggcgatgatggtaggattagttttatttagcgcggtataattgaccacagccaccggtgactaaaacgattatacctccctccgtttgagattatgaaccgttttgactttgattaaagttaaactgtttcaaatttgataagtttgtttaaaaatgttttcaacacatgataaatatattcaacttgttgttttaataaaactaatttgatgttataaatattaatttatgtgtttataaacttagttaaacttaatcatataatttgaaacagagggagtagcttgtaagggtatttgattgcacactggtatacaaaactaaattatattattctacctttgtttccaaataaatgacgttgattagtgcaatttcgaactaaccggcgtcaaacaaaaacgaaacggagagagattatatatcaaggtgtgtatatcaagcacacactgaaaaaagactactaaaacgtctaattaatatagctgccagcaaaaaagagttgtaccaatcctgattctactgctaaatacctaattagcctgcctttattattcctaacaccactaaacagataacttctttctactgcagtaggccgacgtagtcgagatcgacggagccgagccacaacttgcggtccctctccacaacctcgctcagcgtcacagccctactagcagccgtcagctcctccacctcgacgccgtcgccgttgagccggacgccgaccaggtgcttggccggagaagccgccgccggcacgttgaacgtaatcttctcccggttgagccccacccagtagccccccttggcgtctcgccggacgttgtcggggtacccgggcaggtcggcgaagagctcgtactggccggccttggcccccttgagccaatacctgaacacctgtgccggccccgtgtgcgccaccacgaggtacctcccgtcgtggctgacggccacgccgttggcgtacggcaaccggtccttcagcaccgtcacctgcttcgtcttcgcgtcgtacttcatcagccgagccgtcgcgtcgcggttcctcatgatgttctcttggtatctgcatgcacacaactcatctcctgttaatgctgatgatcaacaacgcattgcatgcataatgcaaatttgaaagtaaattaatttggattgttctcgatctgtgtatacgtaccggcgtgtgatggtggtgctgctgtcggtgaagtagacgtcaccggtgtcctggtcgacgtcgacgccgttgaggtaattgaacggcacgccgtcggcctccgtggcgagcacgtcggcctggccaccccgcggcccaacccgcatcaggcccttgtaggcgtcggcgaagtagaggatccccgtcttgaggtggaacgcaagacccagcggacgcccgcatgtgctctccgtctcctcagatgacgacgcgcacgtagggttgctcctgcacggatatatacatgttagtctcgtcaaccaatctatacgtaagaaagtattttctacacctaggtctcatggcacctgggtatatacatgtaatttaaatagttatataaaaattttaaaaaatttgataagatatatagtacataataatatcacacaccatgcaaacatacaagtcaaaattctatacatgcacgtacgtaccggtaattccggttgtacgcgaaggtagtccagccggcggagtcgccgccccacttgaggacgcggccatcggagacgccggtgaaggggccacggttgctggagtcgaaggcgaggctctcggcgccggtgacgccttcggggaggcggacgtgggaggcgcgatttgtcggggttgtcttcacctgcgacgcggtggtgcacggtggggcttcgcagatcacgcgctgcgcggcgcacggcgaagctaggcagacaaggctgaggagcaggaaaaccgtcgagaaactagccatgacgacgaagcgatcgatctgaagaggctacgagaagaagaagcgactacttcgagggactaagttacacagatcgaggaggccatcgggacgctatttatttggagaagaggaagagacagcagccgacacgacatggcgaggagttggagacagagctcgacacgccagcggcggcgaggtttatctctggtttttgaagcggcggatgaagacgaggagacagagctcgacacgcctgcggcggcgaggtttatctctgtttttttttttttttttttttgaagctgtgcggatgaagaggaagaggagacagtgctcgacacgcctgcagcgacgaggtttatccctgtcttttgaaacatagcgaggatgaggagacatagctcgacacggtagcggcggcgaagtttatactgtttctcggatgagatcgtttgattcgaaaaagatcgtagacgacaagaccggatttggttgaggacgcggcgtcgtgggcactgcgaactcccggccggaggaggaagaacgagctgacagggtggtgagctgggctgggctttggcgcactcccgcgggccggattgctgggccaggccgggccggaagagagaaaagagaaacgggccatttttgcatctgtcctcgttcatcccccacactgccccacacatccatcgccggattcgcctccgcctctcccttcctctcgtcggcggcagcaagcggcggcggcggcggagctccggattcgaggggaccaagcatcgcctgcagaggaatccgcctgaagggtaagcacccctcagctcgacgcatcgcgctctgcctccctctcgatttcctcgtctgctctagccgacgtcgaatcgtgatccctagcatcgtgtgttgatgcggaatcgtggttgaacatccagattggacttcgattccgggaggatccccgcccggatccgaattttggccgaccgggatccccgtctcctccgccgagatggggagcacctcgtcgatgctgacgcagtacgacatcgaggaggtccaggaccactgcgaccacgcctgtgagtttgcgcgcttgtgtttctctctttcgattggattctgaactctcaacgaagattgatgctgtctgccgctgttcccctccgatctgacctgctgattcggggtgttttgggagctaagtctcgcagcaggagatcgtgtcgctgtaccaccggttctgccagctcgaccggaatgggggcggattcgtctccgccgaggaattcatgaccgtccccgagttcgccgtgaaccctctctctcaggttacaagacataactagcctgttcctcaataccttttcttattctgtattgagaacgagggattaggaaaggaatgaattgggtgattgggtagatgtttgaggaatgctatttgttaatcgatgcgatgtctctgtcagaggcttctgaggatgctcgatgggctgaactttaaggagttcgtggcgttcttatcggcgtttagtccccgcgcaagcctgcagcaaaaaattgaatgtgggttcccagttcgtacttaaattctccatttgctttctgtcccggatgtctagatgttctgagaaatatgctatgttttctctgtagttattttcagggtttatgacactgactgcaatgggaaggtggcatttgatgatatcttgagcatcttgcgggatctgtctggttcttttatgactgagcagcagaggcaggtttgtgcttaagatctttggtgccatatcatatgtgctaacatatccatgttcatttatgtccataaaagcttgtgtagttgcaagtaattgtaatttgttgattgctcatgttgttgcaactacaatgctgctaaaattggtacctcacatgttgctctgagctggtagtcaagtggtcaattggtcataactgttgatcgactctaaatgcggaggactactttttttttgttccatgatcacattctaggccttgctggctgggataatttttggaatcaatagcgaattctaccttcgagtcaatttaactaaagcgtaatagtaatgtatttttggtagagcactctacagaatattttttttccttgtaagtaggattccgtctggtccgtgcttctgccggaccagcataataggttaatatacatcttggtttacttcgtaataaaataacatcatttttttatggtaaagtatactgtagtccttttctgctatactgatgtatgccacttatgcatttcagaaagttttgatccatgttttagaagaagctggctatacaaaagattcaaattttactctgccagactttatgaaggtaagctccaatctactactttattcccttagatctctttaaccttaacagataaatattttctgcactagtatcaggagcatacacattatgcttggtgaatcagatagatgttctagaaggaaaatatcttgtctgtatttgacaggtttaattttgaataagctgatatcactaaattaaaatctagttgtcatcatctccttatttgttctaaatcgagcatcccattcacttggttttatggcatttagctttgaaatatctattttgacctatactttccataccatgttattttgttaaataatgtagcattagcatgtgatcattttttcattaagaaatgaatggttttgattattgcaatcagcagatcttcgtatttacttgattgtagctaaaaattttcaccttttgtactcacgaaacttgtttttgtttccagattcttgacaattctgatgtgaagatggaggttgaagttcctattgactaagtacttgtgtcattgttctgtgccccggcatgtatgtcagcttgagaagatggattaattagaccctactagtactttttttatcatgtattaagctgtaattagtgaaacatctgtatttgatcattttcaggcttaattaacttttaccacccgtgcatcctatgacctttcaggtactgttaccctgtaaggtccccttcattttttcctaacatcttttcatattgaaaacgtctgtgatattatggcttattaatcctttctagtaccttccattatgagtgaaaaaaatgttctttgttctctcgcatcgaggatatctgcaaattggagcaggaacaatttgggcttgcttggatcattgtcaatccatgccttaccaaaatattggcatgctaaattttttttggtggagtatgattggttggtttgttgccaagttgtttgagctcatggttctcttgccatttttttttgatccccagaggcccagttcaaatgcacgtctagcttctccagctactaatcttctgcatggcaagtttagaggcagtaatccaaaaacaagccctttatctcgtcgtacaatgggcaatgcaacaatattcatttctctaggtcaatatggctaaccaaaggtggcgacgttagcttaaatgttaacttgctagactgaaataacatgccagtatgatcagcactactccatccgtttcataatataagtcattttagcatttctcacattgaaatgctagaatgacttacattgtgaaacggaggaagtaccaaaaagtcactgaggtacaaaaccatgttggtctaacgtgtttccgacaggacatgctgctctggctttttatctgccatcctcatgtttgttggtattccaggcagactggtgaagagtaaataggtttgctcagctcagatgactccaaattcacatcccaaaaataaggaacaccttcctgtctttctccctctaaagttgaggtcatcaatgttttctcctattaatagacgctaagctgattacctgcacttctccctagcagggaggaaggaatggcagaaccattggagaattggatctttggctcatcgttggggggtttcaaatatcggtgagtttgtctgggcttcatgtactccaacttgtcgttgcttattcaaaatttgttttctatatccaattgttaatccagtcatgtcaaattttgtgctcaactagtggagtaataaattatcaccacaacatccctcaacacctctgggaatcgaatgcatgatctattgtattaaccctgacagcaaaatcataacagaattcttagtcaatttgaactcttacattagtgcttcgttatattttttcagcacggctgtcaattttagatactgaattccagtttttcaatttattgcaatacttttggcatctaattagcttttatttagtcaatgtgcattatgttatgagcatagaaacattaaccctccatagaaaacatatttcgttaatctgctatcttctcgacatcttcgtaccacctttgttttgtatattctttcctcttctttggcctttctaaatgcgcttgattgacgcttttcaaattattcatagctaccatgggctaatccatggaacagccaaatggtgctttttcttcaaaagcatattgtcttgcctagttttaatttggtcctccactctcaatatatatatatgatcctgttagtcaggaaatatgtggatcatgaggttatcatccttgccaacagttatttttatttaaatttttaacatgtaagattcaattttccacattttaaattgaatacgaatatatatatatacacgtaacatgctacgatgctattaatatcatctctttctcttattcttcatggcaggatcacacattttaggctaggggcataaatttaagcattataggatacatgatatgacttccgtagtgcgtacaatgtggatggaagttttaccctatgatagaaatattaacacatcctggattaagttttagtaggtgcaaaaactgaaactcatttgtgttatttatgatatcacatatacaattacataatcaccaaactactagaaaggaatcatatgtacggtaatattatttttatggtgcggaagaattgtgacagtattattctaggctgagttgattttacacttcaaaatcaactccaattttttttcctttttcagcttcatccaatcctcgcatgtcttcagagaataaagtgaagtttttttaaatattgcaggttcaatagatgaatttaatagattctaaggcaaatagtaaaccatatactaatcagagcctttgagaaagatggcagaaactgaagatactcagttacaaaaagcaatattcgcacagtacattatgatgaagaagttattcatggagttggaagaggagagagaagcttcagcaacttctgcaagtgcagccttgtcaatgattcgaaagcttcagaaggagaaggaggagcagaggatggaagcatggcagtacaagaggatagctgaggaaaagattagccacagtgacaaagcactggagattctacaggaagtccttcaacagaaggaactggagaatttttatctgagaaaccaattgctggtgtataaacacaagctattggatgttggtattgatgagtgtgatattgcagacgagacgataactaacaatataccattatttgaaagcaaaaccgtggagaatctttgtcgtagcatcaaaaggaatttctctctgccaactttgcagatgaagaaactttttgccgaaaaggacaccgacagaaatgttgaatcaacaaagagcagattaggtggctttgtttgtaatttgagtgaagatgaattgaagcatatttctggaaatgctagtgacttcaaggctctagaggttcagaaaagcttgctgacagatggggatgccacagaagaacatggagaagaaccaaatcctccaagcagtgatctttctcaacaacctcatctcttggaagagtcaagttgttcctcctcgttgttgagtaatcatagagatacatccagtgaaagagcaatacaggttggggaaaatgcggaagatacacgacatggtgatcaactcaagcagtcacattcaggcattggaaaggaagaagtacaatcacatcccttggaagagtcatcaagttgttcctcgttctccacatcgagtaatcacagagatatatgcagtgaaagagaaatacaggttggaagaaacgcagaggatgcaccacatggtgatcaaaccaaagagtcacattcaggcattgaagcggaagaggttgcagttcatcctataagtgacatcgttgacacaatcaagattcaagaaagaagccaaggagtagaagaatcctcatgcactgcaaatgaaatcatcacaaaggagtcagaactttctcccaaggacgttccgaaagagcggcggcctcaggctctatccaagttatctgcaacaagaaaagttggctccatgaacaacctctacaggaatgtccatgtaatcaccgataagagttcgacgccacgaggaaagaattcaacgccacgagctggcactgagaggaccagatcaaggctgaagcgggtgcagagcgagaagatggttgagatgaatgacaccaggaaaaacaaggagcagatcataatgctcaaggaggtgtacgagcagcttaacatgatagaatcgcacatgaggccttcgacttcacaggagacccctcggaatgaccaatccttggaatctgtcttggaggtaacttgttaaattttcaacttgttatgaaattttacttttgtagagttctaacatgtctaatcatgccaattttccaacaggcggctctgtccttctccttatagctagacccttgtggcctctactctaccatctgaacttctgaagcatatattcagaggccacctccagttttgaggcggccatctatcaggaacatctcttccatgaatacccaacaaggggaaatgcatagagtttttatatgcagtgtaaaactgcaaactcccatggtggcgttctttgagaagtctcatacacacactcatctatcaaggcctccttcgagcggaggattttcgaagaaattctgcaggaattgaactaattcctgtaaaattctgtgaagttttcgcgttcgggagtccaaatagaaagaaatctaggtgttgggtctgtgggctgtggcctgacgccccacttcggcaaccaggcatccgttgtagcaacgttcttttcacagtggcagcggccaatgcagccgttatgttacttgtgtgagaaagttttacggttctacagagacaattttttttaccttatcacactaaatatagttaatgccatttctctcttctctcgttgagctatatcatcttaattatttatggtctaattatcttcctcattttcttcttttataaagtcatgtcgccttaattatcttccttcttcttttcttgtcttataaagtcatgtcaccttagtttcttagttttacctctagatgattaactatattacctttttttttccttttctcataaaccacggcttttgaacaaccaatccatatataatttaaattattataaacaacatcatcttaatttatatgagaaggggatggcggggaggaattaataatcaaaacccttgtttcttgggtatactcatgcatatacttgtagaacttgattattgaataattaaagttagcactcatgtgtgattatatttatacgttgtcctataaacgtgaaaattttttgtaggcttaggcacacagcacacataccctctatatagactagtagtactaggataagtccattccggtactaggttgttatattctgggatgggacggagggagtatgtttgagcttacgggggagctatttactcgcaactacgaccacacgcttcccaaataattaaacactatattttctcaaaaagaaaactttctataaagatttctttggaaagatttttctttaaaaaaatattaacctttaaattttataacagtaaatatatttaattaattatctaatggagtaatattttttcttattttgcgtatggcttataaactcatttcaaagtttcaaactctgtttagaatgggcccttactcgatataattgaactggttcttcgtagcctttttagctggccttttttttctctctctctctctctctttcagaatttttcccatcacacaacataatttttattcagtaaaaataccactgtttgtgtgccgtataacaaagaccggtgatgtaaaacatttttattaacaaaataatctatgtgaaaagtgtacgtggtcagtcggaaaaatataaaacagtcattcggacaggtgttccgtgtcggcagtcagctgtacatttcattttgcacacgtgttgtttcacaggctcacagctgcactacgaaagcgaccaaagtgctacggcatgttgggcccctttgaatcaaagggtttatctagaaattttataggattcaaatcctataggaaattttcctacttgaccctttgattcaaaggattgaatttttccaaatcctataaaattcctatgtaatgacacattgtatgcggattttggaggaaatatagcaagagctttaacctcttggaaaattccttttgagtctatctctctcatccgattcctgcgtttttcctacgctccaatcaaacaaccattcctgtgttttgcaatcctctattttacacttcaattcctattagaatcctgtgtttttcctattcctctattttttcaaccctggacttgcaaaattgcaattgccagttcacatttcaggtttggatctactgatcctggattagccacttggtgctctcactcaacggatacgtgtagatcccttcgcacggcgcaaactgattcaggttggtcacctaaacactgccagaaaaaaaaggtttttcttttaagaatacacataagatttgtgtatctttgtagtattaagaacaaaaaaaaatggagaaagttttgctttgggcttttgctcagttgacttttaacacgtcaaattttgcacagttcgtcaactagtgatgggattcaactgcagatttgtcatcttgatctgtgacgacgaatgcacgatatgactatgtaataacaattttcatgtacgtaattgaaagctaaattgagtttccaattcagctgttcatgacccataactgatgtatgatcagtgtctgatgatcaattaattcctcatggaagtacattgattcaggtcatgggattgatcaattccatgccattttcagagactgttgctttcttgagtactttgaattcaagatcaatctaaccgattccaattatttttcctggagtcacgctctttctctttcatttaattgctgtattttataaacttgaatcataatttaatcaaagtcaaaacccacagcatctgatttgtccgttgtgctgtctgctacttggttacgtctgtgttgtctgctacctgaactgaaactggaaccggtccaggatggatgccttgttttcatgtcaaaatctgctggctacacacaatcacaagtaacccagttaattagtctacaaaaataaaagtaacctaagtctaccaaaaaaaagtaacctagttgatcagatcgagaccgtggcatgccctagcagcactacaggattgatcatcgatttggttgactgctcataaatcatcataactgaacaatgttggtgtaagttcatatttgccgccttctattctgacggccaaatttgttggaagttgctacggtctgccataaatcattaaattgtgcccatgctatccacaagaaaataacaggagagattcttttgtctgcgagattgtggaaaaacacaaccttatttctctttatttcattgtttcttgcaactccacgatagtgatgtaagtatggatgaacagtttgaaatataatgtataaaatcaaggaatgggaagaggagcaagaacttgaacatgacaaagacatgacaagagaaaatataggccagtcaaacctggtattgcttcaccgcatgcactcctcttactttaacagtctattttttttataatgtttgatagtctaattaggacggctatagattattgacgtctatttatttttaagtagtcattagatttttgtttattttaagaagcacatcaagatacacgtacagtcattagtcaaactcttgttgaacagtatggaaatgtccctcaggttctcatgcaaagattgccaactaagcacgcccacatttctctcccaatttccataaaaaatactttttttctcccaagcttctttgacattaatttattatactgtaaattataatatccaatgaatggtttgtgcttgacataatgaaaggtcagaatccgagcaaatatttttccttatctactgacccgttgtgataagaaaagaatttgaggatatctaatggccggaatttgttctttgtcaataaaagaagcacgttcagaaatgagcttctttcagtcagaaaaatggtactactaactgctagctagtactagcgtgcgtgtcaaatatgaattcacgctccgatcttccaatcctaatcagtaatttgtcacgcaatcttgcttcaaaacaaccggccgtaccgttcaatacggtgcatgcttgcaacattgacatctgaattaaggaaatgttcgcccaattctgttgatgttttgatgatgggagagccattcaatttagactcggttttgcaaagacgcatgctggcagcatgctcagtttgacatcgtgtgtaaatactctgcaaatttggtcatgcagatcagcctttcagatttcagctgcatacgtacacaagtacttgcatttactgatgatcgtttggactttggaacagatttgagaatcccgagtactgtacttattactacacaattaaccttaagtcaattttcgagggctagaaaattctattattttcttcggatcatgatcagttacgttactggacatataatactatctgctaatccggtcataatcaggcagtatagatcagaacagatgtgctactactgacggatgggtggagccgttaacgaaatgaagcggacagctgaaagttgcagtcagagacaagagaatgtcagctacactcatgaagtcttggaaatttgcagaaagtctaatccgtatactgctcctggccattattaaggaattaaaatgccggcctatttcagttaacccgtggaagtagtagtcagctagtgcgatctctgtagtgggataatagcacttgcgtagccatgtcatgggataatagtagccacaagaactaatttctcacaaaaagaataatcaataactaattctatgttcctcctacagactaatcctatgattctttaaaattttctatataaattgtttagaattgtaatagttaattttattcgtttataactctcgtgcctcctcgaatatcaataaaaacccgataattcatcatttattcatctattaaaaccccatgtgagatagattattctgcttcattataggaagaaattaaatttttaagaaaggaaaaagtccaaattaccctattaactattgcgacaatacaaattccctcttaaccacaaaaccagacatcattcaccttaacttctcataatggacgaattacccccctgagtctctttagagcggttttcgtcttatgtgacacacacgtagcagtccaatcagcattaaaaatttaaaaatagtgggcccacatatcatacgtgagcaatggaggatgaggggagatatgacatgtgggcccactatatttttaaatttttatgctgattggactgccacatatgcgtcatgtggaacgaaaactgtctagagagactagggggtaattcgtccgatataaaaagttgagaatgaaggatatctagttttgtgattcaggaggtaatttgtattgttgcaaatagttcaggaggtaattcagacttttctctttaagaaataaacttaacttgtactaacttataacatgtggtctaaacaatatcgagaatttttcttataagaaaacgtactggctccatattttcatattttttttatagatgaggtcactgatttttaaacatatgtttcactattcatctggtcaaatgaatggtcaaacatctattaaaaattaatggtgtcatctataaaataatagaagaaatgtattttgtagatacatagagtaaataatcaggtgaaagaacggaaccggaacaatcaaactgggacctcaaatatgctaaagatgaagattaagtacggtaaaaaattaatacataattagttgagttttaatattttaaatttgaaaaatcgatttatgagatatttataaaatacaccattttacagttttaaaaaatacattaataaaaatcaaaataaaatctgtaacttaatcaggtttaactgttcagagagtttagcaactactcccttcgtctaaaaaaaataaatctagtactgaatgtgacatactgtagtacaataaatttaaatagagatatgttcagattcataatattatgatgtgtcacatttagtaagttggttttttataggacggatagtttgtggctggtttttcagcaacattggggggagttggggacaaagaagtcaataattcaccgcaacactgccaccggtaaatccagagagagagagagacaggacacagctgaggagagagaaaccactgcaacccaaggctagccgcctcactccctctctctgtttcctcttcttcttcttcctcccgccggtcagctcagctcgcctcgtctcctccattttggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaacggcgagaccgccgccgcgagcagcgacgactctagctccggcgtctgcggcggcggcggcggcggtgaggttgagccgaggcggcggcagaagcggccgcggaggagcgccccgcgggattgcccctcccagcgcagctccgcgttccgcggcgtcacacggtgcgtgcgttggctggccggattttctcaccggcgtacgttcgccgcactgggctgacagcgtttgtggtttggatttttttttttttggcgcgcaggcaccggtggacggggcggttcgaggcgcatctctgggacaagaacacctggaacgagtcgcagagcaagaagggcagacaaggtatcatcaccaatcactccattaatccaccttatagttgcatccctcgagctgctcgtcagacaatttgctcattctgatttcgctgcgttctctcttgttgctctgattttgcgatcggattggcgtggccggacgaacagtttacctcggtgagctcccaatctgaacattctgaaaccaaaatccatggccacgcagaaggattgtttgctgaccacctcactgtctgtgcgccggcgttgcaggggcttacgacggcgaggaagcggcggcgcgcgcctacgacctcgccgcattgaagtactggggccacgacaccgtcctcaacttccctgtacgtggcatacgcctctccaaaaatccatggcatctttctctgaactgaatcctctgcacaagcgttcttcggaacccttcaagaaatgcacgcacagtgcagcttgtttgattctgtttggttttctgaggaagattgttgctgtttttctcatgttggaactctctgcagctgtcaacatatgacgaggaattgaaggaaatggaggggcagtccagggaagagtacatcggatcgctccggaggtaaatattcagttaaccccatgttaccactgactttcaacaaagagaagttaattcagatcattacaaactttcagaaaaatccaaatcaaaacccattgaaatatgcttctctgatcagacatagtgaaatattcatgtctgagaagctgtgttttgaagtagttcttcttgattaagatcataaacctttttcaccctgcaggaagagcagtggcttctcaagaggggtgtccaagtacagaggagttgcaaggtagttaatcagtactaatctacactgaaggttccagttttctactgaacattgctagtagaatcagttaattaacagctgttttattcaggcatcatcacaacggcaaatgggaggctcggattgggcgtgtgttcggcaacaaatacctctacctaggtacttatggtaagtagtttgtgactttgttatatatgtatgcattaaaatgttcttaaactggtaatcagtcatctatcttgcgggtaaaaagctttgaaatagtataaattttacaatggaatagattcttcttatctgagtcagcttgcgttatcaaaaaggtagccattgggtgtcgttgttagataggtgacacctgttagttgcaaaggaaacagagaattttttagacacatccaagaacattgctgatgtgttggcttcaagacttcagacaagtagaacctaactactaactactcctttgcaaagacgaaaaggcacttggtgaagtaaagatgaaaaggcacattagagatagtttggaaagaatgtcactgaattcaaaagagctttcaaactatggctatccaaactaggattcgaagaaattgaataggataaagttcatgatctttgggataagattcgccgagttatgtttgaagcagccgatggccatactctggtagggccagttcatctgaatgccacagaaatgtttccgtacgctgtagctaaaagccgaccgatgcggtccagctctgactaggatggacgacctttgtttgattttgtgcgcaactatgtgcaaaatttccagcatgaactgaattgacgattttagacctgtttcctttcgtcaataattcataaatcaccatggcatccgtatgaattggccaccaactgttgtgtctagttgctgcagaaaccggtggcatgatgtgccgtgcatctgcacaaattcaaatcagttttattagctaaccgtaacgttgcctctttgtcacatctgtacaacaatacaagggacgtgcaatccagaaaaaaaaaaagtccacaacgaccggtatgttgaacaagtcggtatatgtggattatttgcttcacacttcttttaaaaaatgtggtgcatttcttcttggttcacttgctataagttacttactctgtcctaaaataaatcaatctaggtgacgatctgacacaatcacacaatctctttgtccagattcattgtaccacctagattggtttattctttatgtattatgtatttattaggtttattatatataatatttaagttttcgtataatcaagtagataatctatcaacatacatatgcgagcaatatgtttgaaacactaattctaaaagtacactttgaagtcaaggacggaggcaggagtttgctaagcctaaggctcaacaaatgtaacttgttagattttcaaaattttcaattttttttggatgaatttaaatgggattgatttagcaagcgcactttatagtcgttatattccctcctgtccgtggggcccacagacagacaggcaccaagcagtggcaactggcaaggccactggttcactgggcctggacgcaggcaggatggcaggagacaggagtcccaggcagccacacgccacagtgacccactcccacacccaactcagcaatgcacagccacaaaaccaaaccacgctctttctttcttcttcttcttttttttttccttttcttttctctttttttgcgggagaaacctcgctcatctcatctaagccaccatcttgtttttttctgaacgaaatttaccatttcatatggatttcctctgctatgttttttttatttgttcatggctcacggtgctcttttttccgtacgatctgtcagcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgcgttgcaaggcgtcgacgagcagccgtcgtcgtcgccggcgacgacgcgccagctgcaaaccgcggacgacgacgacgacgacctcgtggcgcagctcccgccccagctgaggccgctggctcgcgcggcgtccacctccccgatcggactgctgctgcggtcgcccaagttcaaggagatcatcgagcaggcggcggccgcggcggcgtcgtcctctggtagcagcagtagcagcagcacagactcaccttcttcttcgtcgtcgtcatcgctgtcgccgtcgccattgccatcgccgccgccgcagcagcagccaaccgtaccgaaggacgaccagtacaacgtcgacatgtcgtcggtggcggcggcgaggtgcagcttcccggacgacgtgcagacgtacttcgggctggacgacgacggcttcgggtacccggaggtggacacgttcttgttcggggatttgggcgcgtacgcggcgcccatgtttcagttcgagctcgacgtctgaactctcaactccgaccagggtgtttcgggaggcccacaatcccagcctgttcccgtagatgggctggaaagatcgaatcaaatttgggcctattcaggggatgggctgggagaattgatatgggccggcagggatggccgaaagggaaggcctcccaagttttggctgtcaagaagctagaactgagttctctctcaaaagagagagagagagagaagctagaactgaggattagttgcttactcgcaaatactagtagtttggaggaagagtaaaatattggtttatttgttgcccatctctgcgaaggggaatttaccgtaataaagagtacatattgccgtttttatacgaaggctagtttatgcgtttcatcgcaagttatttcctgttgcaataaacctgcattgttatacatcatcaattctatttttttcgcattaaaaaatctaccttttcttttttatgttaaaaagaacgcttcaataacttccactaaaaatccgcaaatcctagccatccgattagagatcaagggctgaaacgatctccttccccaacggccggtgccaaaaacgaaccattacttccactaccccacaccgcagcgcacgcgcatgtgggattcccctcctcctcttcctcttcccgccctccccctccactccacctctctcccctctcctcaacccaaccgcccaatcgaatcccccaaaccgcagcaacggcggcgcggcgcggcggaaaccctagctctaccctcctcctccggtcgcatcctccccggcatcgccgccgatggcgggccctcccggcccggcaccgggcacctcctcctcctcctcctccctgcccagccgccgccgccgccgcccccctccgcgcctcggccgacgccgcggcggcgatgatcaacagcccccgcatcctccaaaggcctcgtcggaggctctcccctgcgcggcctccccgcccgcgcggtgccgcggcggtgatcaccagcccccgcatcctcccgaggccgcgttagaggctctccgcggcgcggcctcccctcccgcgcggcgccgcggcggtgatctacatccctcgcatcctcccgaggccgcgtcggaggctctccgcggcgcggcctcccctcccgagcggcgccgcggcggtgatcgacagccctcgcatcctaccgaggccgcgtcggaggctccctccggctcggcctccccgcccgcgcggcgccgcggcggcgatcaacagcctccgcccgctgtggcggtggcggtgactagtgaaggcggcgtgggtccccgccgctcgttccgcatcagcctgcggcaccgcgtgcgtgtggtcccgtgggtgaagccacccgtggcgaggaagcccaaggaccccgcgaagcccccgcgcccgtcgatcgaggcgctcgcggcggaatgggcgaaggagaaggcagcttccggggcccccgaggaggagtgcgtcctgcctttcctccagaaagatgcgcctaagaaggtagcgagctgaaactatcgaattcgttctcttctagtagtagcatttggctcccagggttcgatcgttaggttgcgtgggtaattaatgcactagttcccctcttcgggcttccttgcgatgttctatggtggatttgcccctgcacactacgaaaattgcagcctattgctgttgtggtgctttgatttctccgtggaagggtggtattttggcaatctggggttgtatgacctcagaattcaactattagcaaatgtagggtccaactttgtgtataagggttacaactagatatgtcttcattttggtaatatgacagtatgttgatatcgccttctacttctaggatatgaaattaaagtatagctgcctccatttattttaggcaattttacaccgtgtcatctgaaacgtgtttataaacgttcatgcttttggttaaaagtttttgtttcctgttactttttgacacgtgagctgtgagaaactcattgtctgcatcgcctgaagtgtatagaactttatataactctgggtttcttgatggttcagaaatctagtgtagctgtatatggtctggacatttgtagcatcactgtacaatctgctgattcaattttggactatctgtataacacccttttgttatgctttatattacagaccagctaatagcacaaatgtttgattcactgttagcaccactgtatattgtgactggttagaatgactacaattgttgtcatgggtcacccagaaatttgagaaatacaacataagatttttagctttcttgagaagaggtggatggcagagaatttggggtacaggctgaaatttcatatcggttttcatcattatataatcttgataagctcgacattgtaaaagttcttggactagatggatttggatatatggatacagtgatattgagcttgaaggtatagcaagggctgcaacagggatatggatggctaagggttaaatcttcaatttttgtagagttacaggaaaaacattcccattacagtaggaaatgtaagtggaatggaaattcattttgtgttaggacagttggactaaggacaccaactgtatttccaagaaagctagtttcattaaattttgggtagctggttattaaaagcataatgagaaaccaagttaaatggtgaatggtgatggaattcaaagtttgtaaacaacagataacgatttgtagaaatggtacaaatgataggtcactttctgtacatatatgaatatggactgaactgatcgtggaaagcaagtaatatctgaagagaaaatatggaagagttaagctctatgcaagaaaaagagctggatgtataggagtaaacattttcttaattaaggcagggatggggcttgaactgtagtcctcaactactgcgcataatcgcatatgggaatgggatgtcgatctatatgcatgcaacctgaagaaactgaatttttgctgaagaggtcagatatttgtatggatgtctccctctcccatgagaaaccctgatgtatattatatgttgctcaaatgttctccatacagtaattattcagtaacctgtatagaaattgatgactatgcgattatttaactaataactggtagaagaagctcatattattagagtctgaatagatggaggtttggaggcattgcttgccgctgttattcaaatgtctggttgctgataaataacaggaaaggaagcttagaactgctgtataaatgaagtcagtgtgtggacatcttcagtgtagaattttaaccagagaatcttattagctaatacaagaaagaagaaagcttcatcaagaaatgaaggaagaatgacaagaaaatcttaccatagcattctggtccagctggaaaattttggctcataggatgttaatatcaagttgtctctgctcagtattacttgaatgtatactactcatctgcttttttattgaagtacaaaaggtattgtgacacctcctgattactggaaaaaaggagtcctctaaatcattttggatttaggttgagtgcctggtttgctcaaagagtattctgcctgatgacaagatgtgttgttcagttcgtgattgtgatgcaaagctgcataaggcttgttctgaaaaaggtgatggatgctgtcctcgacatgtacgcttctgaaaccaagttactgctatatttcagttgtttctcaatgttttctcattgcctgaaaaatgaagcagattgaaatatccatatgtacataactgagacttttgacacatctcagccctacataatagcaatcaataattacagtttattgataaagagaaactgagagtttcaaattgcatatgtgtgtcaaccacttatccttatctgcatatgttgcttatttaataaaggggttaatacaagagttggatattggctgatcagagaatgtggatgtaacttgaaaccttaaaccattggcatgtatagctgcaaatttaatgtttcatcgtttcctcaccatgaccaggcgttaaaatgattttgcacttagtgaagattaattagtaatgtcatgagaatagagtgcctcattgaaaacgccatcctactatttatgagtttgcttactatatgttgcaaaagattactgggttgacttagagtttttcttaaatccttatttaaaatattaagaatttaatacctgtacctgctttgtttctattaacattacttgattctctgttagatgtctttatttctgcaatttttttctgtcttttgatggtaatttcattgatatcgtgatatcttgctaattacaggatgcaggtccaacagatggtatagaggtgatctatacttccttttcataggtctcatctgtattattgaacactacaacctatctatatgtgtaaggtgcatcacctattctttaaagttggctgcttagatgtgactgagtctgatgcatagcattatgttagatcacatgtttttgtttcacttgctcagtgaagaattttattagttgctaacttgatttttgaaaaatgatttgattctttactcattctatatgtgcttgtttgaatctgtgatgatttgtttcgtggaaacaaattgaaggataaaatgtgacagcaatggatgtctttctagtttttcagttcagtattttgtttctacaatttttctttgatgtgtgctctgattgatttacaggaagccttccggcgcttacccctcccacacactttccaagagttcaacattgaccctataaagaaagaggaattggacaatgggacagaaccacctccatatgtacacatgaagcgtagtatccttttattgcttgtaatttaaaatatgcacctttttctatttacaggtagctctatttagtgtaaaaggagtttatgcttatccagtttttactccttttgctttgagtgcttcaacaactattgttcccttaatgaactaagatctttatcttgtcaagaacaaatgtgatgatgattccattgaaggtggatgcactaattgtctccctgattttacctgtaaattaagctgttcatgcaggtacaaagtatccattccatttattatgtgcagcttatcagactttctcctgttgctcattggatatagtgttttctcttatgctcattggccataaatgtatgtggatttaaaaagaaaatatatattttttatttttttacagaaaattaagataattcctacaggtctctattggttagctgctctcgggcttgtcactgctcagatgagtgcactaacaaaccatttcgccgacagaaaaagattgagatcgttaaggtaaggcttgtcatggactgctgagtttttggagggcagttaagttccatagttgtcttggtgatattgatacatgtaaggatcttttcctaaagtactaatgctgcccttttctttatgtgttcttatgctgtgcttgattgtgctttggagatctgattttgaaattattttctgtcactattgtttctctttgacaacctacttattagtggaatacttctgcagacacaatattgtggatggggatctagagcactggaagccattgagaaagatgattttgtcatagaatttgttggagaaggtataagatattcattatttggtttgcttagacattttattgtaatttattcagatcactgcttcttcttacttatgcttttgtggactattttatcaaaggattttacatatgttaaacctgttaaattactttcatagggcagtactgaaggaacttgcctgaaaactttttagctctgcttacttttgtttattgcagaacaatagttctacctttcgtacctgccaactttcccaatttacctatctagatgatttggtagaaacacactaataactgggctttgttttctccccgaaaaaaaaactattaccaggacaaagttagatctattttagcttattttccaacttaatattggaatacctttttccacatgataatgtatatttcagcatagtttgatgttccatactattgcctctgtaacacttttttatgcagtgctaagatatgccctttgtttgttgtttattatagcagtctatcggttaattgtatatgatatttaaacttacctttttatccttgctcctttctggctgctaataattaaattaatgttatatggtcatgcgtcatgaatcgttttaaaaccagatctaccaggcaaacctgttactgttaagtaaaacatagtataatccagttaacaattataacttgctgagttatcggtataatcacctaacaggccatttgcaaggttagtgtagttaagcctcacttgtcaagctcatttatggcttatactccctccgtttctaaatatttgacgccgttgactttttaaaacatgtt

SEQ ID NO: 74556 - DNA, 15087 bp, Oryza sativa
atttgtgatgaattttgtagaagttgtgatgtaattttttaaagattttgttatgtatttagagattgatttgagaatttagagactattcggggatgattgatttgggattttgggatgagatagagtgaatcaatatattaaaaacaatgaagaaaagaatagaataaagtagcagcctgagctagcctctttagtctagaaatggatttttactcccggtttttttcacccgggactaaagatagcgatctttagtcccgaattcatagtcccggttagaaaaccgggactacatgggggttacgaactgggagtaaagcccctttctccaccagtgaaataaaactattccttaaggaacatttgccaactaacaaaatttgctatgttgttttcaaagataaccctattttggtgtgcactggactatgggggcatcctgctaaagctggaggagtgctctgtaattgctatgttgttttcatatgttggcagcggttggtccgagcttgttttctcctgatcactttgcaagtcgagctcagtgtcaggacgaaagttcgtctcgccttgatactcgtccatggacacttggtcatgggactctgcttgctcatcactcgacgcgcactcgttggacgtgcatgttgacggtcattattgatcagtttcgaccgtcaatattactaaaatagaggagaactagtgatgcttgcaatgcatatatttgttagaataataatattccagtagtattaggtatactaaccttttgcagagaatgacaataaagtggaggagaatcgatatcaactcaggcgataaatcaatcggacgatgtcgagaatcagacttatgcatgaataggccaagaactcagaattaacacgtcaaattgggtcccaaaattcacaagtctacataaagtagcaacagaggaggccgccagccgaaaggtgggctggttgggccgggcctaacctccctcgcctccgttggatccaggttttggctggacggttgagatgaagccccaatgatggttggagggtattaccgaccattccaaccgtcacaaccatcatagttcagctgtaaaaggagctcctcttctcacttcactcacacacctcaagcaatagctctctcatttctttcaaatttagtttagtagtatctagctggtggaataggaatagaatagaaatcaggagtccggaagccttcagaagagttcgggtatggttctagtagctttcctcttctcttttgtaagctttgtacttttattataatactcttctatatacatttatggtattgaaataatttccgagtatatgaatgcctactttacattatgttcatgttatactgaatatacggcaagcttctctgggagaagctttggtgcgggtataatgtttgcacatgcaattactctatgtcatgacgataatattagagtagtatctggtagtttagacgtggtgtctagattacgggatatcattattcggggttatatattgcggatgagaggcgggctgctgatggtgacagctcagtacaagtattcctccgcgtcagtatataatcctaagttaattccctggggagggtattcctccgtatttagccccggttgtatggtcatgacgggttgtcgtaaggaactcggcagtcaggggtggcttctcgaagtaccgggagggcatcggatagagggtattagctagtatatcggttaactagaatgtatgtatactatgtatattataagtatatgaatagattttctttctcttttctttccacttagcttagataatatattatgagaataagtagttaatgcttgtgtgtcactctacccttggattatttttaacccctgcttagaatatgattatcacaagtaatatataaattattagtcaagttctctctacatgatcttcccacgggataaaataaatacgataccttagaatactctcgggtgaaatgctacgatgatatatccatgtgcttgcagatgaactctgtaaccataatataccaggagtattttcgcaccattgttgggaattatatttctagtaatgttgttaagaaataccaacaagcatttttggcgccgttgcggggaagattcataatagagattacctgaactaatactttatatttacctctatataatcattttcctttgcaggctaaccttggttgttttcactttttattgtgaaaacagggtagtgcatgactagtttcaacttgccggaaaactttaaagaaaatccagaagctttcttctggagcgtcagtccgcgagtcgctgctccgcagaaaaatctaccgacagagaaaccagtcgtaccagcgccaccaaccttcaagactatggctaacaagactctccgcgagttcgctgctccctttgctgacaatgtggccattgggccgcagatcaacatgggagacgtggattttgacttgaagtccagcctcatcataatggcgcaggctagcccattctgtggcaagcctaatgaggatgccaatgctcatctgcaacagttcctggagatctatagcatgtacaccatcaagggcgtcagtcccaacgccgtcaggctgtggctgtttccgttctcctttctcgggagagcgaagcagtggttctatgccaatcgtgctgctgtcaatacctgggacaaatgctctacggcattcctctcgaaattcttcccgatgggcaaaaccaatgcccttcgtggaaggatttcaagtttctagcagacaagggacgagtctattccggaagcatgggaacgactgcaggagtatgtagccgcctgtcctcatcatgggatggacgactggctgatcctgcagaacttttataatagactcaccccgatgtcccgcgatcacctagacgcggtagctggaggagctttcttctctaaaacggttcaaggagccgttgatttaatagagaagatggtctcaaatatgggttggagcgaggaacgactccagacccgtcagcaaggcatgcacaccgtcaaagagacggaattacttgctgccaagctggacttcctcatgaagcgattggacgaccacaagaaacggccacaaggcaccgtcaaggccttagactctcacgtcacgtgtgaggtctgcggcggcacgggtcattctgggaatgactgcccggaaacctgtgaggaggcgatgtacatgggcaacaacaacgggtaccgtccacaaggaggtcagcggtggagccaaccacatccatattatcaaggaggtaacaacaacggtaacttttctaaccagccctcttcgagggatctagtttttacataggctaaaaccactgatgcgctaagcaaaaagcttgcagccaataacaagatcctagaaaacataaatgtcaaattagatggctttgcttctacttttttcgcgctgtgatgcaccccatctcccaaagtgttgaccctaccgagcactggggatctgggtggaggctataattcaatagtggtgtcattgcccttgcctactttatcttacgtgagcaaagaaagtttaggggacaaggcgaatatgaagttgtatgtaaaaaataaaatcattaaaataattgattcgatagtgtcaaattgatttaacagtccaatatgatttaggtgccattgaaactagtgacacttttagtactcccttcgtcccaaaataaacgcatatatgaggaaactgggtttcctgttcaactttaatcgttcgtcttatttaaaaaaatagattggaatttgtattgatattagattataaaatatgaatagtgttttatgcttgacttatgtttttatttttttaaaaaaataaataagataaacaattaaagctggacacgaaaactcatggctgcgcttattttgggacggatggagtaattaatctactcccttcaacccacaatatagtattctagttacctccaacccacaatatagtattttataactagatgagacatcatctgaaattacatatgtgatgtacccacttcgtcccataaaaaaacaacttagtaccggatatgacgcatcctatcacaatttgaattgatgcccgtgcatatacatagtattaggatgtgtcacatcttatcctaaatttattttttattggacatggaagtatgtgaataggctttaccattctactatggccttgtttagttcccacgtaaaaacatttcactatgtcacatcgaatgtttggacacatgtatgaagtattaaatatagacaaaaataaaaactaattatacagattgcgtgtaaattgcgagacgaatcttctaaacctaattgctccatgatttgacaatgtggtgctacagcaaacattttctaatgacatattaattaggcttaataaattcgtctcgcagtttacagcaaatttgtaatttgttttgttattagtatacgtttaatacttcaaacgtgtgtccgtatatccgatgtgacacactaaaacttttcacccctggatctaaacatagcctatgtatgtagacagatctgtccatatatgtagtactccctccgtccctaaatataagggattttggtttcatatgacataagtctatttagattcgttgtattagtatatgtcacatctcaccaaaatcttttatatttaggaacagagggagtattagattatatcgagttgacatgtgacagagagagtacaatagtggcattttaatgtttactctatctgtcatatatatgatacattctaataatatgaatctatatatatctctggctgtgtttagttcagcgcaaagtttgaattttggttgaaattggagatgatgtgactgaaaaattgtgtgtgtatgacaggttgatgtgatggaaaaggactgaaaatttgttatactagaatgtatcatatccgatccaaggtttttttttaatggagggagtagttcagtaattgaggccatctaaaccagagggtagggtggattgaaatcctctgccttcaaagacacaatgtctttgtcactgacagatagccccatagtttattgggcccacatgccagtgacaaaggtagtgtttagattcagggactaaaaactaattacatgaatgagagctaattcacgtgacaatttttaagcctaattaatccataattaatacatgtttactgtagcatcatatatgctaatcatggattaattaatcccaatagattcgtctcgtaaattagttcagagttatgaaatgagttttatcaatagtctatgtttaatacttctaattagcgtcaaacatcgatgtgaaagagaaacaatttttagtttcatccgaacagccccaaatgcacataaatttgaagttaggctgtgttcgcatgagtgggatggaaacttgttagctccgctcgaaaaatgaagcgatccattagcacgtaattaattaagtattagctaatttttttaaaaaaaatggattattttaatttttcaaagcaactttcgtatataaactttttttaaaaaaaacacaacgtttagcagtttgaaaaacgtgcatgtaaaaaagagaaagaggggttggtaacaagggttgcaaacacaggcttagagtagcctgatccgttcttgtcagtcttccccttccccagctctccatcgaatcgtagcttgttgaaggtggaagatggaggccgcgcttctgagcggattcatcaaggccatcctgccgaggctcttctccctcgtcaacgacaagctcaatctgcacaagggcgtcaagggcgacatcgatttcctcatcaaggagctccgcatgatcgtcggcgccatcgacgacgacctctccgtcgaacatggcgccgccgccgccgccgccgccgtatctccatcgaatcgtagcttgttgaaggtggaagatggaggccgcgcttctgagcggattcatcaaggccatcctgccgaggctcttctccctcgtcaacgacaagctcaatctgcacaagggcgtcaagggcgacatcgatttcctcatcaaggagctccgcatgatcgtcggcgccatcgacgacgacctctccgtcgaacatggcgccgccgccgccgccgccgccgtacagacgctatgcatggaggacctccgcgagctcgcccacggcatcgaggactgcatcgacggcgtcctgtaccgcgccgccagggagcagcggcgctcttcgtcgcttctcccccgcacggtccgggcaaccaagaagttgctacagacaaaccagcatctggcccaggagttgcagcggctgaagaggatggtggaggaggcgaaccagcggaagcagaggtacacggcggcggcgcccggtcaacacggtcaggtctactcatcggctgcggcgcaggtggatgagccgtggccgtcgtgctcatctgcctcagatccgcgcatccacgaggcggacctggtcggcgtcgacgcggaccgggcggagctccttgagcagctggcggagcggcagccggagcagctcaaggtgatcgccatcgtcgggttctgcgggctggggaagaccgccctcgccgcggaggcgtacaaccgagagacccgcggcgggagattcgagaggcacgcgtgggtttgcgccgcgcaccggagtgcacgggaggtgctcggcgaattgctccgcaggattgacgccgcttgccatggggactccgatgctggccagctgtgtgtagatatcagacaacagttggagaagaagaggtgaaaaatctcaactttctgcttgaattgcctgatccatttttcacatgaatttgaggtcaacattttagtcaactcgcctgttcttttgcacaagttcagtgcgactgacactttcaatagcaaagtgaatcatgaacagatactatatcttgctaactgctaggtgttagctgcactaatttagtcatcaaatgcatacagtgcatttctcatgcgctttatcttttacaaatttactataatagaataaaaatggaaaaaacaattcactgcttctaaattgctctaccgtatgaaattatacaaattattcgtttcaatttgttgattactgtggctccagatggggatgtttacaattattctttcttgatctgcctcgtcttgcaggtacttcattgttatcgatgacattcaaacagaagatcagtggaaaagcatcaaatcggcttttccgactgataaggatattggcagcagaatagtggtcacgacgaccatccagtcagtagctaatgcctgctgttctgcgaatgggtatttgcacaaaatgagcaggcttgataagaactgctcaaagcaattgttgtccaagaaagcttgcccagagaggtattcacattacaagcagccagattcagcagcaattttgaagaaatgtgatggccagccacttgctcttgttaccataggtgaattcctgcaagctaatggctggccaacggggcctaactgtgaagatctctgcaatcggctacattatcacctagagaatgataaaacacttgaaaggatgcggcgagtgctggtccgcaactacactagtctacctggccatgctctcaaggcctgcttactatattttggtatgttcccatctgatcatccaatcaggaggaaaagtctgttgaggcgatggctggccgagggatttgtagaaccagtgtcttcatctagtaacctagattccacggctgctttcgatgtgctaatggaccggaacattattgagcccatcaatgtaagcaataatgataaagtcaagacatgccaaacgtacggtatgatgcgtgaattcatatcgcatatgtcaatctctcagaactttgtcacctttttctgtgatgacaagttcctgcccaaatatgttcgtcggctttctctccatggtgacactgttgtgaatggcgataacttcaacggtattgatttatcacttgtacggtctctggtagtctttggggaggcaggtacaactgtattagacttcagcaagtatcaattgctgcgagttttagatcttgaaaaatgtgatgatttgaacgatgatcatctcaaagaaatatgcaatctggtgcttctgaaatatctgagccttgggggtaatatctccaaacttccaaaggatattgccaaattgaaagatttggaggcactcgatgtaaggagatcgaaagtaaagataatgccggtagaagtcttcgggttgccatgcctaattcatctgcttggaaaatttaagctctcagataaagtcaagcagaagactgaagtgcaagagtttctctcgaaaggaaaaagcaacttgcagacgctagcaggatttgctagcaacggaagcgaagggtttctgcatcttatgaggtacatgaataagttgagaaagttgaagatttggtgtacgtcgtctgcaggtagcaccgattggactgatcttagggaggccattcaacagttcattctggatgaaaaggaagcaaatattggtacccgttctttatcgcttcatttcactggatgctctgaagatgcgataaattccttaaaagaaccctgctacctcagctcgttgaaattacatggcaacttcccccaattgcctcagtttgttacatcacttcgtggtctcaaggagctttgcctttcatctactaaatttacaacaggccttcttgaagccttgagtaatttgagctacttgcagtatctcaaactggttgccgatgaacttgagaagttcatcataaaagttcaggggttccccaggctgctatgcctttgtattgtgctacaatgtccaacattcccagtaattgaagaaggagctctgccatttcttgtcacacttcagctgctatgcaaagatctacatggcctttctgacatcaaaattgaatgttttaaacatcttcaggaggtaactcttcattctggagtcactccagctacaagacaggaatgggtaaaggctgctaaggagcatccgaataggccaaaagtattgcttctcaaatctgttgatacagcagaaagtgaacatacagacgttgatagtgtaatggaggcagtcaaaagtgagactacagaatattctattgcaccagagggaccagaacaagtgattgacatgaacaacaaaatgcaacttgaccatggattggaatcctcttctgtgctgaacaaacaaaacaattttgcagaccaatcaagctcaaaagatcaactgcattattctttcaacaatatggggctttcagatgtctctcctgctgtgagtgagctgccgaatggcatggtgccttcttgtacatgacaaggatctagaatcttcacgtggcttcccggtcagttatttggacctgttgctttctgattgtgcattttgtgtttacttgtccttcacacaatcatcgtcatcaaaatacctttgatttcctacactccctgttacctcccttgatgaaatcagggggattcatgggcacagctacatgttctgtctgcattttgtatagtgacgtggcatacctagtacttgttttgtctccatcctgtttggcagagcaacaggttgtaataaatcttggttctaactggctgccctcagaatatgttgtctatagaatccacctgatagggaattcggccgtttgataatcctttatttttaagtctattgtttgtcctgagtatatttatgatggttttggtttgaggagcgcagtgaaatcatgatggaatggcctagtatgggatgatgctttgatggatggaatgatttgacgaatggaatggttttgcactttgtttggttcaaaaaaatgacaacattgaatgtgaacacaaatacaaaatttgttaaaaaaacgaagcatgaggtgcggagtgttatagcaacgagagttcagttccctgttgtatcatcaaagaggaattgaataaaacttataattttctgtgtcgaacacatgattggagagtggaaacaatgttttctccaatattttgttatatcatgattacaagtacaaaaggagatggaatctgtaagaacatttatttcgagatgagaatctctttcataggatcttatttcttgtagctaagaagcataaatgataaggctcatacatctcggttgctccagtgcctctcccaaactgacgaccatgttggaaagggagagatctggtattttaaataggatgttagaaccagaacaatgtcaatgcaattatacatttttagcttgaattatagccataccttgtctacaagggagtatggtgctcctcaactgagcatattgacaatttcccctatagaaggcctgtccttccggttggtctgaacacagctcagtccaatttcaatgcatgtctttacctgctggaggcaatttgtgtctaacgatgggtacttcagtgatatatgcacaatattggtccgatttcggcgtacctataaacaacgacagcacacaaacttatatataacattattctaaaagaactccttagtatgaaaacagtaaatttgttctaaaactggtacagtcattatttttgccttacattctcaatgaagttcttagcaatgatgtcctctctattggggaagtttttctcccctgttgtgatctcgataattagaagacctaaactgtatatatctgattgagtggagatttcacctcgatataaatattccggtgccatgtatcctctgtataatatcagcatcaatagttggaggattatgtgactaatgcaaatgaaattcaccttgtaggaaaactacaaaacaatagacattggaatgtgtttggtgacttacattgctcccatgacattttgtgtgcaaactctggtttgttcttcacccaagagccttgatagaccaaaatctgcaatttttggcaccatgttgtcatccaatagtatgttgctaggtttaatatccaaatgaataataggtctttctgatcctttgtgtaggaaatgcaaaccctcacaaacccccttaattatattgaagcgtgtgtgccaatcaagtcgacttgattcacctgaagaagcaattatggaaaacaaataacattaggattaatcgtattacttactaattgccaaaaaacacaaggaattttcatgagcccacaacctagtgagagcttgatcttcttacctttttgacttattgtatacttcagtagaacctagagtaggctacatcatgctaatatctaaatcttgtaaacattgcaaacagggaaaatgactggaaatatttaggtattgcattatcataccgaaaaggtgtttgtcaaggcttccattagatatatattcatagcacagcagtttttctactgcctctgtaagaatatattttccattatgctccaccaccttcttttgtatttcataacagtagccaattaacttgactatatttctgtggttgaccttcataagactcccaacctcatttttaaattgattgtcatgaatcggtgatgtttcccgaagcttcttcgcagcaatttctgtcccatctttaagcattccctgttaagtcccccatacaaaattgacatcttttctgtgaacttttgaaaatgctgagaataagggcctgttcagattgtagccaaaataaaccttacaaaattttggtaagatggcaatattgccaaaattttggcaggatttcttatgtatttaccaaatttggcaacaaacattcattttttagcaactttgcaaaaaaaaaaatgtgtggctgaaaatggcatcaaagtgaacaggccctaaaactacaaaaatcttaccttatacactattccaaatgcaccttcaccaacttttcgctcatcagagaactcattagtgatttccttcagaaattgtgatgatagctcaggtgtcggtatttccatttctgattattgagcactaacccaataatagaaaactagagtcacaagcaaaataacacaaagctaagaaaacagagaaaaaaattacaattgtttgagacatagaaatatatgatttctcagtattatgtgaaagctgcttctgagtacccttcatgcttcagtagtcagtatggcttttctgatattgttgctagctggtgtttcgtagttcataaatattagtctcacagatattgaacagaaacaacttttgaatgcactagcattgagtagtcagtatggcttttgtgatatattgttgctaactggtgtttcataattcatattactgttattcaaactaacaagctttcaaattcaaataaaaacaagggtttctcacatactgagtcaggatgagctttcctcaaaacacacacacacatggacatacctaaagaagtaaagaacggtgtaatgtttcttagcctttgaacagaagcagcttttgaatgcactaacctggagaagctttgcagctgcagaggtgctagctgctgctcacacaacaaccaaaggacgcagcagggcagaggagatgaacggatttcttctccagggaagagaaggggggggggggggtgtgaatactgggtaagcaggagctgaaatgaagcatcagcagtacaacttggcaatagttgacttgactccaatattagatggatgtgaaatggtgaatatgatatgcctggtgtattttatgagtatacagacaagttgtttagtcaatggtcaatgatggttccattaagaggctgtgtttagttcatcgcaaagtttggattttggttgaaattggagatgatgtgactgaaaagttgtgtgtatgacaggttaatgtgatggaaaaggactgaagtttagatctaaacacagccagagtttagtggcacttaagttttggatatgatgtcctattgtcgtgacagcacatgctacaattactattttttagggggtggggtggggggtggggttgttgttgttgttatcatgttccatatgcgttaatgaattaaaaaggtgccatgttattttttctaccgaaaacctgaaatgtggagccgattttgatgtataaatttatgaaattttgattataaatagtatgatgaactgtactatatgaactaaataaacttctccctttgttcataaatacacaatgtttgatttattttatagttttaaaaatacaactttggccataattatatattagaatatgtttatataaactagtaaattcatgatatctgacactactttttgtgacgacttcacacgtgtaagctgatgatcttcttatcaattggggatcctaccgagtcattagagaagaagaatggggtccaaaatgaaacacaaggaaaaaaaattgatggtataaagtgaaaagattagttaaggtggtgtttggattcagtgacttactttagtctctgtatttagacactaatttagagtattaaatatagactatttataaaactaattacataaatgaaagctaatttgcgagacaaattttttaagcctaattaatccataattagagaatatttactgtagcatcacataggttaatcatggattaattaggctcaatagattcgtctcgcgaattagtccaagattatggatgggttttattaatatactacatttaatatttataattagtgtccaaatatccgatgtgatagggactaaaagttttagtcccatctaaacagggtataagacgtattccaaattaaaactttggtaaccattctgcaatttactttagaacttcctgatgttcgaagttgtaaaagtttgaccaaatcttatcaaacattgaaatatttataatcaaatggagttgcactaagactaagtatgtatttatagtactttctccatcccataatatgacaatctagtattggatcagaaataatatttcatagtacaacgaattcggatatgctttttatctagattcgttcggatatgctttttatctagattcgttgtactatgaagtactccctccgtcctaaaaaaagagaaaccctaggtttcagtgtccaacgtttgactgtccgtcttatatgaattttttttataattagtattttcattgttgttagatgataaaacatgattaatactttatgcgtgacttgtctttttaatttttttcataattttttaaaacaagacggacggtcaaatgttggtcacggaaacccatgtttgtttttttagaacggagggagtatttcattatattagattgctgtactacgggacggtgggagtaggttttaggggtactacgaaaggcttccagttcagcacagttgctagctgacaaatcaaagggttcttgctccatgaagggagatgttgcaagttgcaacagtgggtttcagactgagcagcacagggaagctcacacgctggggacaccacacaccccacgggccatggttttctagtcttcttctgcagggatgtggattccgggtcaatggccaagccaacctgcgagctcctgctcgagagtagccgtagtaatcagttcccaagggaagtcaacggagtcatcgaggcgacgaggtgggattaatttgtttatggcgcgaggcaaggaaacaaagggcgcgaacgcgtgagaatcttgtgctccgatctagtagtagtagtatcagcttgtttgcgaggacccaagcgaggtcaaaggaggggggaggccgccattggagaggctcgctctgcatcgttgccaggtacgtacgggcgcgacgaatgcttgatcttcttggttgcctaaccatcgatttttttctttgttgatttgttttggttggattgatctgtcgcttatattgcgcccgcagtgtgcttgattgagctgctcgtttccatttctgctgaaatggagatgaaactgtaggaaaaaaaaaaaag

SEQ ID NO: 74557 - DNA, 21085 bp, Oryza sativa
ctcaaaatcccttatattgtgggacggagggagtaacaaacacccatggaaattaaagatgccattgaaaacaaagatcttcttttggtatttccgttacaaggggtagaacgatcttcctttggtatttccattacaaggggtagaactgacaaatgatgacaattaatctatctaagcgaaattgacgatgcaatatgaaatcgttagttctattgacgcaactattacttactgctcgctatggctatgcgtgaaagatatatttttctgataagaaaaaaaatcatcttctttaatataggctatctacttacttatccaatagcttcgtacatgggtctttatccttcaaaagacgccggatttacatgacttggttgcagttccctgtcaacaattggttggagcaggtggatccatggttatgggtggtggtctaatctcttcgatcagattgatggtccttaatattagtacttcttttgagttcattttcataactgtttgtttctttttgggttgtgtatatcttagctatacagaggctagatgtattttcacgactatatcatcttgatatagttatcttgaattcaataaaagcttcctttataagaagaaaaggagtgcctgcatttcactctacttttgttaccagacaccattttggtggttcctttctagcaacaaatttataaacacttagaaatagactataatacttcatattgaagtatgtcacgtggtaattacacactttttatatataactaggaaggtggcccgcgcgtatgcgcgggcacttatattattgaaaggtaagattattgtttgttcaaaaattttgtctcatagatttagggcaaactaaagtttggataattttattttataataatttaagggttctatttttcttaaggtatcttagaaaaccattcacgaacttttgagtaggagatgggtttagtacttacaacttttaaatcatgttttttttctcgagtaaataagaaactattggtagttaattatcatacagtccatctatatacataccgtgtagtatggccgcaaatgaaaaatgcgagtgcaagaattcaaaactcttttgattaaatcatctcatgaaggcgtatgatatagtaataaagggagggaagcatatgcatgggaaaaaagaagaaagagaaaaatgaaaaaaagggaggggatgcgtacgaacccgcgcacgtaggtgcgcacctatgctgaggtgggaccccgtaatatttagtttgttctaagatcaatttaatctaacggtttataatattggacctaccgatttaagtgaaaattaagtaatagataattttattttttttcttagaatttctaatatttgccctaatttattagagcaccacgcggcagtttgagagcattttaaggaattttaaatgactaattagaatattaactgcgcaatatatatgtatgggacatatggtaatatttgttccagcttcgtccttgtttatataaatgtagagagaaattaattttgtggctagcaagccattagatgtctaactaatagcaattaattttgacacctatttacaattgttcagagtaactcttatatattcatcttacgacttcgataatccattgatcaccaatttactaatcaccatgacttgcatgaaaaaaaaatatgtagtaaggtttaggatagctgaaattgatgaattatataatttatgtgatagctatttgagagtataaacgaatgaattgacttctaaaacgttaaaatgttgtttaaagaagacaccatttagaaacttagaaagcgtgcaaacaaaaatccaaaatatgcaatcgggaaaataattaatcgctgcatcacacctttaattttcttttcatgttattaataaaattaatcatctccatatatgatttgatatgtggcaaaacggtagcgctacatcggttgtgatcaccttagatgtctcagacactgcgctttgttacatgtgcgaaaggcaaaggtgcatacgtatattgtgcagcgagcaaaaagagaatttcggacgctttatttattagcaaacaatagatccgatgattataataatatgtccaccagttctagtgtaagtgtaaattagttaatatagattttaaatttttattttaatgggtacataatataatggtgtagaccttacattgaaacagtgcattacgtgagaataatagaccaatgtaataaaaagtagatccgatgatttatataatggggccatcagttttagtgcacgtataaattagttaatatagatattgtttatttgataggtacatgatataattgtgtaaaatttattttaaaatagtgcattatttgaaaatagtggtacaaagtaaaaaagtacaccggtttaagttatatgatggtagattatttgtttgtaaaattatgattaattatttaaaaatatatccattatatatataaatggaaaaaataagaaaaaaaagaaaaaaaggaaaaaaagggggggaaggaggcgtacgtatgtacgtacgtatatactacacctgccaatgtgtgagaagaggataggtgggaccatggtatttagtttgttttaagatcaattttatctaacggtgtataatattggacccaccaatttaagtgaaaattaagggatagatgttttgcttttttcttagaatttctaggattttctctattttattagcgcgccacgtggcggcttgagagcgtttataggaagtttcatggacttttagtatataatagatagaagatagatagatagataatagatagatagatagatagatagatagatagataatagatagatttaacaactttcaagttattggtagcctggaacaataacctggttgattctggcataatggtagaaagcttgcctcattaatttttgttggtggaaccaaattaagtagactataaacaactctaaatttttgagcttcggcagataagccataaaaaacaattaaagcaaccaaaaataagttataacaaaactttatatctatattattgacaataattaaaagccaagagtacaacccctcaagaatctactctaaggctgcgttcgtttgggtgatagggagtgagaatgcacatcgttttccacgcgcacgtttcccaaactactaaatggtgtgttttttgcaaaaattttctatatgaaagttgctttaaaaaatcatattaatccatttttaaaatttaaaatagttaatactcaattaatcatgagttaatggttcacctcgttttgcgtatattcccaatctccttaatccccttctcctcaaacacaccctaatatttcaatttttggttgtgactaataagccaataagcaaattattagctagtttggacaaaccacgttatcaaaaatgaaaatcgtactagtaataagttttactccctccaaatttaaataattatcaccaaactccatccattttcaaaattttactactcgtctactccaacacaatagtaataattaaaaaggatgaactttcattcatcgtaatttttattttgcgattacacagcacaagcgcacacacacatgcaacactatactggcatacatccgtgaatgtgtcccctataacacgctctctaagagttaaaaacccaatgactcaaatttgaataattatcaccaaactcgattcatctttgaacttttaccagttgtctattccaacacaatagaaataattaaaaaggataaacttccgttcatcataatcttattgtttaagagttattagtggtcaaaattaaaatagatagtactacagtcaagatcgataattatttgaaaacgtagggagtaataattataaaattaacctgtaaaagttttgatattataaaagaaagcgtgaagaacgtacgagtactgttagaactaatggaagaaataaccccaatcacttctcgaaacgcatgtctctatatcaaattgatatgaactgaagagatattataatgttaggcgcagcgcaggcaggcatgcatgcttgcatcttaaactaagttgggcttatttggtttactattatgccaaaatataggtatgtagattttgatagtgccaaatcttttgacgtcttattgacacattttggtaacaaactaaacactagccaaactattatttaaaataacaacaatttgataggatatattttggcatcaaacaaaaatggtcctttatcagtcatcgcccttgttgttttgacagtgcagtggtaaaagtcccgtatttaattaccaatacacttacagttttcttaagaaaatgtttggagaggcggccctccctctgcatcttgttttatcagtcatcgccctcgttctccacgccgcgttgatcaacagtccgctcgtacgagtacgacggcgacgcaaaagctgccgcggccgtcgctgttcatggagttcgtgcgcgctcgctctcctcctcgcggggcaaaatgatcgagcaaaacacgcatatcgagtgcttttccgccatgcaaacaatgcatcaaacccccgtgtgggtaaggataattccggacgacgacgcccctgtacaacagcaatggccgtgactgtacgtgattgggttgtgatggatccaataattaggcatttaatcgccggggcatacctgtccgtcgtccgatataggactactactatagctcgcatttgatccggtgtgtgtggatcaatggcgcgtacgtgcacgcaggcaccagtgctatagcttctgcttctgctgctgcttgcttgcatgcaatgcacattgctcacacagcctcgcactgtttgggagggggcaagcaaccttaatgcatgccaagaaccgaactgggctgaaaactttaagggaacccctgtgccggcacgtatgaatgtttcagactttcagaggagacgcatgcatgcgtatatgtctcatgccctgcatgatgatggcatttgcaggggctcgcagttgtcttcggcaagaacaaaatttaagagatgtggagtgaaaacgctaacgcttgcagcaggtgctgggcctgggcgtgcttgcctgggaacctacacggcaagtggaattttttttccttttgttggaacattttcttttaatgctgctggagcactattgctgcctctcttttgcagtgagcgcagttaatcgctgggaccaaagttgttcttgctctcttttatttccaccatttttttaggtttgggaataagatattctgcaagcacgaaaatgtgccttgtttgcagcctgcaggtcgagtaaaagcaaaaccaaccagacgttccagactgactcgttttcagaagatcaaaagaggctatcattgtttagtgggggcccaagaagaaagaaggcccagttcatatgttcagcaaaattaactggctacgatgcgtccgtccccctgtatcctgtactcatgtgagcagcagaagtgaattgatccgtagtactgtacactgtaaaagtgtactcgtaaacgtgaagtttggtcttttgcttctgggagaatcagtttggtttttttttactgcacgcatcttagttacgataagtactattttgtgctcagtggttcctgcagtcatgtgctgcttcaggctttcagctgtttcctgaaatcttgccccagggaaaacactagcagcaagattaaccactgcacatctggcgccatgcatccatctcgattagctgtcaacgctgtttgggccggcgagctccattcactgattgacctatacgtttctgtgtctcatttacagatttttacctgttacctgtagttgccgtactcgcgaacaggaaccacctcaatcttcatggtccggttgaacgagatctattgacgcttgacttgtctcaattagaagagtgatccccaaacgataccggagctttcaggcacaggggataataagggttggatgaagtaaaagcttacacgtcttgcgggctttctctcccaaagccgtttaattaaactcgtgaaaacgatggttttatccgtcgccgtcaccccgtggccggtacggtgaagatttgctccacccactttttcttcagaaaacaattaatacatgatttgctccaccccccaaccatcatattactttctctacctctgggagactcggactcgcggcgtttgttttctttcagcttcaaggagggggcgcgcggatagcaccggtgcaccggcatggacgctgaccacgagcgccggcgtcccgagcagggcgctctgaggaggccgcttttagccgacgacgaggtacgtgtgcttctgcttccccgcgcgcccccgtagcagcagtagtatgtactaccaccgacagcttcgctgccggcgccgcgcgcgagattgctcgttgcttcgaatcgcggagggctcgtgttcgcatcacccgcgctagccggccaccgcggccggtacgtcgcgcgcggctttcgcgtgtgccgcctgaattgggccgtgcacggtgcacccgcggcccgcggcgcccctcgttgtcgaacaacacatgatggatggtccacagaccacagcagaagcagctcctccactgtactatatggttgtagacttgtggccaccgcactgcagagtgcagaggagtctttccgtttatcgatttctgctctgctgaagattgcgaggtacaataggctggttaccttcgcattccaaatggggcttcgatgagaacaccaacttatttacttacgtggcaactgctttattgttctattttttggtcaaaatgagattggtactagtatacggcgactctgctttaaggttttgcttgctgtaatgcttgcaggcatcttcctcaaatcagagcctggtatctcaggaagatcggggacaagaggtggctgaggtgcagaaggttgagagctgctccaacaaggcactgataatcatcttgagtgagtgcctagccatacttgctcgacttgttcaaatcagcaatattgcaatatcgtcagatgaaaatgctgagaaaaaaaaagagttactgtagtactgatttgtctaaaaaaacataggtctgaaataaatatgtgtgcagtagcagtagtcatcagctatagtaggttagacaacgatcggattagactgattctcgagaaaagggaaacgtagattagagtctgattgaaaataatgatatgactatatgagacctggtcttatgcatgattggatcaaataaatgtcagattaccatgcgcggatatcctaggattacctttcaactttttccagagtgatgtttttcagccaacactactgtcttttcatatttttgccttttttttgtctacctctgtttacattcttgaactgccaattcgaactgaattatgtaagattctcaccagtcaacccatcctaactaacaggcctgcaattcttggaaatcactgccttctacggggtctacctgaacctgatagtgtatcttcaggacgttcttcatggcgacagtgcttcgaacgtggcgacggtcagttcttgggtcggaactgcctacctcatgcccatcctcggcgccgccgtcgccgactcttgctggggaaagtacacgacggtgttggccggcttctccatagctctcgtcgtaagcgatcttcccctgtaatgcacacgatctgcagaagcacaatggcgctctctgcttctctgacggacacaatccgaacacagggcatggtcaccatcaccgcgtcggccacgctgccgtctctgagaccgccgtcgtgcgggcagagcgcctactgcgtcccggcgacgctcagccagaagctggtcttcttcacgggcatatacctctgcgccctcgggatcggcggcgcgaaggccgtgctgatcgcgttcgggccggagcagctcgacgacgacgacggcggcggcaagaacgagcgggtgcgggagaggaaggcgtcctacttcagctggtactacgcggtggccaacgtgggcatgctcacggcggggacgatgctggtttggttcgaggacaacgtgagctgggggttcgggtacggcctgtgcgcgtcgttcgtcgcggtcgcggtcgtcgtcctcgccgcgacagcgcccatgtaccggatcctgcccccggcgggcagcccgttgaagagtgtgatccaagtgcttgtggcgttctctcacaaggctaaattgactttgccggacgatccaactgaactgtacgaggacgacggcgtcaagaactcgttgcagcatccggtgcacgaacgattagagcacaccaaccaattcaggtagtaatctaatatattctcatggagctaggtgaacaaccatggtctcagagactcgtccctttgcgatgcactaggtgtttggacaaggctgccattgtcagcgacgaggatctggaagacggcgacaggtggaggctgtgcacggtgtcccaggtggaggaggtcaagattctgctgcggttgatcccgatatggctcacgtcggcggtctacttcatcgcgaacacgcaggctcagaccacgttcgtgcagcagggcaccaagacggacggccggatcgcgcgcggcgcattctccgtcccggccgcgtcgctgtcgtccttccagatggcgttcgtcgccgtcttcgtcacgctctacaacagggccgtgatgcccgcggcgcgccggtgcctcggccgcgccgtggcgttcacgccgctgcagctcatggggttcggccacgcgacggcggtcgtcgcggtgggcgtggccgcgtgcaccgaggcgcgccggctgcacgcggccagggccggggcgcccgccatgggcatcgcgtggctgctgccgcagtacctcgtgatggccgcctccgacgcgtcgctcaccgtcgggcagctggagttcttctacgaccagtcgccggagacgatgcggagcgcgtcgacggcgttctacttcctcgccatatcgctcgggaacctgctcaactctcagctggtgactctggtggcgaaggtgaccgcggtatggggcaatgcagggtggtttccactggacttggatgacggtcacctggattacttcttcctgctcatcgtggccatcaccgcggtgaacttcgcagtttacgtcgccctcgccaagaactacacgccaaagaaggttaggtagggattatacttgacattcgcttgtgtcagaacaacagaaaaatgctttgacgacgggatgcagaacatgcgccggcgaaggggctcgacggccgtcgtcgtccgccactccgcgtcgagcacctgaaatggcaagtgaatggtcttgcaataaacagccataggagggccttatatgtaaagaaacatagtacataggcaaaaacatgggcctaattttaatgggccgatttggacagattgactatctgtgggctgtaccctcaatttgttgggccagcatggatcgacatcactggcagcgatccagatttgatgggccaagatgcgacgcaactttcgccggcgaactagacaagctgaattttgcgggggctccttgctagggggcttcctaacgggcgcgtgcacgctagctgcctatctggcgcagccgcgcacgtccctatttcacttctcagcgctaataacgctgattagtattgatgaccttaattagcgctaatgataattgttagtattagttttttttcaaaaaataatacataaatagaacttttaactcagatgtggaaaactttcaacccggatttgaaactttcaattcggatttaaaaactttcgacccagatttgaaaacttttatccaaatttgaaaactttcaactcagatttaaaaactttcgactcggatttgaaaactttcaagtcaagatttttttaaaacttttaactcatatttaaaaattttcaagtcaagatttaaatactttcaatctaatttttttttaaaaaaaaattcaacttatattttaaaactttcaaatctagatttgaaaactttcaactcggatttaaaaacttttaactaaagattcgaaaattttcaattcagatttaaaaactttcatctgaaaatttaaaacatttaactcaaatttgaaaaattttatctaaaaattcaaaaaatcaactcaaatcttaaaaattttctactcaaattcaaaactttcaactaaaatcaaagatgaaatattcaacttctaaaataaaaaaattgcgaaaaaaggcaaagagaaactaaaaaaacgcatacgtaggtttaggtttttcagaaaaaaaaaggacgtggacgccgtccgcgcgcatacgcgccagcgccgtgggccttatgggcctaaacgcgcgccgccaacgcgtacgcgcgaattagctctggcgccttgctagcgcgttcgcgctgatagcgagcactcccctcttttaagtcttattaactatctctattagttaatatacttaacactaataatagtaattaggaaatattctcgagattttttgggagattttttactaacagattgaaaactttttaagttagatttgaaaactttcaatttaagttttaaattttaaagtcaaattttgaaaactttcaacttagatttgaaaattttcaagttagatttgaaaactttcaacttagattcgaaaactttcaactcgagaatcgagattcgaaaactttcaaatccagatttaaaatttttgaaaacttttaatttgagattcgaaaactttcaactcgagattcgaaaactttcaactccagattcgaaaaatttgaaaactttcaaatcgagattttaaaactttcaactcgatatttgaaaatattcaagttcaaatttaaaaattttcaactcaaaattttaaaactttcaaactcaaaacgtgctaaagattaaaaataaaaaaaaagtgggaaaagacgaaaaaaatgggtaaaaaaagggaaaaaaagcgtaggcggaggcgcgcgcgccgagaattagcgatcgcgaaatttcgttctccgtatcgttgggctagaactgcccatcgtacctaagtacctatttcgttgatctattagaccgtaaaaatttgatctgacggtcaccagcaatcctcctccatagcagaagaagagcgcgcgggctcctacttttctcctcggccctcaccgccgctcgccggagctcccgtcgtgtttcccccacctaccctttttcagacatgcagttttacaggctggacgatctgaactacgtggagattcggcaaacctgcccatcaattttgacggggaggtgatgctgccgatctgatcaagcacgcagatcgggctattatctgttcaattctctcttcttcttttttaagggtatcagtacgagattgtgctatttcattaaaaatagagggaacaaagtataactcgtagggataaaaaaaaatgagaaatgtacaaaactgagaaggcctatacacaatttgatataaaatctcgtagcctccttgctcccgccatggtcctagttgttgcctcttcttttatttttttcataaggttaagggtcgcagtctccttgtgtttgaaaacccactgatttctttccttccagatctcctaaactattaaaataattagagtccgaaggcctttcttaagcacatactttatattggctagcatttcttaccaattttggacgctctggcatagagcctagtggcatgggtccagatgctcgtaagccaaacggcttagagcaggtacaattaacatattttaatgagataaacgacgagacagaagagcaacggactacagatctgtagcaagctacagcacggattataagacgtaatgtgtgtatgacatgtgggacaatatattaatagtatagtaagcaactattatatgaatagctattaaattggctgtagatgaattggagctaacagtgggctatactattaaactcttacccaatctcaaaaaacgaaggagaatcgagcagcggaacagtcttcacagagatttttccagagttacatgcgactagttctaaaaaagattaaaaagaatttgaacgcaacggtcggcggcaactacctcctagcaaagatcaaagaagatttcaggcttgcgggagttgcggcatcgtctggttggtgagggcgtgaggccacggcgcgcttttacgagtttcgtcaagcggaggttgttgagctcgatcgatcgctggtcaatctcgaccggcctaaactacttgaccgaggaaattcgccaccacctgctcttcccaagtttctttggagctctcgcgtcgtcctcccctgggggcggcacgggaggcggcgacccggccacccctctccctcccctcctccccctctgcttcgccgccgcccgagcggccgccggcaaagccggccggccgcaaggacggcagcggcggggcctctcgcgtcctctcttccgggcgggcagggggccgtcctaggtggagcggcggtgaccgctagatccggcccgctccggccggatctggcggggcagcgactggcggcggcgagggtggcggcaacggcggcggggagggcgacggcgatgtcaagggcgcatgacgctgggcggcggttgctgaaggcggcggggacggagttggccgatggcacggaggcggcggcctggtgctctcgtggcgacgacggcacgttacctggcggcgacggcggcggtaccccccagatccgggcctttcagctggagctgcagagtggcggcagttggcgacggcggcggcagtttggccggcggcagtttggtcggcggcagttggcgacgacgacgacgacggccggcggcagttggcgacgacgatgacgacggccggcggcagttggcgacgacaaggacgacggccggcggcagttggcgacggtctcggccggatctagataccggcggcagttggtgacgacggcggctgtgtggtgtcggcggcggcggcggcggcagtgggccggcggaaacgtggtggctgccgtgtcaactggcaacggtggtggaagccatggcgttgagatgctagctgctcggtggtggagggcgacggtgcagcaaaggttttgcggaggcggtggtgacgtcggcggcggggaaggagtcgggtgcgaggtggggatgatgacggcgaggtggttgggtgttcggcagcagcggctgtggtggtggtgaccgtgttcgcagtcaccggaggcatggcggcctcggttgactagccgagggcgtgggagacggtcgcatctggtcggcgcggcaccgttcggtggaggggtcggagaccggcttagcacagagaagtgcagccgatggcagcgcaggccagctcggcgcgagaggcacgggcggcggagatggaggccggcttggcgcgggaggcgcagccgatggagggaggccggattggcgcgagaggcgcgtccagtagaggaggccggcttagcgcagagaggcggccggcggtggaggaggcgacctaggtgtgaggaggagctgccggtgggtgtggcgcggtcttcggtgcacgaaggctggccggcgggggacgccggtgcaggggtcccacatgtcggcaaagcttgtgtggtggtagagcatcgtgcatcagtcgtggtttcgcaggggcgatctcgtctgtgccctttgttgatctagtggcggtcggtcacgcttagcggcggccgatccggtgctagccttctcctggtcgtgtgggtagtggtatattttttccttttcctagttacgactctccagggttgtaatcttataattttttcctgctctatcaatagaacttcgcaccgtctcgtgcgagtcgttcaaaaaaaaaaaatctcgaccggccttcacgtacgtatggccgaaagcgataactcgattagacgatagtaaatctcatcgaaatggtgagaataagctggacactaaggccctctttgtttaggcttataagccaacttataagtcgaaaagtttaagccaaaacaaacaagcagctttttcatttggctttttttgaagccataagccactctaacactattaagccaaaagctagattggagaagcttttttggcttatatgagatagatgtatgactccaccactaaacttaggacattaaatccactggcttataaattatataagccaataagttgatttaaaagtctaggccaataagcctaagcctaaacaaagagggcctaaggccttgtttagttattaaatttttttttcaaaaaatattacatcgaatctttggatacatacatatagcattaaatatatataaaaaactaattgcacagtttgcatgaaaatcacgagataaatcttttgagcctaattagtccatgattagccataagtgttacagtaacccgcatatgctaataacggattaattagacttaataaattcgtctcgcggtttccaggcgagttatgaaattagttttttccttcgtgtctaaaaactccttccgacatctggtcaaaacatatacccatttttttcacgaacgaaatacccattatttgcttctccacttctgactcgtccgtttatccacctaccatttcagacatgagatcttgggggtccatgtcatcagcatggcctgactgtttgggtgtagttgaatctgaatgcgtgaggacatttttgggaggacctggattcaggtattggttgatgttttggggccagactgtttggtaaaacaagactgattagtcatcgcattggataaattatatagaagggatgttgatcataagctttatttattttggtagattgattactacttgcgcctcaagcgtgattcaaattaagcagagaacagaagccgcacaataggacttcgccacgggtgataccatcggtgacggttgtgtgagttggcggggagagcagggtgtaggtgatcgtaacatttcttcagtcaaagcatcacgtgttcatgtgatctcactatataagtcttttgtccatcttactgaaagttctctaataacctgtcgattttactgaatctctcaacaaccacataataacggtgtcttgcaccaaacaaactgaaggatctctagcatagttgcatttccctgtgacgtcaatgtgttgggttttttttacagcaattcgagaagcgtgcatataaaaaatgagaaaatagaatatgagtgcttgtacttccaaagacagctttaggctgtgttgaacaggacatgttggtaactaatcttctctacacgtaaaatggaatggcttattagtacatgattaattaagtattagctaaaatgcttgaaaatggattgatataattttgtaatgcaacttttctattttttctataaaatatacactgtttagcagtttaaatatcgtgcacaataaaaatagggggggttagaaattggaaaaaggggagtatatatataccgcagccttagaagaggtagaaacaaatatggataagattcagacagaattaagcattttattcccttctgtgtttttttccatcttagttctacggtgagcagttgcagaccgcaaaagtgcaaaacatgtctagtttgtatgcacgctaaccgctaaggcatgcatgcatatggtcgattgttgaatgttgactgagctaaattctctcttatcactccgctttcattatcagcaataaatctgttaactttgcattgtccacaaacaaaagaacaacggtaacaaagcaatacatgagaaaatcgcgtggatttagaattgcgtgttgtcaagacaaacacttcattatttgcatattggataatcatattagatcaggttagaatggtgtaacaaaattcagaaagaccgcttcacgtttataacgcgtacctgaactatccaaccagacactatattgtttgtttattgtcagaggaaatggaggaatggaacgcgtcagttatgacaaagatgaagcaactgtgtcgaacacctagtaccgtgtccgaagaaccagcagagttacggtgcatgctactatgaaaagagcaaattgaagcagtaaacagtgacagcgacttaggattgctcgtgcagttgcttggtttttccttgctgatagtgaatgtaggtgaagaacaaaaactctttccgaagaggtctcgctgtctcacctgtcttcttgtagtttgactgttattctgagcagctgatgtaatttcaagtagtagtggataagtgccctgcgtgcacattttaatcccgctggaccgttcatgcttgtacagaaattccctctctctttttttaacaaagggagggaattccgaccttgcaggtagccaccttaaagattgagcacatttcctgaccaaattacagtgtttgttctgaactctgaagttcagtggtggtacctaaacgtgatcgcaaagaacaagaaacctgaaacttacaagaaaaatggaaaagtacccaccacatgccgaattatctttgacggatcttccacagataaccttgatacggtttcttcagttttctccagcacgggtcaaagacactgaactgaatcttcttctgacagtgaagcagggaacaccacattaagccgagacgcatctttccgtagatagccgccgaggtaaattcggcacgtttcagaatccagctagaagattgggtgcagcaaattctcgatagatagttgttgccacggcggcacgccgtcctcaaaaaggcgcagatcgcactccggacaaaagtgcagtagtagtctccttcaggagccaagactaatcggagcagctgctagcctgccacagccagccttcgcagcccgcgaccagcacagctcggaaatttcccgcacgtctcgcgaccaaaaaccattacgaccaactgcttgcttctcgatctttaattaattctgcagtggactagtattttacgcatgtgcgcgctaaaatagagcaatgaaaccgtgcaaggaaagcataaatgcgtaatagtagtataatacaatttgcgttcacctaaaaacgcagagatttgaattgatctcgcgctgatattttttatttttctcactggggtgggtagatggtgactgcggccagggcgcttacctgttctctccatctctctcgcgggaagcgtatataagctgccctgcttgccgctcatttccatctctcgtgctcagctcgcagccaaaaaccccaaggcgctctcacgacggcaggagctagcttagctgcagaaaaagcaggtgacgttgaattctgatttctgaacgagttgcagcagcatagcgacaatggacgccggcgacgccatggagagaggccagcagcggctgccagaggtaagcatatgcacaacttcacaactatctcgttctcctcctctcaccggtttcgctcatcatgaattgatctttcttagtactccagtttgcaacttggaaacaagcgatggcagtgagaatgcacgcatatggatcataactatagcatagtaattttcaggcatgctgttattggtttcaccttctttaaattcagagttcagattgaagaatgggttgttatcaggttcaccaaaatgacagaacagaggtgaataggtgaacgaaggaaacagtcatggtctacatctatgtggtgcagttgcaccactatttgacccttttctacgcaagatagagaataatgttacggctaagacgaaccgtatccaaacacactatagtcgtacgacgtattggcacgttgccacgagggtgagttggtggcaacacactcattggtcaggtctccatggttaaaacgagcgtgaaaaattctgaagtcagaaaaaattaatagtgtgtgtttaatactaagaaattttgtcagacttttcacgcataagtttaaaaaaaagttggtcagaaaactaaagcaacagaacacatacacacaagtgcaccacaaccaccgtatacctttcgtattcatctgtacaaagctgcttcctttatccctttacgattttcaagtacaatcgctgacgtctacaacaacgccgcaaaaactttgatggcttgttcagatatacaagaaataaaaaaaaatgtaaactgacatgttctccccaaactttgaacttgatctgcagagctggaacccgaaactccaggacgacgtcagcctgacggtgccactcatccaggacaagaagagcgggagcaaagcgccggcggtggtgctaggattcgagtgcttggagagcacagcgttcaacggcattgccacgaacctggtggtgtacctggagaccgtcctgcacggcagcagcctcgcgagcgcgtccaatgtcacgacgtggttcggcacgagctacctcacgccggtgttcggcgccatcatcgccgacacgttcttcggcaactacaacaccatcctcgtctccctcgtgttctacctcctgggcatggtgctggtcaccttctcggcgttcctgccgaccaccgcgctgtgcgccgtggcgggctcgacgtcgtgccagcagcctgtgtttggcgcgcagaccatcgccttcgtggggctctacctcgtggcgttcggcagcggcggcgtgcgcgcggcgctgctgccgttcggcgcggagcagttcgacgacgacaacgcggtggaccgggagcggaagatgtccttcttcagctggttctacatgtgcgtcgacttcgggatgatcgtgtcgggcctattcatcgtgtggatccagcagaacgtgagctggggactcggcttcggcatcgccacggtttgcgtcgcgatcgcgttcggcggcttcgtgctcgccacgcccatgtacaagcgcagcatgcccaccggcacgccgctcaagagcctcgcccaggtggtggtcgccgcgtgccggaaggtcagcctccgtgtccccgccgacgccgccctcctctacgaggtccatgacaagatcgatcagcccaagatcacgcacaccgacgagttcagctttcttgacaaggcggcggtgatcgtgcagtccgacctggaagaggactcgaacgacgcctcggcggcggccgcgggctcgtggaggctatgcacggtgacgcaggtggaggagctcaagatcctgatgcggctgctgccgatatgggcgacgagcatcgtgctgtcggcggcgtacgcgcagctgaacaccacgttcgtgcagcagggcgccgcgatgaacatgcggatcatgtcgttcaccatccccgccgcgtcgatggtgtccttcgaggtgttctgcgtcctggcatgggtgctcgtctacggctcggtgatcgtgccgctcctcaggagcttctccccggccaacggcgagccgtcgcagctgcggcgcatgggcgccggccgtctgctcatcgcggtcgccatggccatcgccgcgctggtggagatggtgcgcctcgacgcggcggcgcgcggcgagtccctgagcatcgcgtggcagatgccgcagtacttcatgctggccggcggtgaggtgttctgctacatcgcgcagctggagttcttctacagcgaggcgccggagtccatgaagagcatctgcacgtcgctggcgctgctcaccgtggcgctgggaagctacatgagctccttcatctacgccgtcgtgaacgcgttcaccgccgtggacggccggcccgggtggatttcggacaacctcaacgagggacacctggactacttcttctgggtcatgtcggcgctgtgcacgctcaacttcgtcgtgtacagcgcgttcgcgcggaactacaaggtgaagacggtcgtgtcatgatcgctcgcccacacgtccgcgcgtacataggcaaaacaaggtagcgttaggaacggggtgcgtccaggaaatacacgggacacgtccggtgcacctgcgaaacggtttttgtatcgcagcgaccaatatcttctggctgctgctgatcgacgccatcgtgttccttgttgtttattgtttctttctttttgtcggttttactggaaaggaaatacggatgggcaacaggacatccatgaactttatttatgctgtggtcctgaaagaaaaaacagaaggaaatgcaatgtggaaacatggtgtgaccgtgtgagtgataccgcacatttcatggtagtactctgcaacagttatggccgttggtgatcaaatctctatgggccgtttgtaaatctcgaccataaatcaaaactcttaaatttatgggccatttgtaaacttgccaacgctaggacccagaatgcgctgtcgagagtccagagcccagccttggccgcagtgatgaataaatgggccatatctggaccggcatcatcgaagtgtatctacagccaggaaaaggcccatttggctccctcaaatatatgagtcatatacacggtaaaatttacaacaaaatagtcaaagttcacattatttgctataggacaccgtaaaaacatgataattagttactagacacgaacagattattttattatatccgttgcaagtacagatagagaaactttttaaaatgataagtttgtccatagggcttatttatttttaacccgagcagatctagttcaaaccggacccatactaagagagtgagaatggactggattgggagagtcagaatggtctggtctgatttgaatcagacccaatcaccttacaaacagatcaacacatgagtaatttactactttccacgctgttactctccgcgtttgtaccggatgtaatgaaatccgtgttttcattgtgtcctttaacaaatactccctccgtcccataatataagtgattttgagtttttgtttgcattatttgaccact

SEQ ID NO: 74558 - DNA, 24799 bp, Oryza sativa
agggggttcggtccccgctccaacacgcttcgtcgcggcgcgcgccccgtgaaggaaagcccacggcccatcatccagccagcccaatatgccaaagccgaaacggcccactttacttggaattaggccgaatttaggcctaatactagtacatttgtttttgcttgtaatttgggccttctacctggactcagtttgacttcttcaccgagagtcaaagttttttccgcgtgagaggagtcatcggagctcacttcgagaagatgacatgagatttggggagttatttaaaaaaggacctgaaattagggggagatggatctatccgtccatgaaatcaaacaaacccaaatgcctctcaatgcaagcaaaggcccccttctactatcttgttttctaacccagtcacatttaatttagcccatgtgcgagcttccatcacatgccccccgcacgtctccccaagcttatcacaaggcgcccggacttgaaactcttcactaggagctgtgtgttttgtgttgcttacgttaatcacgtacacgtaaacacgctagctaagatggacaggaaaaggttggagctgagctaatggctactcggctagtacacccattccctctatctccgtagttttacgcaaaatatttgttcctaaataagtgtagttttaggctgaatttaaatcagatgtaagaccgcagttgttggcggctcgaaaaatggggtgaatcgttagttaagtgtagttttaggctgaatttaaatcaaatgtaagaccgcagttgttggcagctcgaaaaatggagtgaatcgttagtaaatgatggatcgaatatcaattactataaaactgaaatattgatttatttgatttttttttcaaagaaatagaaatttttacacaaagcgcaccgtttattaggttccagaattgtgctaacatataacaaccgagttgcccaaacgaacggcgaacgggtccttagattggtccattagatctctttaatacgacttcattgttttctttttgtttttaaccatcaaacaagtagtactctgatctcctcctcctccaatccttgttttctctcggcattaataaaaggcaaagtaatattttaacattctgattaatttgtgtttgattagttaaattttatgaatagagggagtatatgttccatgagtatgctgatcaagtggtgatctttgtttagcttgtgccattaattagattaattaatagttatccatccatcatccatgtgcatgatacttcctcaatccataataactgtatttataggattcaaatttatcttaaaatatatagttattataataaaatactaattatcccatcaatcacttctcaattaaatttctatctttttttcgcggggaaaaacaggaactttattacttagccatagctgtccgcagacataagttcggaaataaagttacaacttccgtccggccaaaagtccgtaagggactcacaccgaccttttattagctaaaacatggctgatgcgattgcagttcctgttcaccttcttcagcttcatctccctggcccccttcaccatgccttggatctccctgactaaaaacgtatgtgccgatcgcagcttcccttcagaaagaatcatctgtatcgcctccgcacagtcagattcaatgataatcggtagaagggtccattggagagccagtctgataccttccttgcaagccaaaatttctgcttccagcgcactctggctctgctcaacaaagccatagactgcaaatattacatctccagtgctgttccgcaagatagcaccgatgccccctgtgttattctcctgataggagccatcaacattcagcttcatccatccactcggaggtttctctcattttgccaagacagattgcttcttgcacttgggcctgtcttctccaattacatgcatcccagatcccaagtttgcattagggatgtcatctctcgggttttctggcctttggatggtgaaataatcaaatcaataaggctctccagtcggcaggatgaggattttatcgcttggcatcctgataaaatgggccagttttcggttagaagtgcttatatgttagcggttcagctcgcaaatgctggggagagctctagctcctcaggaaatgatactaagaaagcgtggaaccatgtttggaagtgtaatatcccccaaaaggtcaaagtgttctcatggagagctatctcaaactgtcttcccactatggtgaataaaaagaaacgaaacctggaattgtcggacatctgcagtatctgcggcctagagcctgaagatgtggcccatgctttgtggcgttgcccgcatgccaggcgataccgggacctaatgagctccgagatgcaagtacagcgtatcctgcacgggtctggggaggggtctggttggatccttgatcttttggaatcaatttcagaggatgatcgccctgtctttcttatgtcattgtggcgaatctggtatacacgcaatgagattactcacgataaagcggcgccatatgtggaagtttctaaacgcttcgttctgagttatgtaaactctctgatggaaataaaaatttctatctattttaatcttagccactctcccactcttacatgtacaccattaatgaggagcaacatattttttttcttctcaaatcttaatatatgctaaacaatttagagttataattattacgagacggaggtagtggctgatattgaggtgtgtgtggggtgggggggattatatataattcttgttaatttcagtagggggtatggtttatgcatggtcaatttggagacacatgctttcctgcctcttagcggggagccctagctagcaaaggtaggtgctaatcgagatccaaagttacttctagaacagtatagcaactggctatggtactatgcttctataggacgcctttgggcatggatcaagtattcaaattagaggtgcctagcttgactgtaaccatccacacatgacacacagttacatgcatatggtggcagcacaaatatgggatccaatgtactttgaaattactggatcaaattcaactatcatgcaaatatatatttttgtaggagtgtagatgatggctggcctatagtagcatttgcatcaagctatagtcatacatgtagagggtgtttagatatagggtataaagttttagcgtatcacatcggatattatataaggtgtcacatagagtgctcgggcacaaataaaaaaactaattacagaatccgtcaataaaccacgagacaaatttattaagcctaattaatccgtcattagcaaatgcttactgtagcaccacattattaaatcatggagcaattagacttaaaagtttcgtttcacaaaatactcataatctgtgcaattagttattttttagcccatatataatactacatgcaggtgtacaaacattcgatatgacagggtaaaaaattttatggtgtgatctaaacaagaccgtagatgtgtcactaattaagtttaatacacctagctataggccatagcagagtactagctagctagctcaacttaatttgaaacattttgaccacaaagttgcgagctaggttgatgatcaattatttcaatagtagacttccatacaaagatgacgtaacaagagtattccactatatattctgatctgatacctcgagtttaactattcccatttgcgtggagtggcaaaatatgcaacttactactccctccttccgtaaatgtttaatgccgttgacttttttaaacatgtttgaccgttcgtcttatttaaaaacttttgtgaaatgtgtaaaactatatatatacataaaagtatatttaacaataaatcaaatgataggaaaagaattaataattacttaaattttttgaataagacgaacggtcaaacatttttaaaaaaatcaacggcgtcaaacattttggatggagggagtcctttttaccatccgatcattctaccctaaaccaaatatttgcgaatacgcaaaaagattacacatcaatatattaaaagaaataagagtttttattacataatgcaactggtcagacggccattgcctggggacaggggggcaaaaagaaagaaacaaaaagattgctaaagtaaagaaaaatactacagaaaaaacgatacttctagggagggtggtggcagaaccccactacactactaacaagcccacaaaagcaacggctccagcagatgaccacagacggccttactgtaggatagacttcagaatcactgagactaacgagagagagtaatcgaaaatcctagagtttcactcctttcacaatgtaacgctccacctttcacgagacgttaaaaactaattcggcaaaatcctaattgcgaaaattttcgtcatttgtgtgcgagtctaagttgtgccaagtatctcaattcaattctgtccttgtctccctctcatcaacataaattgccaccccgaaatttccaattccaattcaagctcccaaaatcaaatttcgacattcaatctattcccttgaatccctccctatctatcaaccgatctatctacctacctaccaatcaatccatctatcgatctaatcacctatctaccatcgaactccttcccaaacaattgtcccaactccgaaaatatgtggtttccttcgaatccctctcaaataatcccttgaatcgccaaatacaaatctatcccgaaaatatcaatttctcaccttgatctcccttccttgctccttcatatttagctgagttcaaacatgcaatttgaattcgaatttcaattcaaatccaagccccaaacctctccaactcaaattctctgtataagtctatttcgcctccccatgttttggatgggccggatttcctcccctcggcccaccttccttgccgctcctcccctcgcgtgctcgcgcgtgcgccatggccgagagagagagagagagagagagagctctctctgttccttctattctctctctctttgttatctctgtttctctctctctcgtcgagctcccccaccggcgccgatttcccgccgacgccgttcgaaatttggccgtgccagctgctccacgcgcgcgcgccgtggtggccgaccgcctggtcgccgctgccgtcagcgcctgcaccacccatgccctgtcgccgcccgaccccgctgctctgtgcgctcgcgtccaaagacgcggaggcagcgcctttttttcccacgcgctccatcctccctctcctcgtccaaaatcgacaaggagctgagctcctttcccctccccctttttttgcttttccccctctcagctggcgtcacatcctctgcctcccgtgaccgtctgtcgccacttgaccgcgaggccgccagccgagctccccttgactgccctcgttggttccttcccctcgaagccccatctccacctataaaacccgcactcccctccctcgttcggctcctagcctctccaccatcgcaccgtttctcaggccaagaacgctcgcccaacgccgcggcctcctccgtcgctggtgttcccttcctcgccgccttgcgtcgccgctcggccaacgcggtgctacccgccgcgaacaccatcctccagacccggcgccgccctccccgaagcccggccgttttccttcgctggcttcccgtttgcttgtcaccgacgccgttcatcgccatcggtgagctcttcacctaatcctcctcgttgtcaccctcctggatcactgtagaacactcccgaaccgtcgctttgatcgccggacccctctccctccccggcggcgttccgcccttccccgcaccgcgcctcgccgtcgccggcctctctcagagtctctccgccccatccgaccctgggaacaagttcccagagtcctagagatgctcccgccaccacgaattgaccccattctctcccggcgtgttttcccccttttgctcaccgccggtggccgccgtcgaaatccgccgcctccgtccagtcccggccacatccgagtcgaggaatggagtctacgtctcctttttcctccctccggtggtctcccttcctcccgcctcgcctcgcggccgctccgccgacgcgcgccgccgcccgccatccatctcccggtcggtctcgtcttcctcctctcgccggcccgcgtggctgccacgtaggcgccacgtcggtgccaactcggctagaccgagtcaaaccggccagcctggctagcccctccgtgcgcacggaccacggtgcgccatgcggctgcacgtgggcccgtcgcgcctcggtccacccggcgcaccaatcgtgagccgcatccacccgaaaccctaaacggcgcccgcgtgctcccatccctccgtgaaccgtgtcgccgacatgtgggccccacccgggacctcgcatggtgggttcggtccacccggaccgccccctctcccttccgcgcgcccctaatgggccgcctccttgcgcccgcgccggcccaatggctcggccgagcctccttcaacccattgggccgcgcctcacgctcggcctaaaagtccatatttcctccctcagtccaagtcagtgtccatctctcatgagctaaaagtccatatctgctccctcccaatttactcctctctcaccttttgtaggccccacatgtcaatgagtaattaaagaatattcttgggaatattcttttccacgaattcaataaaccatctctcatattcccgaaaaattcgatgaatcatttccttgtccagaaaattcagataaacttccaatattcatatctctcgatccgtagctccgatcgactccgttccacttccagtatttctataaaattgagatctatttaatggcactattaattagtctaaataggatccttcttttggtcttttgtttaggttttcgattgtttgcgtatagttgcggttgcggattttcgtcgatcgtggttatctcgaagattcgtgaagctccgtgaaggccttgagcaaggcaagtcaccctttgaccaattgctcctataattggaaaatcattattaatttgtttgcaaatcgcattattagcaacacacatttataacatgcttggcctcagtttgcgtgccaaactgacggacctacccaatagtcgcactaattcctgtaggctgtactaccctgattccttgtcgctccacctttgtggtacttcggtatctatgctctctgagcgcgtataagaactattccacatacaccgttgtttgtcgaaattttgggaaatgggtttgagaagccttgaaaacccaacatgtggtgtcggtgtgtttgaaaataaaatgaattgtgaaaactcgcgatgcgggtgttgtgcctgggtggcgccgtcccgtattcgcatataaggaccgattcctgtgggaaattcatcaagcataacaagtgcaaccacatggtggtatgggacaccctggctaagtaattagctgattttgggaaatcttgtataccaatagaggtggaaagccgggatgtgggggtagaggcatcctgggagctcgaaacagaggaagacacccgagagtcctaaaaggaaagttggggttggcccgatgttggtcagggagaccctctatgtggcatgaggtaacccagagttagatttggaaatgccttgtcgtgaatctcccttttccagcggtgcgtcatgaacacgggttaggtgatgagagcaagttcgcgttgtgtgggtaaagtgtacccctctgcagaggttaacaaattgttcgaacagccgtgcccacggtcatgggcggatgtgaggtgtttcccgttgcgtagatttgtttgcctgtgctttgtgaaaagttgttgtggaatgggaatcgtcaccagaattagcctatgtggtagatggatgacctgagtggtcagaaacgaatctgtgtgattcgggatgtctgcgggcatcatagactaggcttcccgagtggaagcagattgttgtgctgctgggcagctggactctaggagtccgagaaaatgaaaaaggctctgggagccgattaatcaagtgaaagggctctgggagccgagaagtaatgatctgacccgggtggtcagtacattaccatttgagttgttgaaaagcatctcttaaagttgaatcgagacgcaagtctcatttcgacccaaaacctgaaaagaaataatcacttagtgattccaaaatgatttcaaacaaaatatttgcaaaacaacctcgcctctcttccaagcttgcattaaacacctaaattcccgtgacttgctgagtacgaaagtactcacccttgctctatataaatatatatagtttctctgccttgaagtgaagatgaagtgaagtgaagattagggtttcgtcctggttcccagccatcgcctgtggtgttgtgtgttagaccgttggttccgctgctgctgctgttgttggtgttttctcgtccgcgtcgtcggttgcattctcaggctgttctgagttgcaacctaagttaaggtaaataagtcctttatttattttaaggattgcaatgactcatatttgtctccgtgggtaccagcgctatgtcctaggactggtactgagatcgcggtttcgtaggaagcggtttgcgccgttctccctacgacacgctcctgtcaggtgccgttgtacggcggtaccagattggggtgtgacacacagttgcaaataaaccagtagaactagggagtcgaaacccataaaaagtgcttaggcaggcatgccttataagtcggccactagataaacttgaagcgagcacgccatcagatctgaagcgagcagccaccggaagaaccgaggtcagacaacaaatggtgctagacctgatgagcgaatgcacaataaagaatgatgtggatcgtcgtttcaaattctcgagtgtaaaaggacaggccgagtggttatcaataattaattagtgtaaccctaaaccaaatgaaatgatcgaaattgtttcaggccattttaattaattagtgtaaccctttggacaccatttgaattcgtgtgcagaaaacgccaccaactttctcaaactcagcgataaaaaaaattaacaaatcgctcgtaaattctcgatcgatgcgtgcgtacgtgcatctattctgcacagctagctagctgcagggcaggctgcaagccggcacataaggcgctgcaacgcaaatcaaatcgatagacacgatgctctcactacccctacaaacatagcacgactccccatatgtgtgtaagtaagtgtagatgcatactacgtactgtgtagatccatactgtatatgtataagctaccacatcggtcttaaaatgtatatgcagctatttctagcatcttgatcttaaaataaagctatttcttcacttacaatttactcttaaccaatcaacattattctccatttaatttatttatctaatttctcttctcaaataatttttttttctccaatcatatataatatactttttaatatccgtgcttaccgataaaatacctatattttagaatggaggcagtagcacatgcagttaaaccacacttttcagcatcagccacacgtacgatcgatcaagcttatacatggcgccgaagatcgtgtacgtacacacgtacgaaaattaatgccagttgagtagtatatggttgtgaacaattttgattaccaccacttgcttaggtttgaattccccctaatagcctagcaagctagtgtggggaagaaccccttgtgttagagtaaacaagctagctgagagctattcttgttcatttttccaactaggattttggtctaaataacctctgcttggacaagctagcaatagtatcaccaaaagggatcaagatatattattttgctctccaacagtttgtaattcaagatttaccgcataattacacacgtgtcaactacgacatgtggggttgatctatgacatgaagtggcaaatcctttatgccaccttgaggacgggcgcaacaattaattctattttttccttaattatattctagaatgatatacaaagcttggcttgtcatatatttcctacatgcatgcatatggtggatccgaattgaaaatgacgagatgtgccaccgcatattcgagagaatatattggagcactcgatattaggttgaggggtgctggcaattgcaaaggacgcatctcatctcttttctacaatgaaataagataaatggcactgatatatatgccagtgtctcttataaaagacaagaatccgtaattttcttgacggtcaaaaactatcaagtagcatcaaaaccgtcaaggttcattattctgttggctgaccgtcaagtctataaagccaaggatattcaggtttcttggctgctaaccgtaagggaatgttttcttagcggtcggacagccaccgccaagaaaattaagaagattgcgaactttcgaaagcaccaagaaatgtaaccttgtcggtctgaaccgacaagaatatatctttccttagctgccaagaaaccgctaaggaaactacttattcttgacagttagaatcgccaaggaaatcagttggctgccaaaaaattacggattcttgttgtgtatgtaattgatgctgctgatcgatccatcacttatcccacaaaaatagtggaggtaataagaaatggttcctcgacacacagtatatattaattaacatatattgatgaaaagcacaaattaaataattccttgcaggtgaaatgacaacaataactaacacgtctttaagaaaaggaagaggcgataaagtctaaattcagtattacaagaaacctaggggtgagtgagcacatatataggttcgacattagtggtttctagatgaacaaggctacaattttcacgccgtacaccatgcatgaaatatttgcatcctggtgctggtggtccatgtgatgccttgcgaattaataacctctataattctaattctcatagtacaatctctccccctctaaatttttttctttataaataaaacaatgccatttgcagaattgtacatgcatatttctgtacgaactaatcatctacgagtgccaaagagtagctagtgatagagatgagatgcccttctctctgctgtgacatggttgcactagaatatatggctggttgtcacatggcaggatgcttctcattccctctttggcccatctcctcctatacatgcgcaggcatgatgcatgcatacggttgcaagcacaaccaagatcagagaatcccagcagtagtacatgcatgcatacttgcgacgtcatatgataatgtgatatatattatactccacttggtgctagctaggttgaattgagatcgatcgatcgatcagagatggggacgataaaaactgatagagctaagctagggcctggatgcagagagagatgcagccatggccttctgttttgttttgttctcaagtgagatactactgctactactacgacgatatattgatcagatcgatgtgatggcgctggaatttttttaaggtgatcggcacaggcgtgaacgtgggagttgggcatggaattaatggcgccggccgtgcgtgagctggacaaaatccaaaatcatatgatccatgatgtgaaggttggtggcctggctatagctctccctcccttttgtaacgaactttgaaagaggcatcggttactgggaatactagaatatgggattggggatcgatcgagtgatgaatgctgcttgcattaattaattaattaattggcacccggcagacaggatgctttgctaattttcctttttaagttattactccattcattttcaaacaagtttgtttttagcttcaaccatttgtaaaaaaaaacatttctatctcctgcataccctcaatctgtaaattgataagctttatttctctaatacccttaccaagtctcacctaccgacctaattaacaatactatatattttcatattgatatgatcgatttagtctcttccgcttcatcttattttgagcatcccagggaaaagatgaagttattttgaaccaggaaagtataattatttggcgtcataatttagtatggtggagatatgtaaacttctaaagagcttttacgctcctgctggagatatacgatgtttcaacgctgaaaaatgcggtgactcctatcaagtatcataaaattgctcaaactaataagagagaatccattatatgccactgactttgtcacacctctacgatttaccactggctttgtcatgttctataatatgctatcaacttttgcttaacttctacgatttaccatcaccgtccgattagcctctgttagcactgtacaattttgtccaaatgaccaaaatactcctaggacaaaaacttgaaaaaattggataaaattaacaaaatatcatattataaatataagattgtaaacatccaaaatttggccaaaaatttaaaatctgatattttagaatttgtatccgaattttgaaagtttttgtctcaggggtattttggtcatttcgacaaatttgtatagtactaacggagactaaccggacagcgatggtaaatcgtaaaagttaaacaaaagtcgatgcatattgtagaacgtgacaaagtcagtggcaaatcgtggacgtgtgacaaagtcagtggcatataatggattctctcaactaataactctaagaaagtatagctaatcaaaaagaaagatgagagcaatgaaaatacaattacctaatgggctaatcatttgagtaaccatgaatcatgcatcatgcatttttcctccccccccccccccaaaaaaaaggcgaaccacccgttgtttttccactgttactctcatattttgttattgcaaatgcacaattgttggttcgccttctaaagaaaaaaacttctagagataaacttgacaaatactttttcaaaatcatctctacattattttttttacggagggtgtagtttcatacggaaaaagaaatcttatcaatattggaaaaaaaaaggtgaaccaacaattgtcatttgcaataacgtatggaaaaattgataaatatagtatgacaaatgttttttcttggcaaaaccctgataattcacagcacaattatactcctgcgaaaacaaattaaagggcgtgaatagaaaattggtatatacggaaaaattggtgtaaggtgtgtgatcaacaattagtaaggccaaaaacaagtattttggaatctcatcaacaaaaacaatgaatctccatatcaggacaagccatacctttgccatagtctgaagggaccaagaccgattactttatcccaacgtcacgaagatcgatctaaagtattactaaagcttgttaataaagttatatgactatgcttaatttcaggaacctctaaacaaagacaacggcatgcatgagcttgcagctagctagcattctgtcaggctggaacaagtgaaaggtaggtgttatcttgtctttattttaagtacaaactaaactctgtgtttatcatgtatgtgtatatatgtctttcaactcccagctcccttgtatgttagtagtagctagtccagaacaggaggaatataattaataggaagtaattctatatatcttaggagtactatagagtgaaaactcactaaattctaaaactcaacatgcaaagatgctacattatcatccactaacaattaatacatcttaaatataacgtaagcatgctatattatctataattctaaaatgtattaaattctgtagttttaaaatgcaagcatattaaatcatcatcccacataattcacataatattttaatatatatctccagcatttttgtatgatatccttatatagttcatcttcacttagttaatgctattcctctcttctctcattaagtatatcacatcacatcacatctatggtcaaaattattttcctcattttattctctcagtaagacatatcaattgtttttaggtccttagattactaatctatgattcaaattatctccctcctttttctctctcataagccgcatcaccttacttttatatttggatcatcattctatatactatttaaattatcataaaaaatatcaacttacgtaagcttatgccatgtagctatctattatatactccctcgtccctaaatatttgatgctgttgatttttttaaaacatatttgaccgttcgtcttattcaaaaactttttgtgaatattattaaaaaaaacttgagtagtagtagtagtatatttaataatgaatcaaatgataaaaaaagaattaataattacttactttttttaataagacaaacggtcaaacatgttttaaaaaatcaacggagtcaaatattttgggacggagggagtattatttatacttattatcactatatattatactaaactctcacatcaacgcgcgaggtttcacctagttaagtagacaaagcttacaaacttgcattttgttgagcgtaggaccacactaattaacatttcagtaaaaataaagccaaaattaattaaccaggagaagtgaaattagaaagaaaaaacagcatatgaacctttaaaaagagcagatgagtatcacatatttgaccgcgcttaaactagctagctccacaaaaaagtggagagatattcaacgatcgagatgcatgcataaatgcttgttttgtgtggaatgttgtcaccatgtgtgtgtttgcgagttacccaaaatagtactagcaaatgcacgattgcaaagcgccatatatatacctttttttttaaaaaaaaagtggcatttattcatatcaaatattttagccactgatcttaagattagtgtgattattaatccaacaccaagtgcgcttactcataaatgggttgtcgttcatatcttcaattgatcatgatcctgactaaaatatatgcccaccctttgatgcggattctccaccatttaattaaacagatcacattaatcgcagcatgacacacaatgagcaaatgtattacatctagactaccctatccccatttgtttaagttacccatttaaaaactgtgaagtgatcagtatatagtactactgtatatctaatgtgccatatggcctgacacaggctgcctctgatcaattccaaaattcagagacagttctccgtgactaactccaaaacaattctttctggtgctttgtgaaaacaaattaaggagagacaagtgattagcgtttgctttaatttggacagtactactctacagcaagtcaagaagtcaatccaagttgatcagtgtaggagtactaaaagtatatacgtagtatactactagtgattaattagtgaggccattggcagtttggcacatggcacaatttggaatctttggggcagctactagagagagatagagatgggaaaagaaaccctaaactgacacaatgtgtagttgtcaggaaaagaaacattagtgcacatacctcaaaaaatactctgtgcttgtatttgtgtgtggttaagtgacaagactctttagccttgactcaactccagtaatgcacgaagtcaaactgatcaaatcataagctcatggtttcttaattattttaccaagatatgcctagataacaaatggcacattgtgcaggccaaggtaaaaaggagaacgacgtgggttgaatatggtttgactatcacgctatatatggatggatcggacatgcatgcgtgaaaacttttctcagttaattatttctttacaactgttgtctattcatgcacacgttagttattaatcaatttgttatactgatctactactatactctgttctttcttccctacgtcaagttctcactattccatggattaataaggatctatggacactataacactttggtttagttgggattagatcactaatcaatgctactggtgtactagtagagagagaacaaaacaaaaaagtctgaattaatatgtttctatcatgagtcatcagatatatattttatcctgtcgcctgttcagaggtacaggactggtctgacgaacgaattaagctcataacatataattagagcagagtcgatcgataagcttgagcaaaatttaatcaatatccatctcagtgaagagataatatcgaactctaataccgtatcatctccacatcaatcaagcatgtcctttaatttgcgccaaaaaatttccttcaaatatatggacaccgtatcttctgtgcgtccaaatagcgctgtatatatatatacctgtctgaactgaagaaagtatttatccaactggtcataatatgtgcaatatttcgtctacatcattctagtttgattaaaaataaaggtacggatattatgtccggccgcatgcgatcccatatccaggatgtcattagattcaaagaaacttcctacagaaagcaactctcctttgtttaattctgctgcagcatcaccttcaagaacccacttgcaattgattcttaaacaatacataatcatcacattagttaagtaccaagagctagctaagtgaattgatagattccaaatgagcataatctatgtgcttaattgattgcagtgggatgatatgtctgaatggttgcttagcaaaaggaattcacatatatgcgtgcatcattggttttgcattcgcagtttgtgctatcgacataattgaataatgagaataatccaagtgcaatataattaattaatttatgtctgtaggccgggtatgtgcatctctcttatcgttctgtttattaattattagctactcctatatatttacagttactaatttatttacaactatatagttaattattagttaactattgctctgctaaaatatgtaatcttacatgaagtggatagttggacgagaacaatataaaactatgctagcatagcaatatatactactcctgtgcctgcaggccggccggatcgattataaataattttctccagcaagcaacacacatatcgctagctgtgtgtgtgatactgagatgtgcttcatttcaataccacgggcacgttcattcagaaggaaatatatcaaaacaaatcgataaggaaacaactgaaagatattataaaatagaatataaaaagatggcaatgtagtatgtgttcccaagaaaattatgatcatgtcactttcgaatcagctaagatccaattaagaattcaaacaccttactatatgctacgattacataggtgctgaaagtagtatgctttggtacagaaagaggtcaagtgaaatacatggtgaggctgtatatatgtatgtctgtctgtcgttgttggtgtaatggtgttgctagctagtcagctgggtcaatggctgtggtacaaccaacctacctattcatcacttgcaccggttaataaagtttcatgagtacgtaggataaaggcgaacaatattgcacgcccattttcagagatcaaagtacacacacatccacgatgcatgcatgtttgccacagtgccctgcggtaacatgaccaaaagtaaacaggactatgagtcactgtgtacaaagtgtacaacgccgcatgcatgtacatggtgtcatcgatcgagcacggctcagtcagtatattaactgtgaagcccggggcaactattatatcacttgttaattcctatacaaaattgaaatggtggttatcacattatccagatttattaaaccatgggctaattaactatagggttaattccttctctctcttttcttttgcaaaacacagcacacactcatccctaatgaatgtacacacgcacgtacactatatctagaaacactttcatgaaactggatcaatatattttgagattgataaaatcaacacagatatcatatggcagacgtgaacctaaactgtcaagctatgctcggtttgcattataggtatcaattacatgtcttttttgctatagtactcgtactataccgatacttctcgatagagagtgtcggccgggggcaagaaatcagcacgtactggtgccgttcatcagggaagagtgtcacggagcacgccagctcgctcgtccggccggtggccgcccgtcgccggtcaagacgacaagggtacgacgcgccgcgcgtccgctttccgattcagttttttttgttcttaccttgcacgcgatgcgccgcgcgcgagacagagagatctcatgagcgagccgtggtggtacgcgcgcgctgcgtacgtttttttttcttctttggttttaccgcgcgcgcgcgcgacaagcgcccgccgcggccatgccgccttgcgtgtggggatcgcacacacctctctctcttctctcccccccggccgcttgggcgggcgaggtcagcgtccgtccgtccggccccgcgcgcgcccgtgtatgtatgcgtttgcatttgcatatacatgcatacacatccacagccacaaaaaatattactaaaaccacgtctccctctctctcatctctgctgctacatacttctttattgtcatcttggaagccaactcaagttacccatctctctctctctctctctcttctcttctctttgttttcttgtttgcttgcttggtgtaaagaaaagatagctccctttccactgcccatctctcacatccctgcttcccttccaccctacctccttttctgccccctctccacaacaccccaacaagtttgtttgcttgctcgcacgcttgctgctgactagtagctcgctagaacaagcagatcagctcaattacctagtgtcaagaacggagaagaagctttcagcttaggtagctttggtgcggaattgtgtgcagaagcgggaggagaattattgagcggttggaagtggatgcttgcgtcgagctaagcaaatagcatccactatagagagatcggtggagagaaagccctagctgagaggaagctctagctagctaagctagccatgtgcgactacttcctgcagaggatggagggcgaccaggccggcggcgacctcaccgacatcgtccgcgccgggggaggggccatgccggggagcgtcgtcgtcgacctcccgtcgacggccgccgagtggcagctcccggctgagccgatgctcttcccgccgccgccgtcgttgtcgtcgacgacggacggctgtggcgccgggggagcggcaggcgccgacatcttcggcggtggcggcggcgaccttttctccggcctcgtggacccgttcagcagcgactactcgtccggcgcggacttcttggacgccatgccggacgcgatggcgaaggtcggcttcgacacagctgtcggcggcggctgcggcggcggcggcggaggtggtggtgggagcggtggacacctgttagacatgagcaggaagcctctcttgcccagagggatgccgatggcggccgtcggtgggctggcggcgccgagggtgatgccatcgccgctgtcgccgcgagccatacggccgtacccgccgatctccgcaggcgacatgatgaagctcggcatcacggcagggcaggcggccgggtgcgccatcgacgccgccgtcgccggcatgcagatgtcgtcgccgcgctccggcgggatcaagcgcaggttgggccggcaaccaccatcctatagctagatctaattagatcgatccaaaaagaattcttcgtttggttgcatgcacaatatcttgggttaatttcgtaattcgtgaccggattttgattaattaggggggaagtgattgtacaacttctccttgtttttttttctctctttcgctatccaatttgctgttcttttttcgaaacaagcaaatttgctgttctttttttccgtgttctgcactgcaccgccgaagaaagtaagaagagagatcgaggaggaattccgaggattcttcgggctgtggcaaggtcacagatgttacctacagctcaaaattttaggcacaagagttatcatgaacacatggtgaacggtgggaatatttctggattggcaaaaacgcattgcatatcgggtgatgtgcatatctgcatctagacctaaccggccacagctttttttccggccggcaaggtcggcttttgaaaccctaagctagcacatacgcatcgcctcgatttgatcgatgcaaaatttgcaaacgagttaattaacttggctgcgacattgcgtgtgtacacatatggatatgtaaaacaaaaaaagaaaaaactgtgagatatataagtgatacttatccaagtgctaattaaattgcaggaagaaccaggcgaggaaggtggtgtgcatcccggcgccgacggcggcgggaggaagacccagtggtgaggtggtgccttctgatctctgggcttggaggaagtacggccagaagcctatcaagggctcaccctacccaaggtacatgcatgtttatcattctagcaaatgcattttctgttttaacataagctaattgatttgatgaggtaataaattggattgaattgagtgtgtatgcattaaaatgtttgaacaaactctttttaatcatctggcattcatgtatatatatagtccatcatcattatataattttatccagtactccacattgcgtctgcacgatccatgcatggaagtcaagagattaattggaagatactaaacaaatggttagctaggtatagggtagcatgaaagatgcatgcatgcttctagctaattctcatatccaactagttctactagcttctgtaatttttgtggtatttttggggttgcacacctcatcacatacagatagtactccataaatgtgtgacgaattaattagctagataaaatgtactgaaataatatctgctgagattagtttatccttattccaagggtgtagtacttagtttatccatgtattaatttgtacaagttttaaatcagcaagtctcaactctcggtgcacactgcaggtaactagctagctcacacgattagatggagtatactcctatatctttctggcaagctagatgcagttaagtccaggatttttttttttgtacacacatcagatatgatgtttctctttctcttaaaataaaaatggaagtgtaatgaagtgagtaaaattaaatcaagtactgtaaccagtttgagaccactgtgatttcagtatgaaagtcaaaacatttttttattggaaacggccggatatatcttccataacttagaggatcgaagcacataggagtactactactagtacttattaatttacctacagcattggtttaatatcagaacaagtgatgaagtgcatgcaagcttaattagtcgatctaaacaaatatatcttgttgaaatgaacaatttgcagaggctattatagatgcagcagttcaaaaggttgctctgcaaggaagcaagtagagcgcagccgtactgacccaaacatgctcgtcatcacctacacctcggagcacaaccacccatggccgacccagcgcaacgccctcgccggctcaacccggtctcaccacagcaagaacagcggcggcggcggcggctcgggttccaagggctctcagaacgacaagtcacagcagcagccaagcgttaaagaagagcagaaggatcaggcgacgacggcgacgacgacgaccaccagcacaatcactaccacgaatagtgcttctcctgtggttgtgaaggaggaagaggcggcactggcaggatcgtcggaagcattggagttggagagagtcatggacactactgcagctggagtagtagaccacagtgagctcatggatcatgttttcagtgagagctacaagccgatgataccggagactggccagccggatgatttcttcgcagacctcgccgagttggagtcagatcccatgagcttaatcttctcgaaggagtacatggaagccaagccaagtggtggcgatcatgcccaggagaaggcaatggccaaggaattggatccattcgacatgctagactggtctactactactaactcttcggcagggagctcatttgagcaagggaagagaggctaaacccatgggcataaagccatgcatgagggtttatgcatgcatacggttacataaacttgatcccagctaataaccataaagattgtgacaatgtcagcaaaggaaagatgagattttttttttttacttttcttttcttcatttggtctctctgcttcttcatattattgtgtgtgagaattaaattttgtttcaaggtctaggtatatggacctcattttttaggctgtgtcaacttgttgtacttatgcatgagatgatgaccactctatctctctctctgtcgctcgatgtgtgcactgtgtttatggttatctaacagatataagaagattatattctatgtggatgtactgctggggtatagggatagcagctgaacaagtaaaattaaaatggggtttttgaagttgatagatggaagaagaagaacaacaagagtgtgtgagatcgacctgcattcctgaaggggatagatatgatgtgacagagatcgggacatgcatgcattgctagcttgcaacggaagtgatatgcccttggatgtgacctcaagtgaaacacggtgcgtgaaatagctagagtatgaatcacaaacacgcacacactactcctctcaaagttggcagaatagtgcatgcgtgtctgccagtgagaatctgaaacaatataggggatgccaaggaacactagctggcctcctcttcctctttgcttgcataaggagggcatatgttggattcgctggagatggtacatatttttgtctctgcgccaaggaaatgcatttacttctcctgttcatctaatggccaaacatttttgagatatacattactcatcaatcccctcacgggctcaccccatgaatacgcatatgtacatcagtagttcagtactacacacatgtgataatattgtactggtatatacatgtatatctgtgcagtactatttgtatatggaactagatagctgcatcctctagctacctgcagtatcatgcaggaagtaaatacatgcactgctaaaaaaatgtatatacgtggcatctggcctttgatttggcccactggattaacaccatttcccatccatcaatagtacttctagcttcactacaagtgagtagggacaatgcgactatgcgaggactaatgccatatgcaggatatggtatgtgtctgttgtagctggatgtgagcatgtggatgtgtcttgtggttaaatgtatctgaagactcaagtcattgtaacggtgtctgtggatacatgcagcatgatatgtacgtccatccaccactcgctcatttgtacgaggtatatatactcgcccggagaataaatgttttatttttgaaaaacaaatattcttttgtacttattgaaccaagatacctgtagtaaacagcaatattaatattgatgtttaactaattaattaaagatgatgcaaggaagctatatataagcgctgatctggatggatgaggaactcgacacctgggcgaatttgtacctttgccgcaaggatagcgagcgctgtagctctcttcattttctttctctgatcccaggtggtgcataccctgcaatagttcttcaacggcggctcgtcttctccgtttctgctacatacatcgtcctcacctttcgttgaagctgcttgtatttgtctgctagtactgtttattctaaaatattcaacatacagagcttttgcgtgcgtgtttgtcgaaaatgttctggcaggataaacaggtaggaaatacaactttgcaagaacaatatccgttttgtataatattggtagatacaaacaggtccacggttgcataagctctaactaactttatatcctcctaaaacttctctttgagaaaggattttattgggcaaaaattagtactactagcttggaatgctttgcttccatgtggtgctaatattgtttagtgtaacactaccgtgcaagccaatccatcaaatgagcggccacacttacacatagcaacctacttacatttttgttctcgtttcgtgtaaaaaagttaatccgggagtggtatggttgaatggacaatatcttataaattggttccacccaactaaactagcaatgtggtgttaaacgtgcatgtatccacggctctcaggccacaaatgggccatctaaattgggcggatgtcaaattttgtcactggacctagatgaatttacctagaacataaacccaaattggacagatctatctctagcttgttatggttgtgccagcagcgtcctgtcctacttagtttctgtgcttgacatcttgagctggtatcatgatcccagcggttgtatggctctgttacgctttgttataaaagctgggctttggcctttttccaaaaaaaaaaaagcattattacatatagatgtcctaaatcctactccctctgtcccataatataagg

SEQ ID NO: 74559 - DNA, 1748 bp, Oryza sativa
ccatgcaccccgagcccagcttaaaaccattttgagggttttaaaaaagggggacgtgtgaatccatttccacaataatccaactattcaatagtgtccaggtggtgagaatattcccaaagtctagagttataaaaccacctaatgttgcctaacgactctagcggatccccctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtctacatgaccaacggaaaagaaaaggcttttactctgataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggaggggcgcgcggaccgggtccacgggagtggggcccacgcggcagcctcacggtccacggtggaccgggtgcacccgggctcacaccggccggcgccgtgggtcccacgcgtcagccgcacccgagggcgcgggcggctgacggccgggccccacgcggcggccacacggcgcgcccgaaggcggccacgccggcgcagccggcgggagggcgcccgcgcccctatggtcgccggcggcggccataggcacgacggagcggcggccgagagaggggaagggaagggggaaaagaggcggccggtccacggctcaccctaggtcgacggcgacgacgaaaaggcagcccggagcggaggaaggcggcggcgcagctcgggtcgacggggtcgacggcgttccggtggtcggcgagcgaacggaggggtagatgaggtcggcgaggatgcggcgaagccgaaggaggcgacgccggggtgggagatggttcggggtgacgacggaggcggaccggagctcggcggtgacggcggagagagagagagacggcgcgagctcgattccggcgaggaggaagggcggcgagaggcggaaacggacggaggaggtgcggggagggtataaatagagttggaagggggagagggcggccggcggggaaggaaccggcgcgggaggtccggccgccatcaatggcgccggcgagatttgcgggggcaaatccgcccgtttgaacgcgagagagagagggaaaagtggggggaaagggagaggggatcaaggggagtgatttccccctattgattgcacgcggggacggtgggatgcggcggattcgcggcggcggcggcgctagggcgcgggcgagacggcggaagcggcgggaggaaggggatgacgggtgggccccacccatcagcgagggtggcgggcgggcccgcccgtcagcggcgcgcgcgcggggagaggccgagtgggccacggggagaggagagagagggggagggagatgggccgaccggcccaa

SEQ ID NO: 74560 - DNA, 5498 bp, Oryza sativa
cggcgtcgcctccgtttcacgcggagaccaccggagacgcgtccccgctggcaaccagtggcattggtgccactgtactccctccagccggctgctgtccctcgtcggagcgtcggccgacgtcgccgtctccttcgtcggtgccgtggcatcgtctccttccccggccacacctcggtttcgccggaacaccgccgtgtcgccaccaaccctccacccggctcggcggagtcctccggccgcccgttcctcctcgcttgtttaccggtcagccacgggaccaccaccttcggcatcgcagcggcaaggtcgccctcggcctcgcctccccttcgaccaaacccctccgcggtccatcgtcgttgtctccgttcgttctcgtcgtcgacgtcccgtcagtcgccggctcgtcgtctcgcggcgccgcctccgtcgtcggcatcgcagcggcgtgttccacgccatcctcgcctccgtgcagccgctgccggctgccctcgtcgcctcctcgccggccccggtcgtcgtcgtcgtcgtcctctcgtcgctcccggtcgtcgtggcgttcgtccctccgtcgagccgttctcgtccgccgcccgcgtttccccaagtgtgcagcagccccgtcgaagtcttcgtcctcggctccgcgtcgtcaagcctcgtgccggccgcgtctcgccttcgtccaaggatcgcgacgaaagtcgtcccttcaccgttcgtctcagtagttcccgaccgcatcgacgcgcacgtatcatcgttgtcgttcccacgcctcatcgcgtggtggtaaggatccctctccctcgctgccccgtcctcatcctttcggtgtcgcccgtgctcgttgtgcggttgtcggccccggtacccgtgtaccggtgtcggtagtcgttcgcttgtgcgtgtggtgaccgtgtttgtgtgcccgctcggtagccgcgtggtttctacgtgtgcagcccgtgtggtgtctagtggagtccgtttgtcggccactcgcctcggttgacacacgggatctgcttccgtcgatccgtggaccgtctctgtgtactcggtctaccgcggtcctttaggttgacatgtggggtccgcatgtcaacggcgcagccttcttgtcttttccaggctagcgcttacacatgttttataattgcaaagcttaactataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattttgagttaaattaatgcattaccgctttatttaaattcccgcgttatcactgttttatttagccatgcctatttatcattgttaagacattattattgttattgttattattaccttgttcaccctagaaaaatcaaaccccaactagtgggcactctattcatggtaccactagtatgattttaggtagatgcttcgctgattaattaggcaacattaggtggttttataactctagactttgggaatattctcaccacctggacactatggaatagttggattattgtggaattggattcacacgtccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagttgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtgattacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgctttctgcaaaacttaacccctatattattatccccttgtactcctttgcattaattgtgcatctccggtgtggcttgctgagtactgtggttgtactcattcttgctcaatctttcccccctccagtaagagaagcgttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacagagcgcctgtgaagatggagccgcaggcccgctagtccgctgctgtttatttttgattgtcaggccttaagtgcctttgtaataatgtaaatattatcgatataataaagatgtgtcttttatatcatatttgtgtgtggtgtaccccggcttttcctgggacggggattaatacactagcgttcgggaaaatgtatttttctcagtcgtgacataaagccagccgataatctgcctgctattgatccagacatggaagaagtcttggctgaggaagagattgaagaagctgtcgatgaagcagctgctgagttgagcgaggcacgagaacaaacaccaccagccgatatcccggctcctcaaagaacgcctccaacaccaattgccctagctcggcaaaccagggtaagcacttctgttcaaacttgatgcaagtaaaattttcatgtgctgatttctcttattaatacttgatttttgcagcaaaagaaatctgctggaaggaaaaagccagcaccagtaccatctccagctccatcggtaactttatttctctgaaatcttatgttaaactcagccgatgttaactagtaattgatcttcttaattggatcttctttcagccttctcctccttcacctcctgcccagccagcatctagtgaacatactccatcggctgcaagcagtcacaatgtagaagaagaagtccaagcccctcctactatcactgtaagtttctttcttcaagaagtctcatatcggctgtatacaaaattttcatgtacttaacatcttcatttgttcttttttaggtcttggccgcatatgttctcctttgatattcggcaatacttcgatgaagaagaggaagacaccactagcaaggctcttgcccctctaactgatgatgtgaaaaggaatctccaagatatatcaactcggttggaggcctctctagatgtattggtcgcctactgtggatcaataagaactaggttcaatgaaatccaagacttgatcccataagacttggttgctgcactgactccggctgctttccttgagcaacatcaatttaaattagagaaagcaaggcaaaggatagctgatcggcgagaaagaaaagacattgaagcaactatccaagccaatcggctgtccgtgaacaaggagaaggcaaggttagatcagctatccattgggccggtgcctattcaatccaatatagatcggctagaatctcgaaggattgaggtcttggctcagcttgaagagtgcaacaccgagttagccttaaagaggcaaaagttagccgatctgcccaaggttgttgaagaacagaagttgaagttgaaggctaccatcagaaatgttgccgatctaaccaagtccttgaagtttgttcctggaaccgacgcccaagatgaagtggagcaaattaggcagagggcaatatcggctattcaaagataccttgccgattgaactgatgatatgtaataggacttagaaatatttttgtaactggctttaaaactcttgtgcttccgtagtttgctctcatgaacttgatgccgattaatataacttttgtttttgatgtccatattttttgtatatgtatggccccttaattttaccatgttgacaaacattgataaaattaaaataccaactaaggacgatacaacaaacatcggccatcatacatcggcaaagcacaaccgattatgataagtgaaaaaacactaagggtgatataacacatatcggccatcatacatcggcaaaatacaaccgattatgataaaataagaagtctaagggcgatatgagtcatatcggccatctaaaggcaatgtaaacacctcggctgtcatgtatcgacacaatcgtagccgaatcatgaatggatccatacacttggataatatttcttcaaatactttccattaagagctctgccgaaaatttctccatcaagtccttgcaacatataagcccctttagaaatagacttataaatttgaaacggtccttcccaattcggcgaccacttgtcgaatttgttgtcacgtgtgccaatcggctagatcaactttcaaaccaactcttcttccgaaaatgatttcggcacaaccttcttgttataatctagagtcgttctctccttatctctcaccaccttctccaaagcacgcaatcttgattgcactaagtcctccaattcatctaccataagattatgataatcatcggctgtcaactcatcttgaaaatcaatcctcctcgatccaattttagtttcccacggtaaaattgcctaatatccataaaccaacttgtaaggaggaacttgaattgaaccatgacaagccatccgataagcccataataccttagccaatcggctatgccactaccttggaaaatcggcaatcttcctctcgatcagcttaatcaaactcttgttatatgcctatgccggcccattagcttgtgcataatatgg

SEQ ID NO: 74561 - DNA, 3218 bp, Oryza sativa
ctcatcgagtattagattattatatacaatctcgtgctgcattggttaggttcgacctactagattgttgtttataatataagtcttgctaagccaataggttcatgctaatgttttatcggggtgctagccgatacgttatctggacattgcatcggcttataaggattacatacaagttgggtttagccgattgcaacaaaggtttcactgtttaaattaatcttttggattttatgacatcggacctccagccgatgtatgctttaaccttcggatcaatgcttattctatcatattgtattgctagccgattggtttatactagattatattgttattttattacatcatcatcagccgattgcctttctatcattatctatattggacatatagccgattgcttaaatcctatcgctatcggctagtatcggcatcggctattattggcatcggctggaactactccatcgccttgtcagccgatcggctatttaatctacggtttacatatcttgttagttgcaggatcaaactaactggcacgcccgcatctcatcaaactttggacctgcactggagatgaacagatctctcaggccagtttgtctttttcgcatccacacaagggtatcgtatttattttatcccgtgggaagatcatgtagagagaactggactaataatttatacattgcttgtgataatcatattctaagcaggggttaagataattctagggtagagtgacacacaagcattaactattcaatctcataatatattatctaagctaggtgggaagaaaagagaaagataatctattcctacacttctaatatatatagtatacatacatcctagttaaccgatatactaggtaataccctctttctgatgccctcctggtacttcgagaagccacccctgattgccgagttccttacgacagcccgtcatgaccatacaactggggctaaatacggaggaataccctccccaaggaattaacctaggattatatataggcaaggacgaatacccgtactgagctatcaccatcagcggcccacctctcatccgcaatatataaccccaaataatgatatcccgtagtctagacaccacgtctaaactaccaaatactactctaatatcatcgtcatgacatagagtaattgcataagcaaacattatacccgcacgaaagcatctcccagataagctagccatatattcagtatagcaaaaatattcatgtaaagtaggtactcatatactcggaaagtatttcgactccataaatgtatttagaagagtattctaataatagtacaaagcttacaaaagagaagagaaaagctactagagccatacccgaactcttccgaaggctttcagactccgatttctactctatttctattccaccagctagatactacaaaactaaacttgagagaaataagagagctaattgcttgaggtgtgtgtgtgaagtgaggaggtgaagtccttatataggcaggtaatgacggttgtgatggttggaatggtcggtaatagcctccaaccgtcattggggcttcatctcaaccgtccagccaaaacctagatccaacggaggcgagggtggtttggccgaacctggggccaccccaatctagcccaatttcagctggcggcctcctccgttgttcttctccgtagacttgtgaattttggcccagtttgtcatgtcagttctgagttcttgacccatttattcataagtctggttcctgacatcgtccgattgatttatcatttgcgttgatgtcgattctcctccactttattttcattctctacaaaaaggttagtatacctaatactagtggaatattattactctaacacatttatgcattgtaagcatcactagctctctcctattttggtagtattgacggtcgaaactgatcgataacgaccgtcaacaaaaccccccaagcttgaaccattgctcgtcccgagtaaaggacgaaaggaaacaaagacttggttgttgatcaggagttgctactatgctgcatatctcaaagatataggtgcaaggtacatgtactctctctcagattaaataatctttggcacggtggcttatccttacccctgattcccacaagacactacttctccttgccttgggtagttgaaagacagaacaacaattagagcaccattcacccaatattcatccaactcttattccgaaagttttcaaatgattttgaaaaagataaccaagtttgttaaatgattcactcagtctctccaagtgtatcaaaaatgaattcctcaccaattattgcctttttgattccttctctaaggctttgatatgtggagttcggtagggatcaaacatgatatacttgcattcacatttattactaagtcaaaaacttagactaaagcagataactgaacatactcaagatcaagatcgtgcaaagtgtgtgatatatagtggaaatggtgtatgaagaaaaataaagaaaatgcttctcctttgtgcttactttcttctcccaaaaatccttcttttattgattaggagagggcatgattacatttttttttcaacatcatgctcatgtttgatggagcataacccccttttttttaaccatgcctttccatcctcttcttttccctttttttcaaaaggatttttctttttaggagaagaaagcacatgaaagcatggagaatttattttggtggtaatatggaaatggaatggaacattgcttagctcccagtgttggagtttagcacgtgcacatatgtgggtgtatgatcttgatcatagagcatgagaagtatctacacaagtcacaagagtttgacaaagttcagtggaatggcaaataaccaaaatgtaaatggtttcatcaagatagcacatttttggctctggtaggaatttttatcaaatgaggaactttcagttttatcattttgaaaaacaaaacatccggaattcaagtcaaactagtatcaggatcgtagcaactcatatttactatctcatatctcgcaacatcttagacttagatcagcaagtgcagctcatttaccttaggttcccggataattgttggctacttatatttaatctttgagagagtatttacgaagaacccatatgtaagagatgggtaccgagc

SEQ ID NO: 74562 - DNA, 2513 bp, Oryza sativa
cgtgtcaccaggtacacctcctgtgttgtgtgagtgagtaattaataattaacttgtcaaattaaatacagattttttgcgaatacgtaaaaggattgtacgtcaatatattagtaagaaatagaggttttgatacacaacgcaatcggctagacatacgtatgctggaagagagtaaaaaaaaaatcactgcaacaaccaattgcgaaaagaaaaggactactgcgaaaaaaaaaactactccaacaaacaagagggagggggtggcaccacactatgctgctagcaaatctcaaaagtggttggggaaataaaatgaaatggaatggaatggaatgcatacagtaattcacatgagggaaattaatttgaaaatagtggtattggttgtatctcaaattgttctcaaatttaattaacgtggggaatggaactgttgtgtgattaaatggtcaatttaattacagatttgacaagatggaatgcatacagcaatgcacatgaggggaattaattttgaaaatagtagtattagttgtatcaaattgttctgatcaaatttaattaacgtgggaacacgaaactgttgtataattaaatggtcgaattaattacagatttgacaagatgaaatgcatacacagtaattcagatctcaaattttataacgtgggaacgaaactgttgcatgtgtgattaaatggtcagattaattagagatttgacgaaatgttgtgtatgcactatacagtactacttcacatgaggaaaattctctatttctatcaaaatattctctatttttttggaggactatcaaaatattcttaaatttaattgacacgggaaagtgctggggagtttgggaaaaggggtaaaacctgtgacttgatggtaaaggtcacattctttctgggaaaattaatgagtggccgtctaacagtaacagatattatgcttttgttggtctcacatgatgagatacaaaaagaatacataaaaagaggaaaaaaagtatgtatatatgatcaatgattgcacgatcagcatgagaccggccgttgaaaagacgtcgtgcacgtaattaactattacatctaattttactttcaggtgtaaatatgcagatattatatacgttgtttcaatccaatcacgcgtattacatgcatgtctaatacctgaactagctaaatcacacaaaccaaaaaggggagtttatacatgtaaaactagctaccttagctaggtgatctaaactcacatgcaagttaagtcaaatatatatatatatatatatatatatatatatatatatataacaaagtataagaattaacacaaacatgcaaattttacatgttgaattaattacttatgacatattataccttgcaacaatgtgagagatgatgttggaggaactccaaggaggtagagaagcccacaacatcaaccaacattttcttctcctcaagcaacacctcctcttgatcaccaccttcttcctcctccatgatgccagtgaagaacccccaaatcaccttcatctccctacctgaaacaacctcaacctccaagtactccttcaagaacccttcaaccatgatcctaggcatctttgtcacacacaccctcctcatggcactcctcatcacatcaaacccttcctccccaacatcctcaaggaaccacttgggaagcacggctcgcccggcccgaaaccggcttgcccgtaaaccgcagaaggacaccattgccatgaccttcaaggccatgtcacttcccatgacacatagcaatgggtagaggaggaggagcacaaggcccctcaagaaccctcctgcctctagtgccacaagcatgaagtaggggaacaaggaggatgatctaagcaaaccgccttcgacgtcgagtactagggttttcgcggcgagcttctccatgggagggaagcttgaggaggacttgtgcagcaaggaagggtgtggcaatgtggtgttggtgttggatgatgatctagagataggcttcccatgaaggagtagggataccaaggcagagaacagcctatgtgacagcttcttcttgggcatggtgtactgttgttggtggcaagctaggtatagtatggtagaggaagaaatggattgaattgtggagaggtagatcaatggtcccttcttttataggacaagacaacacttggatttcctgcctgatcatgcatgaaagagctagatagatagataggtgaaagttccatacttattactagtacttaattttcagggaccatatgcatggcatgcatgcctacatggctgtccttctcctttagtaacaaactctgaaataaataatgcacagtttactttcttattcaggatagcatgttagatatttggtcatagatcgcacactagatgtcttgatctcattgagaaccgtccagcatgagctagtagccatagtacatgtatattcatggcagggaagaaagggactgtaga

SEQ ID NO: 74563 - DNA, 686 bp, Oryza sativa
ctataatcacaatactgttctaaatagatttgtcatatccatcacattagacagatctatcggctcatcgagtattagattatcatatacaatctcgtgctgcattggttaggttcgacctactagattgttgtttataatataagtcttgctaagccaataggttcatgctaatgttttatcggggtgctagccgatacgttatctggacattgcatcggcttataaggattacatacaagttgggtttagccgattgcaacaaaggtttcactgtttaaattaatcttttggattttatgacatcggacctccagccgatgtatgctttaaccttcggatcaatgcttattctatcatattgtattgctagccgattggtttatactagattatattgttattttattacatcatcatcagccgattgcctttctatcattatctatattggacatatagccgattgcttaaatcctatcgctatcggctagtatcggcatcggctattattggcatcggctggaactactccatcgccttgtcagccgatcggctatttaatctacggtttacatatcttgttagttgcaggatcaaactaactggcacgcccgcatctcatcaaactttggacctgcactggagatgaacagatctctcaggccagtttgtctttttcgcat

SEQ ID NO: 74564 - DNA, 1030 bp, Oryza sativa
gacatgccatgtcaccttcctatgcaaaatctatatgatttgtccaatttacccttacgcattggaaaataaaaaacaaaaggaaaaagttaaaaaaatatatggtatatgcaagacaaaaatatacctcaaaatatgtgaaaaaagaagtattttttcctatgattatgtctaattcacccttatatttatttttatatgatatacgtaagggtaaattggacaattcattatagattttgcatgaatgatgacatggcatatccatatgatggttttggtggacccaaggactattttaggctttatgataaaggttaaggatttctttggaccatttaaaaggtagggagtaaactgatcctacagagaaactttagggactaaagtagctattctctctaaaaattacatacaaattaaatttatgtagttaaggtcttatttcaaacaaatatttatttcaaagaaaacaaccgaacatgcaataaaaaaaagaaagaaaaattagattcaaacaatgttctttgttgcactaccaagccaagcaattatgcaggtgttttatttgcgctggaaccctttattataactatggagaaaatattgttgaacttatatagaggataaaaaatctaacttaattttaatcaacccttgatttgtttgttacgtaccttcacgaggcgattcaatcacacgaaagttgagttccttgattttgtaatttttgcttctagccatatttatatggcatgtgtacaaatggtatataggataattagctagcggtagtataatatttactcgatacaagagttgtgtgaacttaatctatcttttattcaaaagtcaataaatggtttttgagatatgctaaaaaaaatagaaccctcgatatactttaaagaagtacattctccgactacatataagacttgaacaaactaaaatgtttcccttcaacaatataaatgcccacacttaggctcatgccaccattcctattaccacaacatatcatccaaaa

SEQ ID NO: 74565 - DNA, 1525 bp, Oryza sativa
catatttgaattactatctcatattaaaatatagctatattatcttaaggtagttatatttttagatagcgggtgtagtttttcactagaactacaaatctatatgatgagtagggtgcgatggcatattgttatatatcgtctatatttgtatatttgtaaggaacgcatcaacagtgatgatcactattcgatgcatgcctagctatggttttctttgttatgttttttcacataaaaagtacattgtctatgtcattcacctatagtttcataataagaatcacttcatccagcgttgggctcatggtgactcgccgtcaccaagtccgcctatataaacaacatatatggattgcttatacggatgaactgcatttatacctaggaaaaatatgtagtggaaactaaaaactatcgctgtatctaaaaatgaacgcatgagatttgtccacgtcaactagagtaaaaattttactcccagcattactttggttgacgtggataaaactcatatgtctatttttagatctaacgaccgttttcagatttttagtgtatacgtggtttgcactacatatttttcatagattttcaggacctactctttgttgcttacatgtaaaaacagagtatgtccattgaggcacttcgtgcaatgcaaatctatatttcgtctcagtggtttagtaatgaaatcaatatttttttatattctattgtactagttctcggaaccgtcgatagctttgaacctgagattacaattccggaacgaaattctgaaacttcggtaatttcgcccccaccggcaagcacatatttcacacgaaagtttccgattatcttttttcagtttttgtgaattggtttaaaatttattcaaattcattcaaaattcgtcaaactttcaaaaaataattagggaaagaagtactgaaattccaaaaatttcggaaaccctgcttcgaaccaaaaaaatatctgctccattaggaagtccgattccggggctaaatcggaatgttcagttctaatccgatcagtccctcgttcttctccgactgttaatcggactcgaaccaaacagttcccacgcgccatatagcctcgccatccatgatccatccatggcgacgcacacccaccaatcgaaacctgtagaagaacccatggctgcagctacgcaagatcacctcccttcttctccggccggccccgccgccgaccaaccacagggcggcgggcgtacatccgccttgtcatagagcagctgctatccgcgacaccgccagcgacaccggccgcatccgcctcctgctccggcgacgcccccgcggcgtcgtcgccgccagcttccccgcggccgtcacggcggcgctcgacgacctggaggcgctctactccgaggggagcgcgccgatggcggcgctggcgcgcgacgcggcgcggtcgaggcgggcggggcacgaggagcggctgcgccgcgccgcgtcccagcgcctcgctgtcgagggcccgatcc

SEQ ID NO: 74566 - DNA, 749 bp, Oryza sativa
  unsure (1)..(749): unsure at all n locations
ttcctgcagcccatctgaaaattttatttttgataggcatatttcaatccaacaacctatatcttaatgactttctcggatttaatgcatgactctctattctttcacacatgattggctacatgggcattgagaaatgtaaatattaatgaatcgcttgtttacgatgaataactaatacatgtttaaatggatgataagtagaattacttatccttggtctgtgtgccaagatgaaatatgactatcaaaagtagatggagggagtatgtaactattgtatgaatgagctattagattgactatagatgaattggagctagtagttggctatactattaaacttgctctaaatggacattgatgcatgcatccatgcacacatgtatttataacccacatgcaatattttgatttgctattggctagaaaatagtggggatggtgcatgcattgagtttgttgctatagtaaatatagtatgagagagagttattagcttttcttggtcttggtgtacctatgaaatatatagattaatttggaatggagggagtattttgttaaattgatattcccaaaaaatattatgtagtacacgctaaaattcggctttgttaaattgattgtagtatcgtaaagggcatttctcaccccaaaaactaaacattgagccaatgaggtgaggggctcccccacttatatattangtcatttgcccttccacaaccaatgtangactattcaac

SEQ ID NO: 74567 - DNA, 1196 bp, Oryza sativa
tccatcattagcaaatgtttactgtaacgctacattgtcaaatcatgaagcaattaggcttaaaagattcgtctcgcaaattagtcgcaatctgtgcaattagttttttaagtctttatttaatatttatacatgtgttcaaacgttcgatgtgacaggtgtacaatttttatgtgggtcctaaacagggcctaggttcctgctccggcccttcgtttcgtagaatggagtaaaggtattttgttttttttccttaagtggcaacattttaacgtactcccttcccttggtcccgttccaagtaccgtcccattttaagtgtagtcatacgttttttttccaatatttgatcatccatcttatttaaaaaatttatgataaatttttaaaaattaagtcacgcataaagaactattcatattttatataataataataatgatgataataataataataataataataataataataataataataataataataataataataataataataataataataataataaaaaataagacggacggtgacactgaaacccacaactggacttattatgagacaaagggagtagaacaaatatattataaaaatatactattcaataatggagtttcattttttagagcgatagtggagttaatgaattgattttgtgttttaaagttgttattttttataaacttaatcaaacataaaatagtttgacttataacaaaactaaatcattctagtacgttctaagatgcacgaagtattagaaacttatgaattatatttctttagtttttgcacatattctttaaattttcaacgtaggtaggaaggcagaagtgggtcatttggtccaattttatttttaactgtagtgaaaggatatgtaatgagctctaaaactatggcattgtaataaatacatgaattataatgtcatatgcctaatcctaaaaatttataatagcatggatccattaatccaaaataattctagcagtggcaaaactaccttggaacgtgaattgaggtattacctgtgcaacttgaaacaggcttgcttagaaaaaaaaaaaactcaaaggatcaaaagagagtttcgcgcttgagaaaatttgaggctgtaccacgagaacaagtcctcctcgcagaataaatcaaattataaacgtgggctgcaggaa

SEQ ID NO: 74568 - DNA, 1380 bp, Oryza sativa
cataacgggaagagagattcaagaaggtagaaaacacgtgcacctcatttagtactcgatcgtacaaccataacatttccactagtttttaactgtttcttcaaaacaaaataatatataccagcagaatttcaatccacttcatccattcgaaggcatagatcgatcagactaggaaagaaagaattatttgctttcaacaagtgtcattgccagaaaatagttaatctgttttgaacttgtgcatgcagtttaattagggaagagaagtacagattacacaaattctctgcatcatcctagctagtcaatcagtgcagccgtatcaacgcttaattgattcaagtttcaagagaatgaccccaaatatccatgagttcactattcttcaattgacaatgtgcttgattgaccatcaaaatggcaaatggcaagtactatcggtacaaagatgaccataattatcgctggctcaactcgggtcagagaaatttgcaatcaagttggtaccgtacgtgacaaaaaggaaactgtagagtaaccagatgctgcctataaatagcatcagataatgaagaactttcaagccaagagttagccaagaacgtccataaagaagagatggcatccagggtttccactgtcatctttcttgctgccatcattctcccattcttgtcattcgccgaagcccaacaacctcaaactcctccaagaagaaatccaccacgtgcaccgccatcaccaaggagagcaccgtcaccatcggtgactgcagaaccaacaccggcaccggtcatagcaccatcaccaccaccagttgtagcacctagccagccgctagtcgtagcacccacacagccaccaacaccatctggtggtagtcaatgcctaagagaaaatgtaattgcacttaatgtatgcggacaacttgatttgtccacgttgctcaacaacccgactaaggctatgcaagactgttgtccaccaatcaacaatctctcaagcaccattgccgcaggttgtctatgtgaggctgtgaagattaacctcggtgtcaccgccgatgtcctcttccttaaggcagtgctccgcgtgtgtggcaaggctgagctcggcaacctcggctgcttcctctgagctttcatgaacatcttctgctattctattagtatattaatatgaaagaaagcaaggcaacaaataagtaatacctgagctatgcacagagctagagctctatgagatgttactgatagaataaataaagttgtcattttataaatgtgcctgcatgatgcatgcctagttgtatgtgctactgcaagatgttgcatgtactaatatacaaaataattcgatctgagtgttacatggaag

SEQ ID NO: 74569 - DNA, 2256 bp, Oryza sativa
cccccgtttattaacaaatggattgggtagacatgaggctaccctaaatacatggttttcttgagcctaatttgattgcatagtttgagagacaatccatcagtgaacatttcatttagagtatgtgcaaggctcgacatagcctagtgtgaatattattggatggctaaatataattgtctaataattattttgataaatgcgatgtatcatgaatagacggttgtctacaatatgtaggaagggggccaagggaatggtgaaggtgtaggggatttgcttttttctatataagtagatcaaatggtggaaaataatgtaccggttcaaatgataagggattgcaagatgtttttctattttttttatttttttatgattttctctaatttattagaatgccacgtgatggcttatgagtgtttgtatggataacgcgtggccgctttatattaaaaagaagccatcatttaaaatcgattacatgttatataaaatatagtttaaagcacttacatgcatgaatgattattagctttatttcgattatttgaacatattaattcaaaaaataaaatctcgaactaagcggattgttttctctaagtaaaggcaccatatttttctatagaatagcataaactctgaggtagttctttttttccttataaattgtatatctaatttagcaatgtatgtttgcaaaaacaatgtatgatgatgcaacctgtcccgtgtttgttgaactatttcgtattttttgtggcatttctgatgacatgtatgtaaaagggcattagtgtttgtccctccagatatatttttatgtagtggcttcagcagttcagttattcatattttcttatgtacggaatatataatttagttatgcatgtttgtaaaacaatttatgatggtgcaatgtatgttgttaaattatttcatcgttgttattgtcattttttaatgattagttttacattcaagattattttataaaaaatgaatatatatatattattttatcttgaattgttttagataataaaaatcgattaaacatgatgtaaagtgcgcttaaatcacctcgtgtcatgttttcaatgttaaaaaaaattcaaagaaaacaagaaacatactccctctgtccaaaaaaatccaacttctggagtttgaattttgtcccacaaaaaccaacttctaccatgctatctatcctcggcacataaaacgagaagttttctcccttaaataccctttatctacccatcaacattactatgggctttttataggacaaagggtgtaccattctccacttaaataatgaacccgttattttaaacattagatctattccagaaaatcataaactgctgcatgacatgtcttatattaaaataaaatctgagaaatctgaggaaaaaacaaatcattggttttcactttgatcgttcgaaatttttttttaaaaaaaaaacaaactccccaccacccacccctcccgttgtatacacacacaaccttgtccaccctccaccccctaccatttttatgctatttatgtctctttggtccctccctccttatttttagctagcaaactaaaagaaacaatcaataaatgtgtgtaattttaagctacatgtatgatttctaatctaactattgctttatttgtaattaaaccaataatataacatccatataatctaagatcccataagaaataataaaagctatgaagttatagttgtttgaaatttgttataaacattatctccactattataaaaattaaagatatttccgctcaaaattttgatgtcaccttatttcggtatgatgtaggtttcatccgtcctctccgagatttaaataaaaggtcccacgcaatccatcgtcccctttttgctgcagatgaaattttcttcccaagtattagtcagaccaagacaagtgaacccgaatcgaactcccacatgacgtctcatttgatccgctctgcaaccgaaaacaaaagccggaagaggagagcagccgctggacctagaccacacatcgacaattccctcctcgtcgccttcctgcttgctgcctcatccccaattgatctttcttccaaaaacaccaaaaacagaatcctccatgtacgggaacacatgatgctacctcattcctatccattatcaaatcagattgatcagtcccatgccagacatcattctggttctacatagggaagggctgcaggaa

SEQ ID NO: 74570 - DNA, 3424 bp, Oryza sativa
aagattttcttgttaatctcacatcataaaccaacacccatctgaccatcttgtgcgctctctccgtggtcaagctccaggaggaagcagagcagtatggcactgtgtaattgtgacgaggactccctggccggttgtcgaaacatgaattcggcaataataaaacggggtagcgcacaagacctaaagtggatggatgcagagacaaaggatttagacaggttcaggccctctcaatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaatacggtatcggtttcctaaatctactttacaatattatcaaaccagaactttaggctgttccgtaatatataaggaaacgtaatacccgagtcatgatctgttacatattccatatatatatgttatcccctattactagtcggataaccatgccgcatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatatggttaattgaataaaccaagcatatagtcaaggaataaataatccaaccaaccgagtggttttgataatcgtaatcaaccaagtgacttgatatcaatatatagcatatgcggtatgaatcctccaaataacatgatccgagtgatataccaactgctttgtaaaatatgatgagtgatatagcaaaatagctataaagaaacttgtatattgtgaataaagaaatttccaaagtattgggcatacgccatgcgcacactgctttaacagatgtgcttaagtctctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaacgatattgtatccaatcagttgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaaaaacgtgacaggccacacctgaaatatgggctgcagacatattaggcctaggccaaaacatatgccctcgacaccctttaaaggatgacgcatataacatgctcccgagtaataaatcttccgggtaatatagaccaagcgtagctcatatgaatagcttctgatctgagtgattatcccttatgggatactccaaaatagatgtaacaattgaatcccgactggcgcaagtattcggttgatagcccttacggggaataataattggtccagtctttgagcatagaaaatagactcatgacaatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcagcgacagacagatcaactaacaatgaagattaaaagcgatgaccaaatccatccatcatgaagatgaagaaaatagttgacgacgacaaacgcaaccgacatgatgaagataacgatgtcggtgatccagtcaatagcagtgtagcaaccaatgataatgacaaagacgctcatcaacatttgcatagtaggtcaaccgtgaaggtgaaataataagtcggtgaagacataatcatccattagcaacaacggagatgtcagggccgatgaagcaaaggtgctggtgatgatgtcagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactatagcctcttgtcgtcgaataattattgcttgattgaagatatgtgttgaagatgtccaagtagaaatcatgaatgttgaagagccacttgttgtagtaaaataacacggcatcgcatgccgagatgttgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggtacgaggcggtagtgaagacgcgcagttgtgaagataaaagcactagtcggcggcggcataaccagtcggcaacggaagacgatgatgtccatcagtagtggtagctgtctaaaccagacgtagaggtgagggcactagtcagcagcagatgtagacagcttgcgttgaagatgatgatgcttattagcggtgatggtgatgtagccagccgtgaagaagatagcatcagttggcgtcataacaggccagccgtgcaggcggtgacaccagtcggcggcggacgaggcagccggtcggtgaaagcgtagacgcccaacaacggcagcataataggccagccgtgcaggcggaaacaccagtcggcggcggacgaggcggccggtcggcgaagacgtagacgcccaacaacagcggcataataggccagccgtgcaggcggaaacaccagtcggcggcggtcgaggcggccggtcggtgaagacgtagacgcccaacaacggcggcataataagtacccgtgcaggcggtgccaccagtcgg

SEQ ID NO: 74571 - DNA, 1143 bp, Oryza sativa
aaggagacaacatccttgcctccgtatccttttatcctcgcctcacccacgctcacctcctcgtttcacgccctcacggttgcccccacgattctcgcgcccacggttgtctcttcgtttcccgcgtcaactcatcacgtcgcccattgaatccacgccctgcatttagtgcgcctatcagcggcacactcggagtagggcgcacaacggtcacggacacaacctgagtgaaccgtcaccactaccgccgcatgagtagcgggcaagagaatcgaggcgtggcctgaccgaccccccgattttcacgccttaaacatccccatcatcagcgtggtcagtggcggcaaactgctgccgtggttaatatgccaacctggccactcggcgacatttccttagattccctgtcgggcccacaaccccagcttgggaagtcgtgaggcaccacatcagaccgacctcaggaggtcagtgtccaatatggtgccaggggctactgtcggagatgggcctgggggtatgcgaagtgggggaaagttacctttccatccagccgcgtggctctacagcctagccctactcccgcgcctcgcgagtcacaaaagcggccggggggcctcggggtgccatgtcgtgcccctcgggctctcccgctgccttgtcccgaggccctcgcccagctaccatgtggcggggggagcgagcaggaagggggccgaggctgaacagccatcaatgcgcagcgcctcaactgtccctcaccgcatttaatgcggtaagggcagatgtgcggtgccgcctagctgacccacgtcaatcggatgtaaccagtctgtgaccggcctgttgccggtcacatccgattgaacgggcggccgtgcccccacgtcgcttctgtaacaggcggagtggaagtaggtatgacccgtcccatcagggcataattcggggttccctccatgagagaaggaccaccacaagtcttcacccatttataagggaatgacagggctgtcccccgtgtcaggcggggggtggcgctgggtcccacttaggacgggctgctgcttaacttctgagcgaaggcacggatcatggcccggtcaaggtaaggtgggtccccctcccagggaaggataggta

SEQ ID NO: 74572 - DNA, 885 bp, Oryza sativa
ttactaatggtatcaatatcatatccaaaatacaatatgctcggtaatttatacgaaagtacatgtagtttagtggtttgtagtgatctaatcgaatagcacctcaaggtcatatgttgaaatcttcatgagagcgaatttcacattgagttgtttgaggggctaagttcccaatttaaatgacaccacacaccgccgtgacgtgtggtgtccctcatcgagcgcctcggtcgtcgtgcgcattggacggaggcggctcttgcggctgccatggaggcgggtcaccggcgcctgcccctatagcgtgaaactgcccatgtcgccgagctcaaggagaggatattccacaagtacctcgtgccagcggagaagacgaccaactcaaggaaacagatggccgcttgagaactgatcttcgtgtgcttattaaatctttgtaaagcatttgtgaaatactgcccctgtttttgtattgtatgaattttggacgtaatattttactattcatcttattttatttttttaaaaaaattttcattaaaggcatttacgcatgacttatatgatttcactaaaatatgttgaataagtggaatgaaaaaacattatatattagagtaaattttagagaacctcattatggtcaaaattgtaaaaaaaaatacagatattatgacgcgtggcacataactattgatattgatattttggtgtatatatatatatatatatatatatatatatatatatatatatatgtttcgtaaaatcacacctttattaaaatctttattaattatagcatatttgaaacaatttttcaaagtacagaagagataaactatcaccattagttaagaacttaataattaaaatttttatata

SEQ ID NO: 74573 - DNA, 3195 bp, Oryza sativa
ctcatgctccatttgtgaccatgtagaaattgaattaggagcaagtaaactataccatgtagatgcaaagtttgacaaagaaagaggaaacaattttaacttaagcaaatcatcactaccggccttaccacattgttcaataaattggccgatatgctcctttgttgttctagtatcctcacctatgaattttgtgaagttgggcacctcaaatccttgcggatatgggaccgaatctacatgttcaggatacggcctttgatacgtatgcatagctactttgggttctatctcactactatcccgcaagacattgtcatcatcttttccaacatccacataaccgattagtgactcggtcttaggtgataatgctatgcttgtgatataacctgaaccgtcacttagttcggctatattttcaatgatgctattctctaagctagcaacacaatccgaaccattacttggttcggctattccatcgttgtctaaactagtaacaaaatccgaaccaatacttggttcggctataatggttgttgcattatcatccaagctagtaagacaatccggaccaacatttgattcagctatacttgtcacagcatcattgcacaaattattaacacaatccgaaccatcgcttggttcggctatgcatgatattgcattttcatctaaactagcttgtaagctattgtcatccactcggctttcctgagccagagcttcatgcaacacatgatcaatatcaagaaatatctggccattcaatttctctttaatagaatcaagcaatccattatatgcaatgtcggccaaatctttgtcagttattttcaaattgaagcatcggtttttaacatctccaatcctttcaatataatcaacaacagattcattgtatttatgtctaaccaatgttaaatcagacaacttaagctcagtttcattagtgtgaaaataatcatgaaatttttgttctaattgagcccaagcagaaatagaatttgatggtaaagaagtaaaccatgtaaaagcagtaccagacaaagataaagaaaacaagcgcaatttacatgtatccatactactagccctaccacattgcgctaagaattgacctacatgttcgcatgtggtcctactatccttaccactaaacttggcaaattcaggaattttataatcaggaggatatgggacaacatcataaaaattaggatacggcatttggtaaaccctagcatgattccttacctccatgatttcaggccttggtggatttggtggtggatttgatggcctaaaaggtggttgttgcggcgcaatattgtcatattggccgtacccggtgtcatgagaatatcctctattatgatcattgtaagcattagggacatgtggagtagcatgactaacagtattacagatgatgaataataattaaaatcagcactgctagtcgtggtatgaaaacctggagaaatttccagggaaccagtctgagtatgaccggccaagcacccagtctgaccagcccatgcccagtctgaccggtggtcaatggtacggtcagaccggccacaggaggcgcgatctggccaggataggacacggtctgaccgtttatggtaggcatggtctgaccggcgtagtacacggtctgaccggccatggtgggcacggtctaaccggcataggatgcggttagaccggtgtcatgaccagtcataccgttatctaggttttgcatatagccgattcctgtgtaatcagccgtataaacactcattgaccccccatagcattataagcatattgtataggagtaaaactagaagtagtatatacatctacacagtgattattagcaaaggacgggttgggcgaatcggaggttacctttggtaaaactacaacttgaggaagcgagacgttttccttcacgatgccttgattggtcctgatgtatgatttcatcaacagctcctgcgtaaccaccatcatcttgtgttgctccgcgtcaagatcctcccatgtgacctcgtcgatcttattcccgctcatcatggttgatgaagaaattccttgattaattccggccatatagatcatagccgaaatcgctgaccgaatagattaatatacggtcttgtaattttccttgtatgctactgtacttagcaaaaaaattggagaatttgaagcttctcgggaataaccgatatagcaggaatcggctttttttttatgtgaacagaagtagatcggcttggatagcctgatctttgttttagcacgtgcacagtaataaaaagaaacaaagctcctgctgcttgtctgccaggtagatcggctctagaagcctgatattttctctgtttgccttatgaaacaaaaagaaacgaggccatcgagccggcctctgcctcctgacgatgatcctcggtatacgcggcgtgctgaacggcaagtattcagatggattcagtgacgactagataattaacttcgccgccgaaactcctgatttgatgaacagtaattactagattaaacgaaattcggccgtgatatggccgattagatcgttccccagcggagtcgtcaaaaatcacgttggcaactttttatgacaagtcgacaagtacgatcgcaacacctaaacgccttgtggtgatatggagtcgccaaccacctcaatctagccaaagggccagatcaacatgggtactgtagaaaaacagctaaaccgactagcggagccgatttagagctcaaaatcagcctctaggccgatttagatcgatatgaggataactacccgtctcgtgggcaaacggaaggttttcaggacaaacctataaaagggtgtcgcagtctcgcagcggcgacggacggtttacggcgcaaaccgacaaagatggactaaattagggtaaaatagaaaacatagtaaaagaactattcaagtagattgtattcgggggttttacagtgaaccggccttgtcccttaaatagggatagaaaccaaaggaaacacgaaacatgccttcccaggtaagaaacccgagacccgacgaaaacagactcggactcggaccctgacggtctaaccgcccacatacctgcggtcagaccggccctactagccggtcagaccgccaatacacctgtggtctgaccg

SEQ ID NO: 74574 - DNA, 1194 bp, Oryza sativa
tacacaaaacgacaagtaatatacagttccaaacgtaaataaagcgtaaaatacttacagaagaggcacttagtcctcacaccgaaagagaacgacagcagcgaaaaaaggcgatcctagcggggcttcagctccactccacaggcaaaactcaactggggtctgagccttggtcttctaacttcggcttcagctcagaagcactacacttctgaaaagggggaacaatagcaaggctaagtacaaccaccgtactcagcaagccataccaatgatgcagacgtgcaaggggatacgaggatggtttgtggctatttgcataaaggcggttgtagaacattttattgatcaaaacagtaaaacagttgagtaattaaggtaatattaactctcgactgaacaacgctacaccacattgaacaggcccaaccaatccacctgaactacagtgcattgggtcgatttattaagtgtgagactaatcacggtgaatctggttgatcgcctataaccgtgggcatggctattcgaatagttttactctggccagaggtgcacaactgtacccacaagacacaatccaccggcatgtcaccgtgtcatcatgtgcccatgatgaacacgtcaccatgtcgagtgattgtgacaagacccttcatataactctcccctaaccatccacaccacgctaaggtttcacctgcactcctcgcaaggcagccggcagtcccctcgtgcgccgcggtgaatccggcagctggacaaccggacaccccggccgacccaactccatgacgcccaccctcgccaccggtgcctaggaaagggtcgagctatactccagatcaagcagttacccactcccgcttgtggtaagcactgtaattcttctagggtttctcgtgaaccggtccttaattgccatgggcacaactaacaaaaccatgcacccacagcccaccattcagttgcattttagttggataattacgaccatgaaacatggctagatgtctcgagcacgcagcttgtcaagatactagatgtctaaaactgtaattatcccatcaattgagctagtggtaattaagcatggctaagcataaagttctagctaggtcacataagtaatacaagctaggcgatttattacccacggttgacaaaggacagatatcaagtaaacatggcaca

SEQ ID NO: 74575 - DNA, 1154 bp, Oryza sativa
aaaaatcatcatgcaatatcccatcccacacaggttaagaatttagagtctagccaagtgtaatacatgtcccggtgctcagtaaccgcgagcacgactattcgaatagatttggtttactcacactgcagtggatgtacactttacccgcactccgcgactgcccaacacataagcctcgtctcaacacatgagacgcgtcacggcaaagcttttcgataaccttgcattggcagtacccgctccatgaactcaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccaatgtagggcacgcctctcggccctacctcaacggctgccccaccgtagcgcacctgtctcactcaggggtgaaccatctatgcagggatactgcctccgctcggctatctaatccgctaggtctatacccattcgagaagtacggttgtacgggggttgtttcatgcttaacttcatggctcggtctttaattgaccggggacggtactagccttttccagataccacccaaatcctccgtccgtcctagtcaaaaatagttgtttaattttatttccctttgataaatcatgtcatcattatcatggcaatgtggcgctcctgtctccacatgtcgcatctcaattaccttcccaaaggtaattgcccaggcatatagcatttgctaaatatgagcatgcatgaatctagagtagcatttctaagcaattgtcatggttgactagggactcatacataatcatgcgtacaaagatttaaggataaacaataatcaaggcatggcataatcacaagtgagatgttcatcattgcatgcaattttatttgtaaacaaaatagtttcgcaattgggatcaacatgtttaaagaatagtgatgacttgccttgctcgtagttctgtgggtcttgatcctcgctcggatccgcaactccctctggctctaaaattacgtgcgaagaaacgatttgaattcggttagatttcaaataaagatccaagtaaatccacgaagatatcgagagcg

SEQ ID NO: 74576 - DNA, 1775 bp, Oryza sativa
gtctaaagaatgctattgcttcaaattacaatctgttgtttattaacaggaatgcttctatcatgcgagtgaactgatataggacgaagggtcaggaggcgttgggatttgtactgctccatcaagcatctgcatcaccttatgcattgttggccgcatcgatggctcctcctggaggcaccacagtgccacagcaacgaagcgctccaccttttttatgttgaagattgcctcgtcatcgctcgccaccagcaagtcaatcctcccacacctgtagcaatcatttgcccaataagttagtattgtctgctcctcatctgcaacttctaattccacattcttcctgcagcacacaagctcaagcaggatcactccaaagctataaacgtcgaccttagaagtaatccctatgttcttgaaccactcaggtgcaacatatcctcgagtaccccgaatgccggtgtttgtttgtgtctgattcaccggaagaagctttgctagaccaaaatctgaaatctttgctacaaaattatcatcgagaaggatattctgtggtttcatatcgcagtggatgatttgtttattacactcctcatgtaggtagaacagtcctcgtgaaaccccaagtgcgacttgaacacggaggctccaatgtggatgggtatcgctgaagaggaatgtattgagtgatccattgctcatgaactcatacactaacagcctttcagttccctcgttgcaaaaaccaagcagtctaactaagttcctgtgaaatgtctgcccaatggtttggacttccaccaagaactccttttgtgcttcctgctgaagcttttcgattttcttgaccgcgatgttagtcccaaactcatcttgcagctgtcctttgtagacaacaccagaggctcctgtgccaagtacttcttggaaaccaccggttgccttttccagctcgctgtaagtgaaaatctttggaggtaatccagagttattggacggttgcgataactgggttttcttcctcgaggtgatactacaataagtaccaaaaagcataacagagattaggagaaagttcaccaatacagagcttccaaaaagtaatgaactcccaagaatccaatactttttggtcctccttccatttgcttgagccgctgctgaacacggatggtgaattggtgctcctaggcaccttaataagaactgtcctcggtacattgacatccattttaccgttcgacaaagggaaccttttcttccaacaagtgcttgaagctttatcgaacacagctacggcacagaaacaatcagtcacacacagccttcggcattcggtctgatctatgggattgtattgctcatagtcagatagaggccaatcaacgcgatcgattggtgccatgtcatactgcaacattgctgtcgtctcatccagatcacagttttgtggctcaaaatctggcctgcagcctttgtatttccttttatcatcgatgaacttataattctgtgggcataaacaacttgtcgtgttcttggtgccatcaatggtgcagtaactgttaaagccgcatgctccactacccaccattgtttgtattgactggcagatgttttctggaagtacatcgactgcagtccattgctctggccataagggcctggcatgtatgttttttgggtaaacatattgccggaacacaccatctgtgtcaagggtagcacgatggaagaaatcacccatagagtccacccctgcagaagtgatattt

SEQ ID NO: 74577 - DNA, 801 bp, Oryza sativa
acatatatttaactttacataagtatgttatatgtatacataaatttaagcttatacaatataaattataaattaactccattttagccatgcacaaaagttagatatttgattgaagagtcaatcaatctgtaagtagagacatgccctataaatatcgacatatttagaatacggtaattatcatattataagaaacggtaatttccacaagaatacggtaaatacggaaacgattggtataatagcaaaaccatttccgttttcatttccatattttttaccatttccatttttattttggtcgattaccatttccatatggctcaactggtagaaagtcgaaacgaacatcggtcggcggggaattactgttaccgttttcacccctacttacaagtttgcacaacttcaatccccgttaaatggctaaaaaatgggttaatttgatctgtgccattgcaaatatgtctgttcagataaataccattataattcatttatgcgtagccgtgccactcaaattttacgaaattagaaccatgctatcactgtcaggttttccatcttccgaatcggcacatgggactcacccatcagattcttcttcttccttacaccctccattatcttcttccttccccatctcttcgtcgtggcaaggagcgcgggcaggatgggagggggtcggcgacgtgtatggtgtggccctataggagagcaccgactaaggcgacgaggccgtgagcccctacgcttccatgacctagaatgatgggacacgcagcacggtcttcgcct

SEQ ID NO: 74578 - DNA, 1206 bp, Oryza sativa
ttttatttaagcaaatgtgaagcttgttatgtccttaatgagttagcgtaatgcatatcccgccaaatacgttgaagtgatgtgttgcggcaaatgagcaaatggtattttgtacccttttctttttgcttgagtcaataggaaagccgcactattaagagggatgatgcattgacaaatgagcagtgatcaaagtgctcaaaatcaatttttaaaagtgtttctcctcagttatagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaacatccagaacgatgtttttggctctgagtattttcggacttgttcgaaagtgattttcggacttttccgaaagtgattctagaacgatgtttttggttctggatatttttggacttatccgaaaaattttcggaatgtccgaaaattctctcgttgactttgctgttggtgctgaactggaatttttggacatgtccgaaaatctttcagaatatccgaaaatcacaattattgtgtataacaggcagaatttgggctttggctataaatagccccctcccctcacttgtgagggctgctggtcacattggatatttttgtgcccttggcttgctcttgttgagattcacttttgagccttaccttcttgtttcccctctcacccatgttcgattcggatttggtgtgtgtgtgagagttgtggattcgagtttgtgtgagtgcttgttgctgacttcgtgaagatttgtgagcacttgcatcatctccgggagttcaatgcttcatttgttactcttggaggttgaggactcctaggcggctaggtgtcgctcccgacccaccgatctacatgtggttggccgggagaagtttgtgaaggtcggatctcacctccgaaagggaagagatacccttagtggaaggaggagtgcttagtgcaacctcttgaggaaagggttagctaagacccggctcttagtgagctcctcaacggagagtagaatccctcaaggattcgaactttgggaacaaattcgtgagcttcatctt

SEQ ID NO: 74579 - DNA, 1239 bp, Oryza sativa
tcctgagctattatatgccaacattttttcataaaggaaccgttgaacccatctggtccaagcgctttatctgctgggacaatggatataagactgtcaatttcctgtgtggaaaacatgtccaccaaacattccaaatctgtgcttcgggagaagagagtactcaaatcaaaggccatttgaggaccagctgtaactcccattctattcttaaaactgtgaagaaaaagagatgccttttgtgcatgtagctgcacaatctacccattttgatccaaaacttgtgacactgcattgattatgtatctctcagttgcaatagattggaaaaatttagtattttcctctccaagcatcatccacctgttagtgcacctcttcttctaataatagatctttctaaattcctgcaacttgagaatttgcacttttacaatttctgttagattccattcaaagactgagagaattcttgtttcttccaccaaatccaaaaaatcaatcactttgttacagttggtcagaagcaacagtaatttggacagatttttgctccatgcaagtaatctctttcttagcaatttaagcttaaaagaaatgcatttagcagggtcctcaaaccctggatccaaagaccagacctgctgaacaatgtcaaaaaatccctccatctgcacgcaataattctcaaatctaaaaataggggattttggaatttttgtatcaatcttcactacacatggcacatgatcagagatatttctagttaaaggcaccactgtagtgtttgggaaagccaaggtccatggagctgaagtgaacacccaatctaacctttcaagaagagggttttgttgcgtgttactccatgtgtattttctacccttaagagggatctcaagcaagccaagggagctgataatgtcattgaaaaagatatcattcatatctgctccagatttgtttctatcctgcactgatctatagaaatcgaagtcactaaaaataaagccaattttgctgatcaccaatgctaatgttcttggcaaaatttgctacagacatctaaaaaacgtgtaattagctaggggacaccgtaaaaacgcgtatttgctgtagggcatcgcaaaaaactggtaattagctgctggacacccgcgacattattttattattttcggaggaataggagagagaaacaatcattaaagacaaatttgcccttggctcaaatgaatc

SEQ ID NO: 74580 - DNA, 1124 bp, Oryza sativa
tgcggctgctaatgcctatgcatcccttgctcctgatgatagcaactcagctccactgccgccgccgccgccgcatcactgccgcacggcgtgcccgatctacccttgtccccactcatacccgctacgacattgttattgggcatcgttgttgggctcagcatcgggtttgcaggtgctgaaggtccatgcatgagaagagcgcccgctgcgatggcttgagcctcgccgcgtcgccgttggcggccgcctcgcgccatctggtccagcctcccaaatccggcccggagccgctgcgctcccggcgtggtcgcgcccgctgagcccggccgtccttgcgtgcgcgctgacgccgcccaaccccgccggcaccacctaaccctccagctcgggcgccacctccgccgcgtcgtgctggcctcgacccttgcgcacgaccgcgcaacgccgccccagccgaggcgctgcactggtccacgccgtcacgacgctctccctctccctggggctcgcttgaatgaagagcagagaaagagaattagagagaaaaaaaaaataaggaagaataaagaaaaagaaaaaaaatcgaagggtataaccgtatttacacaactgtttctctctcctattcctccaaaaataataaaataatgtcgtgggtgtccaacagctaattaccaggtttttgcaatgccctacagcaaatacacgtttttacggtgtcccatagctaattacgcattttttggatgtcctatagcaaattttgccaatgttcttaaaccaagtaacaaaatcagatctctctgggccaccacaagggccataaacacaagtcaaggaccaggtttgagcagtatgcctcaaattgaaatcaacaaacacagagaacagattaatttccgccacagctccgacaaaaacccttgaagactaaacaaccaaaatgcccctgaggcaccactagagggtgcaaaagcaaacgaatcaaaacgttttggggcaaacttcctgatatctgagagatcaaaatgatcctttttttgtctcctgaatgcaaaaaaaacctggcactcacagtcctcaattttctgtctcaaagagagcaattttggctctgcatt

SEQ ID NO: 74581 - DNA, 2355 bp, Oryza sativa
atgaaaagattacacctggcttgaccataaccatacaagctggccaaaactgttcttctgaaacgcggttggaaagaccaacctcaggaggaaagaaacacatagaaagacttctgaacacgtatttctttctctaaagacttctgaacacgtctttctttctctctccatacaggtggtcaatgcattcaaagccgacattttctatagttttgataaggaaatgtgaaccaatctccctcttatgtctatcatattgacagctttgtaattgcatttgacaggttcaaccggttgcctcgcagagaaacttttggttagtcaagtatggaagtgatcaagactaacaaatgccgctctccaagggctataagttttgttgtcatctagtacgagcaaaaggttgatcaatagcaatggcacctctcctgttcttgcccatcctgcaactcttgctactatactgcaccaaatctgcccaagctcagctaaacatcagcataggctcctctttgacaccccaggggataaacaactcatggatctcgcccactgctgattttgcattcggttttctggcggtagatggaaactcctcctcatacctgctcgctgtctggttcaacaagatcgctgacaagaccgtcatctggtatgccaagactagctccaataggcaagatgatacaataccgatacaagtccaagctggctctatcctcaagctcgctgatggagcactctctcttcgcgatccatctggcaacgaggtatggaatccacgagtcactgatgtgggctatgctagaatgctcgacaccggtaatttcaggcttttaggcactgatggcgcaacaaagtgggagtcctttggtgacccttctgataccatcctacccacacaagtgctcccactagggacagcactccacagccgtctcctcgccacagactattccaatggccggtttcaactaaatgttcaagatgacggtaatcttgtgctgtatctagttgctgtaccttctgcatactaccatgatccatactgggccagtaacacagtggggaatggctcacagctggtgttcaatgaaactggaaggatatacttcacgctgactaatggttcacagataaacatcacttctgcaggagtggactctatgggtgatttcttccaccgtgcaacccttgatacagatggtgtgttccggcaatatatttacccaaagagcaaacaggccaggagcttatggcaagagcaatggagagcggtggatgcacttccggagaacatctgccagacaattcaaacaaaggtaggcagtggtgcatgcggcttcaacagttactgtacctttgatggcaccaagaacacaacaaattgtctatgcccacagaggtacaagttcttcgacaatgagaggacatacaaaggttgcaggccagattttgagccacaaagctgtgatctagatgagacagcagcaatggtgcagtatgagatgacaccaattgatcgcattaattggcctctatctgactatgagcagtacagcccgatagatgagaccgaatgccgaaggctgtgcgtcattgattgcttctgctccgttgccgtgttcaataaaccctcaaacacttgttataaaaagaagctccctttatcaaatgggaatatggattccagtttacaggcgacagttcttcttaaggtgcctaggagcaccattcaccatccatgatcagcagcggctccagcaaatggaagaaggacaaaaagtattggattcttgggagctcattgttttttggaagctctgtattggtgaactttctcctaatctttgttctgctttttggtacttattgtagtatcacctcgaggaagaaaacccagttatcgcaactacccagtaattctggattaccttcaaagattttcacttacagagagctggaaaaggcaaccggtggtttccatgaggtacttggtacaggagcctcaggtattgtctacaaaggacagctgcaagatgagtgtggaactaacatcgcagtcaagaaaatcgaaaagcttcagcaggaagcacaaaaggagttcttggtggaagtccaaaccattgggcagacgtttcacaggaacttagttagactgcttggtttttgcaatgagggaactgaaaagctgctagtgtatgagttcatgagcaatggctcactcaatacattcctcttcaacgatagtcatccgcattggagcctccgtgttcaagtagcacttggggtttcacgaggactgttctacctacatgaggagtgtaataaacaaatcatccactgcgatatgaa

SEQ ID NO: 74582 - DNA, 1825 bp, Oryza sativa
gtaattacctgcagtggttaacagtaattaactgaggttagctcagctcagctgggttgcgtacaaagtaacacgactgtctagaagaagaaaaatcaaatgaacactatattcagagaaaaaaaaatgaaactatatatttagagggggggaaatccttatttgctactccactttgagctgtcaccaaactaggtatgccgatgtaggcgaggctggtgatgtggagacttgttgccgcagccaccgtcccccacctcgtccatggctggcgccgcctccccatcctaagcatcatcgcccagatctagtttggtgtcaagcgcatgcgaatggctgctacttggggccatcagcaactggatggcaactgtggcgggctggcggcaaggtcaggaagccgatggaggcgggagaggaagagttgatcagcaaatgggagacgaggatgggcggccaacggccatactgcccatcagccatggggatgggagaaatagcaagaaagaaaatgaagagggaggaaggcgatggttcatggaaatttaagtatttgctactattctatttatcaattatccaaatgccaattttaattttgtgctggtaaatttaacgccccgcgctttgttacgggatatatattagatagcgtagaaataataaaatgagttggattgaaatatcgtgaaaaagatgatttggcatgtgcatatttattgttgggagtacctatagaacatttgacatttttctaggagaaaaacttaaatgtaattacaatctaactagtgtgtaactagaggtttactctgatctaacaaaaagtatcaaaaagtatcttgagtatcagtacatccaacgatcggaaacgatttggtaccgtgagataccagtacctcgaggtactttttgtttgaatagcgcaaatctcacgtaactaagatgtacttactccgtttcacaatgtaagtcattgtagcattctccacatttatattgatgttaatgaatctagatagatatatatgtctagattcattaacatcaatatgaatgtgggaaatgctagaatgacttacattgtgaaacggatggagtaatttatatgtaagaaagttttgatcgaaggcgggacctcgagcccacgagtcgcccacgcgccagtggctcgggggcaaaccctagccgccgccgccacccaccctcctcccctctctctgcctcgccgccaccggagttcaccgccgaacaaccatgcggggagccaggatggcgagcggggccataccgcggcgacgcgtcgtctctggcaagagggaggcggggcggagcgcggagcgcggtgagccgagcggagcacggtaagccgagcggagggcggcgcgctcgatggcgagggaggccggggatccggcaccgcggtggctagatccggtgctcccgcggccggatctagctgcacggcgcagggcgacggctccatcatgggcacggaaagctacggctgaaggccgccagcggcggcggcagcggcacgagggccgcgtgccggcgaggggaggactgtcgcccgcttggcagcatgctcgtgcctctctccggccggcctggtggtgtgcgcggggaggagctgtggggtggtggactgggctagctggtggctgagaagatgatgtggtggttcagcgacggttgttgtgtgaggtggtggtggcaatggatggaaatcgctggcgaaagccttgcttagcacttggctggcatgacgacggcgatgccctttggcaccgtttcctttcttggaggcgtagttatggcattt

SEQ ID NO: 74583 - DNA, 780 bp, Oryza sativa
ttctgaaacgcggtaggaaagaccagcaaggatcatgtcaggagaacccagcatggttaatgcattcaaagccgacattttctaaagttctgataatgaaatgtgaactaatctccctctcatgtctatcatattgacagctttgtaattgcttttgacaggttcaaccgttgcctcacaggtctcaagactaacaaatgccgttctccaagggctataagttttgttgtcatcagtacgagcaaaaggttgatcaatagcaatggctcatctcctgttcttgcccatcctgcaactcttgctactatactgcacgaaatctgcccaagctcagctaaacatcagtataggctcctctttgacaccccagggggtaaacaactcatggatctcgccctctgctgattttgcattcggttttctggcggtagatggaaactcctcctcttacctgctcgccgtctggttcaacaagatcgctgacaagaccgtcgtctggtacgcaaggactagctccaatgggaaagatgatacaataccggtacaagtccaatctggctctgtcctcaagctcgctgatggagcactctctcttcgcgatccatctggcaatgaggtatggaatccacaagtcactgatgtgggctatgctagaatgctcgacaccgggaatttcaggcttttaggcaccgatggcgcaacaaagtgggagtcctttggtgacccttctgataccatcctacccacacaagtgctttcactggggacggcactccacag

SEQ ID NO: 74584 - DNA, 2917 bp, Oryza sativa
aaaacttatttgaccatgcaagagatactatggaagtgagctgatgaaggaacagggatcaggaggactggggattgcaactgcaccatcaagcatttgtgtcacctttagcatgttaggtcgcatgcttgggtcctcctgaaggcaccacaatgccactgtcacaaatctttccaccttcttaatattgtagatgcctcatcatcgccctctaccagcaaatcaatcctcccagaccggtagcagtcattggcccagtaagtcactatcgtctgttcctcatcgacaacctctagctcgacattcctcctacagcaaacaagctctagtagtatcactccgaagctataaacatcaaccttggtagagatcccaatgttcttgaaccactcaggtgcaacataacctcgagtaccccgaataccggtgtttgtccttgtttggtttgtcaaaagaagctttgctaggccaaagtctgaaatcttggccacaaggttgtcatcaagaaggatattctgcggctttatgtcacaatggatgatttgcttgctacattcgtcatgtaagtagagcaaacctcttgccaccccaagcgcgatatgaactcgggtgttccaatgtgggcgactattgtcgaacaaaagacggttgagagggccattggtcatgaactcataaactagcagtctttcggctccttcattacagaaaccaagcaatctaaccaaattcttgtggaatgtctgcccaatggtctcgacttctaccatgaactccttctcggtttctggttggagcttgtcaatctttttcactgcaatgttggtcttgagttcatcctccaactggccccttggtaacccccaacccacaccagaggcaccggcacctagaatctcatggaagccagccgttgccttctccagctctttgtaagtgaaggtcttcaagggtagttgggatttacttgatgcttgtgacaatgggatattcttttttgtggctattctacagtaagtaccaaaaaggaaaatggagatgagtgcaaagttcaccaatatggaggttccaagaatcaaagaactccctaggacccagtgcttcctgttcctcttccatttgttggagcttgtactgatcatggattgcgaactattgctacttggcaccttgagaagaacggtcctctggacatagtcagccatattcccatttgacaaagggagcttcttcttccagcaagtgctggtgctctgattgtacaccgccatggcgcagaagcagtcgatcacacacagccttccacaatcatcttgtcctatgggctcatatttctcatagtcagacagtggccaatccacaccataaattggtctcagctcaaactgagcaagtgccgttgcctcatccaagtcgcagctatgcggttgaaagtcttgcttacaccctttgtacttcttctgctcatcgaagaacttgtaccatggtgggcattggcagcttgcaatctgattcctggtgccatcaaaggtgcagtaactgttgaacccacagacgccactgccaacatctgaaactatggcatggcagatattctggggctgcatgctcactgctgtccatgtctcaccacctaggatgcctgcattcgctttcttcgggtacacatattgccggaaaacaccgtcagggtccagtgtggcgcgatggaagtagtctgccattgatccaattcctgcacctgatgagatgttgatctgtgtaccatctgtcagtgcaaagtataccttcccagtctcactgaataccaactctgagccatttccagtcgtgtcagtggaccaatattgctggtatttggatccagagggaacagcaacaagatacagggcaaggtttccatcagtttgcacatcaaggagaaaccgaccactggagtagtcattgatgtcgagtcgggcacggagtgacttgttgcgagtcttgttgcaaggtatcacctgagtaggcaagatggtgtctgacggcatgtcaaaggtatgccactttgtcgtgccgtctgcaccaaggagcacaaaattgccggtgtcgcgcatgctagcatatgccacactggtaacctggggattccagcccccctccccagaccggtctttcagtgagagtgcaccatcattagtgagttggagaaaagaatcagatggcacttctactatcgatggatcttggtcagtatttttggcataccagacaactgtcttatcgctaatcttgttgaaccagacggcgatgaggtagaaggaggtgttgccctctacaggtcggaagccaaatgcgaagtcgccagagggtgatagccatgaagaggcaggactctggggtgccaaagtggagcccaatgtgatgttcttctgagtttgtgcacaagttggggacagtagctgcaacagcatgggaaagagtagcagagcaaccattgttctttgcttcaggctcttgcttcctacccctgataacagctggtgagctgccaaacttgtgtagttatagagctatcctaacacttgtcatggaaaggtcttcgtcaccatggaattctacatatacttgactaatcaagcacttactggaatttgccacgcagaaagcagcaatagggaattcgtgtcacgatagcagtaaatccgtagaaattcttgtccagacaaaaacaacaggtaacagctagtgagaccaaatagaccaaggcatcaagctagtcaattctggccattagtagcaccacggggaggatttgctgtcgtcgacattcttgctgaagtagacaggcttgacaggtgttaactagctatagattgccgagaaaatgtttttctaccctacacttcagggcagaagaaatgtttgcatacattga

SEQ ID NO: 74585 - DNA, 3541 bp, Oryza sativa
attcgtcatcaatgatgggtttgttttcagagctaacaagctatgcattgcagctagctccgttcgcttgttgttgttgcaggaagcgcatggaggcggtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctaggaccaagagggggcgtgatagcatttttgtggttgtggatcgattttctaaaatggcacatttcataccatgtcataaaactgatgatgcttctcatattgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatcccaatactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctggagatttggtttggttgcatttgcgaaaagaacgatttgctgatttgagaaagtctaaattgatgcctagagctgatggaccatttaaagtgttagcaaagattaatgagaatgcatataagattgatttgcctgcagatttcggggttagtcccacatttaacgttgcagatttgaagccgtatttgggagaagaagatgagcttgagtcgaggacgactcaaatgcaagaaggggaggatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggatacgcgcggggtggattcggactgcagggcagcgccaacttctgatggccgcaacgacttcatgtgaactccgatttgggcgtgcaagtacttcatggaaagcttatcaagtcgactttcaaatggattcagccacatgtccatatctattctggagcggccgcaattgtcattttactcccgactgttttctgtccatggtgctgcgtcacctcttttggcccaatgggctgtgtatccaagttgggcctattaggggcgcgtcctagggttggagcacgaccctatggttgttcttctcctcttcttatacctctagtagccgccaagaacactcgggttttgatgatagagatagctacttgctaccggctcgcagcgcgcgtgttggctaaaccgcccgtctgcctgtaatcggaaccccaccatattgtgttttgatagtgaaactttcttctttatctagcaatttcggtgcttgttctacctgttcttgcttgttcttcgattgcttgcaggacgagtaccctcgtggccgggttgacgcgcaccacaagttcgcggcgaccattggagacggtgtatcggttgctaaggcgcagcgtttttggacggttgtagtcaggccgtgaacgtcgtcttcatccaatcgagttatcccttacctctcatcgaaagatcgggccacaaaccctagcgggttcgcatcaggtggtattagagcgtggttcattagtgagagattttacccttcccttcgtcattaattttttttcctatagtccagaaaaggccaacaaaaaaaaaatagtagattagttttcccgtgatcctatagaccattgtgcctttttactagtactgcttagttaagacttgttgagttttcgattgcatcggttgtgttaatttgctggtcttagtgttaggcgattagagtttcgagttcttgccacaaccgcacatcgccaccttcatcaattttgccgtcatcaccaccgtcaccgccatcgcagtcacccaccaaatcactttctatttgtgtttgatctgttgccgatagcatttgtgagttgccttgtatcctgccgccactagaaaggaaatagaaccctgattcgagtgaccttccttaaaacagtcatatccttttcatacggactcaaaattaggcttataatatatccacggacatctacaaaaaaagatacatccgattctgccccactttgccaggttcggcaaatttaaaatcgccgaattcctcttgcaaaattttgtttttgtggcgagaagctttgggacctagtcgcatagaactttgaaaaattctacaagcttcatactttgtccgtttaaggtaagattttctgtggttggttgcagtgtgctcctggttgtgaaaaaaatatcaaaaaaataaaataaaaataaaaataaaaagtcgtgtctctctcctcagcactagagagagaaagcaaaaaaaaaagggatccagcgagcacaccccaccattccctctttgtcaccacctttcaccaccgtttcttgttttcgttgctgtttgggtttgtgttttgtggcgtcctttgtggttaggctcgcgtctctacttcaactagtctaggaccagcactgtacactatacccttgagcgattattcaacttgctttggttaacgtggtttctagttttctcttgagcattgctttcagcccaccgacagctccaccacaaacccgactacaacttgacaggtcttgttgctacagcaccgatacacctcgttccacggttgctaacttgtgggttgctgtccccctcctgtgggcaaggtaagaacttgtcacatcctgattttcgtttcaggatttataaattatttaataaattaataatagaatttatattaaatgttcattaatttacaagtaaagttaaatgtgggaaataaaatttcctaaatataaagcatggttggatttaatttttattaaattctccatggttaattatactctctggaatattctcggatttttcggagctcaattcctaattttaatcatacaaagagcatttcagtaattacccacatattaaattaatcattaaatggtctaattgtaatttgttaagtactttgagtgtccaagtattttcaggattttctt

SEQ ID NO: 74586 - DNA, 1567 bp, Oryza sativa
cgtggagcaagatcttgaagccccaaaggtggttatgcttgattaccggcagttaccgaccttccaaccgacttaaggaggctataaaagaaggagctcactacactctaaaattacacagcaagtggagtacaactcacttacacatttaggctgagttcgggagtgagcgttgggaaccctcactcccaacatgcaaaacagagcggtgattagtgcataatttattaagtattatgtaaaataaacttgaaaaatggattaatatgatttttaaaacaactttcctatatattttttttttcaaaatgcacaccgtttagtagtttgggaaacgtgcacgccgaaaacgagaaaggtgagttgggaaaagtaggggaagaacacagtcaaagggtgtgttcgggaggaggggttgggaatccctcctccccagcacggaaaatgaagcacgtattattgcatgattaattaagtattatctattctttaaaaaaaaagattaacatgattttttaaaacaacttttatataaaaaaatttggcaaaaacaacaccgttttaccattttaaaagcgtgcatacctgccccaaatgtcggacttctatccgaaggagtgctagagatgtcgacattcttccaaggagttctagaggagtgcccaagatgtcagctctctgtctctctatctctttgatcttgtacctcgttggatgcttcttttacctaagtatttgtgatctcatttggtattaacttttcttatttaagtaagatatattctcatcattccaggttcatcgctgtacttagagtaccttaatcttatataagtgtgacatcgagattggggtaataatcaatagcgtagacatggtgttaaggctagagtttacgtttgtttgttgtgtgctccacgggttgtagaagtagatggcaggtggtaacagccatatccgtcctttgtaattctccatgttcggtacgtcatcgagctgtaggccggagtctccttggaagatcacgagtaagctggtgttcgaaacaattgatagagttttaacttaacttaattaacccataggaatccgctctttcctaagcatcccaattagttgttgtccttggttgaatcttgttcttagattacacgcacatgttccctgtgatttgatacccttggaatactctaaagtgaagtgctacttcggtatccatgttcttgcggatttatttatgactgtagcaaataccaacagcgggccactattatgttgtcgctagtcatgcattgtgcacacattattaatagatgaggggtctcgacaagccattgcgtgcaataggtgatgacatgccctcccaagcaattagagcaagtttaacagtagagccaaatattagctataagatcatattagagttagtatgtatagtagatgggctctaactttgtatttatttttcttctcctctctctttctcatgcatatacatttagtgcatttattttaatgtgtgtgaagagttagctcttggataccatcagctcgccattgttgaagc

SEQ ID NO: 74587 - DNA, 4319 bp, Oryza sativa
aaggatgagctgtcagttatgttgatctctcatgactatgttgattttcagcagctggttgacaaagcaattcgacttgaagacaagaagaacaggatggataaccgtaaaaggaaaatgactgtatcccaggaggcacaaggtagtagccagaggcagcgtatcaagccactccaaattagtgaatcttcttccgctggtcaaggacaatcgcaacagttgaacatcggtggtgagatcaaatcagagactaatgaaagcaatgaagttaacatcgagcaagcaaatcagccggtgctagttcagcaggatcagtcgaataacagtagtggaagggagcagcaggtatgtttcaactgttacaagccaggccactttgcaagagagtgtccgaagccgaagcatccgcagtcgcaaggtcaagtcaacaacattgtcgtcacaggagccaatgcagtgccagttgcgtcttcaagagttgcgtcttcaagtgttacaactcagccaccagtttcaaagcggcagtagttttctttaaagccttagaataattatcggagttatggaataagatagactgcagtttacctatgcctttttctttctagccgttccgaatctcgggacgagattctttgtaaggggggtagatttgtcacatcctgattttcgtttcaggatttataaattatttaataaattaataatagaatttatattaaatgttcattaatttacaagtaaagttaaatgtgggaaataaaatttcctaaatataaagcatggttggatttaatttttattaaattctccatggttaattatactctctggaatattctcggatttttcggagctcaattcctaattttaatcatacaaagagcatttcagtaattacccacatattaaattaatcattaaatggtctaattgtaattttgttaagtactttgagtgtccaagtattttcaggattttcttgaaattatttgagcattggaagtatttttaacaattcaaaaatcatttcagtgattaatttaattggaaaagtatttaaaatccccttctccttttcgggccgaaataggaaaagttcagcttcagtcctcggcccattctcctttcctttcggctggccttatccctcctccaaagtctgctttgtgtccctctttcaatcgggccaagaagtagaagcccagccaaaagtctagtttgcctccctgctacagtgtcatcttcaatctccagccggctggagacacagccgagccgtgcatgccgagcccgagccgccccttttctccctcaaatccgcatccaatccggccctttttcttccggatttttgaggggttttgatcctctcgtcctcctctatctttcccctcaagaatcggagcaaatggttgagtatattgctcgaatcaaactcgttttcgggtttatctccaaaaccgagtttttgatttctcggatcgatttcttgcgggaggagtccgatctcttcaatccaaggctataaataggaccctctagtcctcctctttcgtttgccccttttcccgagctctctagtgccccgtagcctcgtcgccgcgtcgtccaactcgccgccgccgccggccgagcttcggcgaggtcgcgccgccgcccttgccgtcgccgccgcttgccgccgccgccaagaggtgcgccgaggagagaggaagcccggccgcccgtccttcttcgccgccggtcgccgtagctcgccgccgtcggtcaacccgagccgccgcccgttccccgtcgttgccggccgtcgtcggacgtcgtttgtcgttgtggtgagtaccgttgggttcgtctcgtcgtcctctacgtgtacatgccctccaaatccgcagccggccgctctatctccggcgaggtcgtcatcgtggttcggccgccatcatcatccttcctttttcccttttttctaatagattaaatcttcggaaaatcataactaaataaccgtagatccgtttcaggtggttcaagttgctaaattcatctaaaatcatgatctacatgtttgtttactttatatgtattgtttatttggtttttattagtctttttcttcgttttgcgtgttagcttgtcgtttccgtcgttgcgaaggttcgtgagtgcgtcaggagtgttaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagtcagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacttggtaataatttgtttagctcctggtttggagttagatctgtacagccgggtatggttgttcaggatggttgggcctgtgcagcatgggtgtgctgttcagtgttgattaaaatttctgattaattactccactattttacttctcttaaatgttttgctaaatgctgattttgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataaagttcagaaattactagtgaatttccgggcgtgacaagttggtatcagagccatcttgactgtaggataagccaaatggtcaaaccttaaggactaattttccgaaaacataatttgtgaaaattttcctttctttcttatctagaattctttgcaaatcgttttgtcattcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgtttgttgtttgctttgtgtgtaggtatggttgcattcccatcattagagaagttcattgatgagtgtgtgactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagtttagggctttgaagcacaaggatcgtaccgtggcagagtatcttcatgagttcaat

SEQ ID NO: 74588 - DNA, 629 bp, Oryza sativa
tgtcacatggtattcctataaatactcctaagtcgtcatatggcactataataaaccaatggaaccattacattcaactactaaatttatctctttaggaaaaaaacttaatgaattgatttaacgggagcctcaaggcccacctcgcttgctcccccgaacatagggtgtgtttagacgcgaaaagaaaatttttggatatcacatcaaacgtttgaccggatgtcaaaaggagttttcggacacaaatgaaaaaaactaatttcataactcgcctggaaaccgcgagacggatttattaagcctaattaatttgtcattagcacttgtgggttactgtagaactttatggctaatcatggactaattaggctcaaaagattcgtcttgccatttccatgcaaactgtgtaattagttttttaatcaatatttaatacaccatgcttgtgtccaaagattagatttagtgtttttgagcagaattttttggaaggccgtagtaacgcatgtaggggtgaaaaaaaagctcgggctcgtgagctcagcttgggcttggctcgagctcaaatgccaaaggagccaagcccatgcctccttttcagctcgttgctgaaatgagccaagccc

SEQ ID NO: 74589 - DNA, 3284 bp, Oryza sativa
tattagctattaagagacatattatatattttaggagattcatcacatcatgtttcaaaccctcaaaaggacatagaaatgtgatatttccctctgcatcattgcattatcttcttatcaaggacgcatggtccaaatctgatgcactatgtgaaacataattgtcctaattaaacgctctactttttgttcatccgtaactgcaatgtagcgtgagctgtccaattagttgaggttttctaaagtcaagcattcaaggttttttgagaaacgctcaggggtcttccggctagctccacaaggtggtgggctagacgacatgggttcgaagcctcaccccttctaattatttaatattaggtccttccctaatattcgcgtcttttttttgggtcaaatttaatccagtgaaattaccatctgccttgaactattgagttgagcacttagggaatgaaactattcggaatatacgaataacagcttcaggaagagataatcgttagaggaattttgtatgctagctgaatgcctgtgctttgctacgaatagaaaatatattataatattgtgaaataaatattttttttccatgaaacgtgttacccatcctcctatgctatagggaatattcacctcactttgttttttatgtggctatccatttatggttgtgttttaatattgagaaattcaagggggtaatttgtaaaatttacaatggaagtagatggatggcagattcactgccaccaccactatcttcttttaaggtagtatatagattacctagtacaaatacctcacactggctgtcagcacagtgtagataacaggaacattgcatgctttattttgaaaaaaagtccattttactccgtcaaactatttcgttgaatcacttaacctataaactattttttggctcatcttccccctaaacttttaaaaatgcttcactttactgcttaatagcatttcccttctttgtttctctttgtactacttatattttaagctgaaattttttagagccatagatggctgtattatcaaagttccaaaatatttttaaattcttttcaagactgtttgcttgaagttaaaatctcaacatttaaattagtcttacatgccttcaatctatgtaaacagtgataaagaaaatcgaaaaaatattcataggtactccttccattccaaaatcagaaattccaaattgattatcatataaccatggtcccttcgtttgacgtgtagtatcattgcatttatgcatgcaaattgagtttgcatgcatgcaggtaggagggtagtaaaggtcccgtttcttgtgtatggtggaagttaaagtgtgcatgtttcttgatttttttctcgtaccacagtcacattaaatgaaatataagaaagttaatacttccttggtcttgatgaaaaaaacttatttgataattaatatggaatagagggagtaagttgtaatgcatctaacaacactaccaaatttcagtgcaaaatacaactttgagaaacaaaaaagagatactattagggagtaaggtgaaccgttttcaatagttcggggtgtaaaatgagctgaaaaatagtttaggggggttaagtgctccagtgaaatagttcgggggagtaaaattgattcttttcttttattattgtcatccctttcttttgactctggctcaaattgccatttccttttggaactgatgaacataccaaataactgtaaatcttgacatagatatcttcgaccttagatgtattgggttcatattttgtataatctctcgtactcatatgctgttagcatgattttcatttttatctgtaaaacttgatgtggaaaatgttgtgattctggtttataatatctactgctacaaatgttgagaagaaaatgatacatggtatgctgtagatgttgaagggatggaatcatgtgaaatttgtcgttgatttatttatctttgccgcagattgaaggatactattttggaattgcttgtcacctaactattttagctagaatttgttacttgatgtttttatggtggaaaggtggcttacctttgtagcatgcacatctcatgtgcagaataaatcaatgtgtggtgcagagatgtctttttgccagtatcctactctcttcttcatattttctcctggccagttcaacttaattctattgtctcatttatgaatctctaataacctctttccatggcagttactgatttttagggaatgtacacttttttggcagatagggtacatatgtacctgtgatatgtattgcatgtctgcaactggtttccttttgttccatttacaccattctaatacctatccatgattctactactcaggccacactacaatgtaaacctcaagtcaattgatgttggtggtactgcactaaagcttccgtcacatatgtttgatacaggcgaaaagaagggtaccataattgatagtggtacgaccttaacataccttccggagatagtttacaaggaaataatgcttgcggtatgaaatgagccctgcatttgttttcccatgttatggaggattgcatgcatgcgttctctttacatgttatatttctcaaccaatttcaggtatttgccaagcataaggatataaccttccataatgttcaagaattcctgtgtttccagtatgttgggaggtatactttacaacatactccatccgtttcgcaatgtaagactttctagtattgcctacatacatatagatgtaaatgaacctaaacacatacgtatgtctagattcattaacatctaaatgaatgtgggcaatgctagaaagtcttacattgtgaaacggaggaagtagtatctagctatattgttgagcagcaaaattgttccataatgttatgttcgtgactttcaaataagttgggagaagaatgaattatgagcccaactacaattttattcgttttttcttgaatacgcaggagtgcaattttatttgttacatttctaactatatatttttattcttctatgcagagtggatgatgactttccaaagatcactttccattttgagaatgatcttcctttgaatgtgtatccacacgattacttcttcgaaaatggggtaatgtaacatctcactccagtgatttggtcacctattggtatttctttgccaacttagttgttacaacttatgacacctataaggttataacatgttaaactggaatatgaaatggattcaga

SEQ ID NO: 74590 - DNA, 1597 bp, Oryza sativa
agtcttggggatcaattcagatgactatgcagacaaacacaagctgcaaagatcctgtactgtttccaagtaaattatgcagtagtcttcaagctttccttaattttcttacaacaggtcaacaaggcttgaagaagaaacaattcgatcatatttgcaagaaactaatttgatcatattcacaatatgcaacagatattagtatgctctgccaggaatagatgaatacatatatgtatatagtaatccaggtaatggaacaatctgaagattaaatggatcttataatttagactgatctgtctagttcaaagagttcaaggatattcattaattacgcgtcgctattcaccaattcaatctggatttttcagtgggaactaattagcattctttttgtatatgcaagaaccaaaatcccataatttcaatattcaagctcattttttttggaaatatgccatttaataaacatgaataccatctcttgcaggtactgctatgtgtattcatcattgttgttgggctctgctgtgctggtgtgggcacatactcatctttatctaagataatccaaaactacaagtgaatgcatgcttttctagcatcattgtttctactagaagaaatgttttctgcaagtttcatgtaaagttatatatatatttatatagtatgtaatctcaaaggtgtattagtctgaggtgctttgcaaaagggaggacattagggtgaaccccaccttggttttctttgtgtaagttttgttagtcatggtaaggttggcatattcaattttgacatgcatcattttttggtatccatgactgtccatttcgtgtgtgtcattctccagtcgagtgtcaagtaacttctttacagggggcaatgttacatgagatattctaagtgttgccattaaccttattccatgttttgccatcgacgaatgttagtcccacaaaatgccatcacaagttaatttatctaaaaaataccatcgccattaggcttccatggattcaactcttgtcaggacacctgggctagatattgagtaggctactaagtatgacaacatgaaatatttagttggatgggatattaaattaaacctaaataataatagtagtaaccatccaacctcatcgttgatctagcatgcgaaacaccaaacacaacataaaacccaaagcaccgagtagtgagcacaggagatcttcgatggaatagcccgacagtcaacttcaacttaaaatatgcccatcaaactactcgaaggtgacgaccaaatgtattacatcaggggacttgactcatatcgctaaatttcacgaccatctcaattgctcaaaactctaacttgtgatcggctagtctcaggaggttgctagcttcacactgttatcttagccaagatatcagaaacatgaaggcacgaattaaagtaacttaagaatagctagaaacattggtctaaatcatctatatgcagttgaccggtcaatagaagttcagcggaaaacctgcctgcccttaccacacaggcaaaccgactagggatagacacctagtaagaactatcctaaagatccat

SEQ ID NO: 74591 - DNA, 5258 bp, Oryza sativa
tatttgcaattttgcacactatttaaagaggattaaatttggtttagtaccatctcaaccgctggtgagtcttaaaataccattgctaacatgaggggttttaaaatactataggtataaaattttggagggtggcattgccctaagctttgcagtccatggcaattgttaacatccaattaggacagagggatttcctgaaatgacgttatcactcctacatcctccttttcttcttctttgtaatttgtgtgatattgcacatgaccttaaaaagggggacatgtccatgcactacttacgtggtgaaagtggctatacatggttgaacccacatcttgctccctggtaaacaaaaaatgagggtagattggccattttacacattttcaacggaaaatggactgtgctggtgttttccaaatctgttcactttacaatggtattctgtagccactcttgtttacgattgtattttgcaacttgcaacaactgtgaaggcgatgacaatgttgcagattttcatatccaaattaattttaaactgtaaacctgtacaaaaacatggttcccttgcatactagttgcattgctgtttgcatctctgttacctttttcccaattagtaatagtcattcccttgcatatgtttattttattttatttattatcccttcccttcttttccaattgttcatgtttaatattggcattctctgttctataagatgcattcagccattctctatgacagaaatatttggatcagggttaagggaacttctgaataaccccttcgaaaccctcatatttgattagcttatacaccaatattcttatgattgcctccagttcttaccctagactcagatattccaaataaaattctaagttatataaaatacaaaaaaagagggtaaaattgcctttgacatggtctcgctgagaagctggaactgaccatattccagttttcccccagaaccaagattgcaaaatgtggaattttttgtctgtctcacaaaaggaatttgtttagttatttgaacatttcatactacattttaaaatagaccctccaaggagttaatttcaaaactgaacaattttgccggccacgccatgggtagtgccatcctgcaacatgcttattgttaccacaacattgttggtgacatgggcaaaccattgccacaacaacacatggtacagttttgctgtgccaacactgatggcatgggcaaaaaaaaaggttctgttatggaaatgacttttctaaggaattatttttaaaacattaataagaaaaggttcaaaaaataaaagaaaatccctacagaaattgctatgggttaacagcatagtactatagcattgcaactgttctcatgggtggcttatacagttgtttgcttcaggataagatagtagttttcttgttagtgaagcattagtttccttggaaatgattaaaatgttaggccaaagcctttgtaacaaaggagcagtatattaatttagatcaagcaaaattcaataaatgaagaatctagtgctcttctcgttaatcaaagagccatatgtattgacagtataggaaagagttccttgctagcctgagcttttgggcttttactaatacacacattataatagaattgttaacacttgtcgcacataaatatttcaagagagttggttctcactcacttgaatggactgacctttggatgcatgtttcgccaggatctgaacctgcgttcaaaggcagatgcattttcaatcccacctgagtcagaaatgccaaaatatgtaacattctaatgactgctgtgtcttgaaaaattgcactaattgtgtcgtaggatgcataaatcagactctaaagctctgttgttttgtccctcttcccaactccattccctcgttttccacgcgcacgattcctacactgttaaacagcgtgtttttttttaaaaaatatattctttttagataatggaattaaaaatccggcctttgcttcaacgaacctacagccaattattacaatattctctcaaaaagagcaaacactcaagcaacaaaaataacttaaaaaaataaagccaacacataaggagtaaacaatttctataggaaagttgtttaaaaaaatcatattaatccatttttcaaaaaaagctaatacttaattaattatatgctaatgagtcgctccactttacgtgcgtgagttattagttcccatcctcatatgccgaacgtagcctaaggctgtgttctttcccctcctttccctacttaccccctcgttttctgcacgcatgcttcccaaaccgctaaatggtgtgttttttgcaaaatttttctatacgaaggttgcttttagaaaaatgtattaattcatttttcaaaaaaaaggactaatacttaattaatcatgcgctaatgagtcgctccattctgcatgtcggagggattagttcccatctccaaccaacaaacgcagcctaaacctgccacattcagtggttcaaagtctaattgttccaatcaacgatcatgatagttaatttgaatttaatggagtactatagtttgaaatgatactataccgttgcattcagtcttgtagtagttgttatgttctgtatataacatcataatatgcaggttcacagatatatgttcatgacacttagatttgtgatttttttttttgtatttaagcaggataacttatattgtgttggattccaaaatggtggattacaatcaaaggatgggaagggtatggtgcttttgggaggtttgtcttgctcagcacatgcaaatcctttactcaatgttatatatctgatgtttttttagaactgttatatatatgatgttcgtgctattacctgttttttttccagatctggtcctttcaaataagttagttgtctatgacctggaaaatcaagtcattggctggactgagtacaactgtaagtttaacacattcaaatttgattgttatgagttcattccatagtactttacatgtttagtctattgttcttgctaatgtcttgacaatccgaaaatatatggcaccaaagttggattgagtttcacttcataaggaaaatgggacgctggaaccatgttatactaagcgttgttcagtaaaagagctttgcatgttgcacgcattgcgtgctccaagttctgaacatcttagtcatgggatggaatatgcaacttttagctacaaacatattctgggatggatgaagtacctaacttgtgtgtcataattggcttgtccgctctttgcaggttcctctagcattaaaattaaggatgaacagacaggggcaacatacactgttgacgctcacaacatctcctcaggatggaggtttcattggcagaagcatttggctgtgttgctggtaacaatggtgtacagctatctaatattctaactccggtgtatgtctcgactctagtggaaattcatttgatttaaattcttttcaccaaagagggaaaaagggtaggggtgtttagatggtgttctctgaccactcgagagaactgaaaaggaaacattgtacgctacacaatgtacccgagtgtgtagtgtaatgtaatgtaatgatgtggtgactggtgagaaaatactatggctgaatgtgcttttgggaggttctaggaatgatatcaggcccccatcttttgaatatactctgataatatgccgtacagcatattaaggaaaaaaataatttatatttttttagataatgataatttatatgtaaaacttttataaacttgtacatagcgatttaaaagctaactagcaataattaaatctaactagcaataatcacgagctatgctgcgcgcgtgcataagagactaactatatttgatagccagctagtattttttgtcacgaatatctataatcacacatatttcggtactgagcaaaccaaattttgttcaaattgtaataacataatgcgctaaaagatcaagttaatgtacaatgaggccttgtaataattagaaaacatctattagctagtagatctctatacgggcataaccccacagattgcacttaatgggcacgccaacaacaaaccatctattagatgaactttcatacatgcatatctccacatatatggaatctgatggcatgttaacgctagttctctaaacacttggtaaaactgtctgtacatccgacccttaatttgttctgcaatctttactatccattatttgtgctgcttttgggtacctaattaccaacaaagaatgatgtcagtcccagaacacaaggaaactaaataaaatacatctattggtatcatctatacgaagaaggggaaccaagaagtaaaactggatgtagtagaagtgcataatataaccaatataaggtagaaaaaaagaacatttatgggtcctcagacaactttgatgattataatagttgagaaaagtatgcatttgactaatcactaattattgaaacatatgactctactatatgcattcctaaagaggtaaactatatccaaattcccaaaaatcttggtaaacatgaatcagagaccatgccggatgacaattttagccctgtatgtatgccattcataaggcatagctgagaaaagtatgaccatcttcattgcaacatattcagatcatgtcttgagaaaattaaaataaactaagaaaatgagttaatatcgatgatcaatagtctattaactttatcttgttacctggtttatgatttagctcagaacccatcacattatctcaacagcaaaataagttgatcaatatactccatgttcatgcttttcaacttttcgttagcggcatgaaatttcgataataagtttagaactaatacatcatgtggagaagcatcattgatgcaaaagaatacaaatgtgcttaattatggcgaatcatgtgtagaagacaaatttatattgaatgtttttttttcaaaagaaaaggaataatatatgtgaccacgtttaatacttactgataaactgagcataccaatttataagaataaaagtacctgtggggtaatgaagtcattgatctaacggtaaaaatgaatggcattgatctgttggggtgacttcgatgtctcttatcctgtcattgaaagaaaaccatgctatagaatcagtagcaccatttttaagattagggtcagatat

SEQ ID NO: 74592 - DNA, 1038 bp, Oryza sativa
tttcccggcacggtggggggatgcataaaaaaaattcggaatatcaaagtacctcttaaaattaggatctttgtgtggttactactgagaaacaacgtgttaactaaagataattttaagaaaagaggatagaaaaaagggactgaaactttccagttctgtgataaaaaagagacaatacaacatctgtttttttactgccccatgactttacttgaaatgtggtggcttgtgctttcgatttgaaacctgtgagaaatattcaacatacttttggtatatggacaacactgtgacaaagatacaaaacaactccgtcctgttagtgggggtagttgctgtgacgtggtcgatttggaaagcaaggaataaggcgtgctttgaacaaactagaagaacagttaggttaaaagaacaggtgaaaattagaaaagtcaaataagtatttagaaacaaaatctaagaaagcaggcatacatgaaaattatcgtcagaggtaagcacacacagtgctgtctggactgcgtatacgcagagacattgcatgacatttccatgttcattgaccccagtgctaaccgaactaaacaagctgaaataggaagcctgggttttctttggtagctagtatgtacatacaaactgcacttatgctggatcatatttacagtagaatagtgaccatgctgcctgcaaaacaaacatatataaattgttataagtattcagtagcactatagctgtaaaaatggaccgtttttttaaaaaaaaactatatataaagcacccactataccaacagagggatgcagtgaattacttttctttcttggttacagccttgggcttctgagtgtaacccgaagtggcatgggtgcggaataaagcaaataacataattaactatagtcatttaaaaatagaagttctcaaccagatacgttcaaagagtaaagtgtaatgacactatatttttctttctttcctccattaggcacaacagcttctcctacggaacgcaagagttaatgtgctata

SEQ ID NO: 74593 - DNA, 17091 bp, Oryza sativa
caaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataaagttcagaaattactagtgaatttccgggcgtgacaagttgaatagattacacctgtgatcagagtataatctattcgaatagccgcgccctcggttatgggcaagccgagcaatatacccaagttagtggttttaattcttaaaacctgcttaacaagtaaaatgtggaatggttggcctgggttggcttgggacgagctgggacccagggtcgggttgccagtttggtctgaatcatcgtaggccttgggttaaggcaggttcgtgtgggttcacggccttgattaataatattgtatagctctaggatcgtatttacaaaatagctttgagcaactaagtgtcttttgatgctgtttactgcaaaccctaaccctttatattataaccctcttgtactcccttgcatttattctgcacttgtgggtgtgtcttgttgagtacggtggttgtactcagtcttgctcaatttttcccaatcccagaagaggagcccctggatgatgaaggctttggtgtctagctcgtgcctgccgtcaagcgcctgtggtcgtcgccctagtcttccgctgttttccgtttgtctttgtgtgtgctgggccttcgctgcccatgtaataaattaactatttacgcttccgcttgttaaactctgaactgtatcaacttttggtgtaccttacttcctgggacaaggaataatgcacgcacgtaaggaacgcccgttgggttatttccggtcgtgacaatcactatgagagcctcattgtgcagcgtgtccttagcgcacaaatggagaaggcggagcaaaatcagcgacacacattgttccaaacaaagtgtgtcatcaaagagcattgttgccgcatgatcattgatggaggtagctgcaacaaattggctagcagcgagatggtggagaagcttgcacttagcacaaaaccgcacccacatccatactacatcccttacctctcatcttcatccaatcgagttatcgcttacctctcatcgaaagatcaggccacaaaccctagcgggttcgcatcaaggtatgacagttattggaaggagaattgtcggaaatgccccccaatcgccatcaggaacgcatctgggacgtctatgccaaaccacaggatcaacggtggagatatgggttcggctgtgtcaaggggtgaccatctctagcaggaggctgtgaggcacccctttgagagttcgaccgggggcagcgggtgagattcgaggatttggtgagcgaaactgtgtgtgatcttgatctcggaggctcctccaagacgatgagacaaaagagatttatacaggttcgagcctctatgaagcgtaataccctactcctgtgtgtatgattcttctgtgcttagaaagtccctgaatccctggtatgcaagctagggttagacaagctttagctcagggatcctccgtccgatcccccctcctcgctaggcatggtcctccttttatactctaaggggataccacatgtgctgcgagtgctacctaggtagacgacaggcctgacaggtgggccccacctgtcagcggcagcgagcgcgcgcgcgggctcggctagacttgggccgacttgggccgaggaggagagagagagggttttgggccgactttcggcccaaagccaagagaggattttaaaaacctttttcgatttaaattattcattaaatgcaattccatttattaaaaatactttcttagctcaaataaatcccagaaaaatctaggaattatagagttaagtaaagtatttaatgaaattttatctggccccattttatattggaatttattaattaaaattagatcttctcttctaggcttttaaaataaattctaataattccaattaaacaacaatttatatatttaggatttttagggtgtgacaaattacatgtcttgtgcctaagcccagaagctatctgcacgtcggttgctgcgcggggcccataaaatcatgcagggcgcccttgtcattcatcatttaacagatgaggacttctgggttctcgttcacaccagaaaaagggaacccgggttagttcagattggttggaccagctctgaccggggtaagaggctgtgaagcccctcatcattatgatgggacgggacggagcacgccgctcgccgcctgacacactgatagggcggggttacacagtcgccgtccaatcggtcattccaccggtcacagaccggtcagatgagcagcacgccgcattaaatgtggcatggcgcggttgcatagaccgctttaaatgcagttaggtgggcgttaggcgcgcccacctaaccctgtacaagtgagctgatacgtggaggggttcggggcagctcgaccccaagcgagggcggcctcctccctctagcttggagtagccgccacaacaccccgggctcgaccctcctcggggagagccacgtgggtttgagggcggcccgaccccaagctgggagggggcaaccgccacaacaccccgggctcgaccctcctcagggagagccacgtgggtttgagggcggcctcctccctctagctgggtgggggtagccaccgctccaccccgggcttgatcccccctcgtagggagccacgtgggtttggtggcggcctcctccctctagatgtgatacccccgggcccatatatccgacagtagcccccggcgttagccctgaccaaaaccttcccccggtggccagggttgacgccactctcctagtctaacgatgtgggcccggtctcttctccattctttgttggcactagggcccatgcgcctttttcgccccaacttgagggagactcgctgtcccgtaccttaggttgtgaacttattttttgtatatattcagcaaacgttgttagattctctcgggcccgcgacatcatgctacgcacctcacttgcccctgccttttgttaacctctgttcatgttctacttcatctattcaaacgattatttttgcgtgagtgtgaggactgaaccttccatagccagcaatcctcacccgcgatcaagccaagctgggtgccatagccagccggcggggccaaagccagctgctacgggagagccagcacagggggcgtcgatggcgtccagagctcgacacggggctaggatagagctaggaatcatagcccccacacttttagcaaagaatcatttgaatgggtgaagtgaatacaaactttttgttaccaaggggggcaaacgagcgtgcgacacgtgggaatcatgggaccgcgaggaagagatgggtgagagataaatataagccatgataattttgctaataagcatgaataaaaaagatatgtacttaaaggaagtattacaaatgttgtgctcaaaaagagtacccgggcaacgctgagctttcccagagtggtttgctttggtccgggtattgtaacacctcctttgttaccgttgtttatccttatttacatgtcgcgacctttcaaacctttggctcgaagagggctccccaccctgggtttcgaaccctttagggaagcctgcgaccacttagaaaacgaggtcaagctcccatgagcctgcgccctaacactacatattttgttcgctctttcctttcggtggcctccttccaatctctcttccttcttcatggacgattactttcgcacgagtttgagagccgaaaaattctagagccagcaatccccgtccacatttgtgccgggccgagtaccgtagccagccggcgggtccaaagccagccgctacggaagagccagcacagggggtcccgggcttcgacggctcccggagctcaacttaaggctaggataagactagaagacttagcccccacacttagcgaagaatcgttcatgaagatgggagagaggttgggctcttaccaccgaggggccaaacaagtgcgcaacacgcgagcgtcgtaggtccatgagaatagaatggggggaaattaaatataagattttaagctaatgaattgaaaaattgaaaatacttgaagcttgaaaggacgatcagttgagccagcccgggcactgtagccagccggcaggactaaagccagccgctacagaagagccagcacaggggtcccgggcttcgacggcacccggagctcaaaactgcaagagtcctcccaagagtgaaccgaggtggcagcaggttcatgggctaaccccgcgcttggcccctgagggccatggggaagacgttcgccatgacccggtaaccacttcccgccgcctctatgatcgccgtgcagatctggagggactcggaggggtcagcgccatcgtcgtacttctcggtgaggcagggctggagctttgggggtcctcagacattccgaagacacgccataaagacctggtagccaagcttacctggtggggatgtgggggaccttgcccccagcctggggtggcgcgacactcctgaggatgctgtgccttccgccgtagcggcggcgcgacactcaccacgccggcgctcaaaagaacctcaaaaattacgaacgcgccccctacctggcgcgccagctgtcgaggggtgaccctctctagcgggaggctgtgaggcccccctttgagaattcgaccgggggcagcgggtgagattcgaggatttggtgagcgaaactgtgtgtgatcttgatctcggaggctcctccaagacgatgagacaaaagaggtttatacaggttcgggccgctatgaagcgtaataccctactcctttgtgtatgattcttctgtgcttagaaagtccctgaatccctggtatgcaagctagggttagacaagctttggctcagggatcctccgtccgatcccgcctcctcactaggcatggtcctccttttatactctaaggggataccacatgtgctgcgagtgctacctagggagaagggaaaatattctctatatcaattacatgtcttgtgccttagcccagaagctatctgcacatcggttgctgcgcagggcccatcaaatcatgcagggcacccttgtcattcgccatttaatggatgaggacttccgggttctcattcacaccagaaaacgggaactcgggtcagttcagagtggttggaccagctctgaccggggtaagaggctgtgaagcccctcatcattatgatgggacgggacggagcacgccgctcgccgcatgacacactgacagggcgggggtacacagtcgccgtcccatcggtcattcaaccggtcacagaccggtcagatgcgcatcacgccgcattaaatgtggcatggcgcgattgcatagaccgctttaaatgcagttaggtgggcgttaggcaagcccacctaaccctgtacaagtgggctgatacgtggagggtgtcggggcaactcgaccccaagcgagggcggcctcctccctctagcttggaggggacactcgccacgccaccccgggctctacccccctcggggggagccacgtgggtttgggggtggcccgaccccaagctaggaaggggcagccgccgcaacccccgggctcgacccccctcggggagaggtacgtgggtttgagggtggcctcctccctctagctgggagggggtagccaccgctccacgccgggcttgatcccccctcgcggggagccacgtgggtttgggggtagcccgaccccaagctaggagggagtagccgccacaacaccccgggctcgaccctccttggggagagccacgtgggtttgagggcggcctcctccctctagctaggagggggtagcgaccgctcgacgccaggctttatgccccctcgcgaggagccacgtgggtttgggggcggcccgaccccaagctgggagggggcagccgccacaacaccccgggctcaaccctcctcagggagagccacgtgggtttgagggcggcctcctccctctagctgggtgggggtagccaccgctccaccccgggcttgatcccccctcgtggggagccacgtagatttgggggcggcctcctccctctaggcctgatacccccgagaccatatcaccgacagtagcccctagcgttagccctgaccaaaaccatcccctggtggccagggttgacgccactctcctagtctaacgatttgggcccgatctcttctccattctttgctggcactagggcccatgcgcctttttcgccccaacttgagggcgactcgccgtcccgtaccttaggttgtgaacttattttttgtatatattcatcaaacattgttagattctctcgggcccgcgacttcatgctgcgcacctcgcttgcccctgccttttgttaacctctgttcatgttctacttcatctattcaaacgattatttttgcgtgagtgtgaggactgaactttcatagccatcaatcctcacccgcgatcaagccaagctgggtgccatagccagccggcagggccaaagccagctgctacgggagagccagcacaaggggccctgggcgtcgatggcatccagagctcgacacagggctaggatagagctaggaatcgtagcccccacacttttagcaaagaatcatttgaatgggtgaagtgaatacaaactttttgttaccgaggggggcaaacgagcgtgcgacacgtgggaatcgttggaccgcgaggaagagatgggtgagagataaaaataagccatgataattttgctgataagcatgaataaagaagatatatacttaaaggaagtattacaaatgctatgctcaaaaagagtccccggccaacgctgagctttcccagagtggtttgctttggtccgggtattgtaacacctcctttgttacctttgtttatccttgtttacacgtcgcgacctttcaaacctttggctcgaagagggctccccaccctgggcttcgaaccctttagggaagcctgcgaccacttagcaaacaaggtcaagctccaatgagcctgcgccccaatgctacacattttgttcgctctttcgtttcggtggcctccttcctatctctcttccttcttcatggacgattactttcgcacgaatttgagagccgaaaatttctagagccagcaatccccgttcacaattgatccgggccgggcaccgtagccagccggcgggtccaaagccagctgctacagaacagccagcacagggggtcccaggcttcgacggctcccggagctcaacttaaggctaggataaggctagaagacttaggccccacacttagcgaagaatcgttcatgtagatgggagagaggttgggctcttaccactgaggggccaaacaaatgcgcaacacgcgagcgtcgcagggccatgagaatagagtggagggaaattaaatataagattttaagctaatgaattgaaaaattgaaaatacttgaagcttgaaaagacgattagttgagccaggccgggcactgtagccagccggcgggaccaaagccagccgctacagaagagccagcacaggggtccctagcttcgatggcacccggagcttaaaactgcaagagtcctcccaggagtgaaccgaggcggcagcaggttcatgggccaaccccgcgcttcgcccctgagggccgtggggaagacgttcgccatgacccggtcgccaccccccgccgtctctatgatcgccgtgcaaataaatgatgaactttgttgaacatcttaaaattattgtgcaagacatgtgattatgtaacactgatgtttatatttatgtatatatttgttatgcttatgtaaaaaattgctaaatatataattgttccaagtaactcggttttgctggttatgattcttaccacttgaatatgttatgtgaaatatgtgaataatatgaatgttatgtgcatggatgtgtaaaatatgtgaatggcatatgtgtatgtgaatgaggatactggggatgtgtatgtgctgggggatgctggggaatatatctatttctgtctttatgcagcgggcatggctagcaaaggcccgaggctagccaaaaagaaaaaaaatattttttttgtgggatatactcatcggtgacgggctttaacttatagcctgattgagttataatcattcgtgacgggcataagtcaaagcccgattgagttatagtcatccgtgacgggctttggttaaagcccagttgagattaaagtcatcagtgacgggcgctagttgaggcctgattaagattagatcttccatgacgggcccttgtttgactggtcgtctgggtcaaagctatcggtgaagggctttagtttaggcccaattgagataacttcatccatgatggccatatgcccgatagagatgatttctcacattagtaacctttacgccgtgacgggcaccatacccgacacagatgggggttgacgcctgattgagatgtgggtgaccgttgtagtgctagcactaggatttgctcatgatcgagctgccccggtgctcatgaacgagtccaggttgttggtccccaatgtctatgctaccatttggccctatagaggattaattcatctctagttagagtttcaactttcaagtggagttgatccagcttgcttctcagctcaatggtgaccatgtactcaacacctacccagatattggcaggactatgactgtggatgaagcaaaccgctatgcagagtatgctgttgctagatttttggaagctagcaggatttctctaagagctcgtgcaaatgaatctgctttggtcaccatgaggcctgcactcaccagcagagcctcaccatcctctgatttatcatctgaactctgatggattgttctgagatttaaccacaattctgcataatgatttgcaccgcatcagcttttggtcgataagaactcatataatgtgctaagcaaacataggtaggttggtgtactacaaagtgtgctagcattatgtaattgttagatcttaaacatggcattatacatagacatcatggtacttcatatctcaagcttttacttcagctgtccactgataaggctgagatatcagctcagaagtatctgataatacctacgtcgcagtacaccttagctgctccgccgccagacaatggcggtacccgaccattctcatctcgccatagctgcttgaaaatgccaagtgcgacatcgtctggccaaccaacttctccaacaccattagcctctccaatggcggcggcagcggcacaacggacagatggaggagcacggtggtgcttggttgccgggttgaaggagcacacgcagacgggttccatcctacttaccgtccgccaccggtctctagggccgccaccaccgctctgccttgaaggttgtcctccaatacacgttggaggcgccagccaatgctccgcttgaggccgtgttgtcgctctgccatgaggtcaggccatcgcacaagccggggagggagagagataggtgaagagaggtaagggtcactgataagtaggccccaccatatgccacgtcaacgaaaccgggggaaattttggtccatactgccaagggacttactatgcatggtttctaataattgaggggtagagattgctggtattggggattagggatgtaatacatactcgatgtaaagttgagagatgtcagatgaacttattccgtttataaatgtgttgattgcaaataaagttgcattctaattataaaatgcgtaccaacttgattgtgaaacaccttgaaattgttattcatattccttgttgcctgagtttattctttattgcgtggtcaattattgacattgcttaacattgcttatttagatgattttacacttgacatttggtatatggatgtgaatacaatgatcactaattgtgagtgattgtcggaggacggctggagacatgagcgccatccgcaacaaaaaaaaatcattattgtaaccaaaaacttaataaaacaaaataattttgattggggcggtatggatagaatatgggtggttctatgaaacgacaagccttcgaccaaggtcagttaaggactgagtcaagaagctatgcaggaaatgaaccaagtacgaccacatttctagaatgggtatagacccggtggactaagtaacccgagtaggggggcacctttcatggtagttctacagttattactgttgtgcggaagatgtgttggaaaaattaaacatcatgaagatatattatgtaatccccatagtacctcagaaacgccaagtagggttgggcgctagggtgcaatggggatccaatagtccttggagagggtgccgcaatgcgagggtgaccgaaaaactgggacgtgacaagtctcatgtgttgggtgcgtcacgaagggattaaaagcatacatccactacagtgtgagtaaacaaatatatccgaatcgccatgctcgtggttaattgagcgttgggtcttgtactactcttgactagcctcatatgttttaatcttgcttagaataggattgagagggaatgtgtgaccttgctcgatgtgcgggaaggtcggattgatcaagaatgtggaaaactggatgcgagggtaaaccggaccaaacgacaacctcaacttaaagttgttttcaattaaaactgctaagccacaagtttgtgaaatgaattgtgaagtgtcgctttatgaaaataaaccaagccatccttgaaaccctgtgtacactaatgcattatgtagtagtggcttgctgagtacgttggtactcacttttgcttaattaattcctttagaagaaggtgttggagtcgacccatacctgtgccatgctaacgagcaggtgccgaagacggtgaagtagggacctaggttcaccagtcgctgcctgtggaataagatgggccgtcgctgtttcgtttccgctaccttatctacctcttttgatatttggtattgtaattgaccatgcttggtctatttaggtcccactctggctacccttgtattattaatgtattgtaaaacttttataacgatgtcagctatgtgacatgtaactttgtcatgtgtgtatcatctattgatcaagagaatggtattgtaaacacatggggattctgatgtataaaaccgagggcccacaaaattgcaatacacgctgaacgacttagaaggggttggtagacaagctaaaactcgattgtttgggacatataatttcatatagtttatctatgcgacttcttaactctcttatgttgggtatatgcgtcacgaatggtttgtgttggtatgtgtctcacgaatcaaaaaccgatggttcagttccttttccattaataaagttgctttctcctcccgctgcaatgtcttccttctccttgcattctttctactccatcttcctacgttttccctccaactagcattcaggtttgtagcgacgttcaaattgctctcagtacgacgtcaaccgatggtgcattatgaggcaaaattgtaggaaagacacaaaaccaacaagggcaatgaaaataatgaaaaaatattcctaacaatatcgatcttccatcaaaagtattcaattcttacccccatttttcaaactttttaataaacaaaactcacgcagctacgggtaataaatcgccctaccataaggcaggccatataaattgtcctacggtaaggtgatttaaactcatctaaccactgtccactgctcgatgttgcattagccatgttcgtgttatttttctctacttctattcaaatctcaataaattttggaagcacaacatgtccatctcgattatgatatagttcgcacattctgttgctcgctgttgctgctctcgttgatgtgttgcttagtggcaaaacagaaatgcgaatttacctttatatgcaactgtttacaccaaaaggggaaaaaaacgggtaccttgcaaaaaggagtataactttgcagtttcaagtcccacttcaactacaacccaatctgcattacaggatgggagtctaaaacgactgcagtttcagcgtttttgaggcctgcagagacactgggctcgcgttgcagcaaaagattaggcggcggcgcccacggtggcgccggcggtgagcctcgacgagccgtagagagtctcctcgaaccggatgatctcgttcttggaaccgtaggccacttgagtccgctcgtcgaggttgttgatcaccttgtccagcaccgactgtttgccgtcgctgctgtacccgccggctttctctatcaagaaacccaacggcgccacctcgaacaggagcctcagcttggccttggctgtcggagacgtcacgttggtgaagatgcccttctccttaactatgatctgcatcataaaagatcccatcaaggtaggcatctcatatttctcgtagcaattctgcattcaatttaccggattttgtgacagttctgaactaattaatgacatggctttaggagttccatattagtgggttttgtatgctgatgtcttaaagccaggatgacgtaaacgtttattttattttttttggcagagatttaatatagtaattaggcacatttttggtttaacacatggttctgacagttgcagattttgtggtaagtacctggttgacatcaggaaccattcctccagtgtaacgcaatgtgtacttctccttgacatagtagttgatgagctgagaaggtacattttgcagtcattagacccatgaaaagcaaaaacttcttgacaaatatgatgagaccagtaccaaaagagttgtaccttgtcatattcaggattatcaaatgtagccctcaggttaccaggagagaacattttcccctctccaatggttgtggtgtccttgacatgctgccattttcctgcaatattggttggaagtctgaatacaggttgtatacttagaataacttaattggtagttccaattgttggaacgcggagcaaccttcatcaagaagaaggaattcatgagttccaggacaatctttgagagcgataatgtaagtagtgcgagggccatagatgcccatggcagcagcaacttggtctccaccggtgacgcctgtcagcttgtcaccaggccagacaccaaatatggttccaactgtgaagttcgtgtcgacaatgctggacccatcaagagggtcgaatgctacactgaaaccacctgcaagatgacagcaagacagaaaattcagaggacacgaatctgcagaaggcaaatttttggtatcctttaaatgttttgtaacaccagtttaaacacattttagcaaaattgaattgcaagataaagtgcttaaaacttggggaaggtggtgatgtggtgagttttccccttgctctgcattaagtatataatctctaatagaattgtgcttcattgaaatattatattatttgcacagataaataatcgttcatatatatccaacattgttttcggtttgtgggggaggatggattaccatcgactggtccacccatgtcttgcagctccgggacttcctcggagcacgcatacttgcagacatgagagtattccagagcctacatggagtggtacgttgtacaaataagtcaagtgcaaaagcatgatgcgatatatgcgtcatatagcatacccggatgaatgaatgaataaccattgcaaacttctaagcacctcgaagaggagcttgtcggcgagcatatcgacggcgagctgctcgtcaccgaaggagttgacgcaggcggtgccgccgcacgacgccgtcctgaccttgaacgagatcgtcctcatcgcctcccccatgcagatgagcagcctgatgaggttcttatccggcgtcgccttggtcaggaactcctcctagcaccatagtcagttagtcacacacacatcagcgtaatcttcacatggcatgtgacacacacagttgcacaacttgtatacgcgtgcacgcaccaggctgtccccgatctcgcaccgggtgctgagcgccgcccggctcgccgccttggactgcctcccagacggcagcgacctcgccgtgttaacccgcagcgactcgccgtagaacgtgctcggcggtctagcggccttccatggcattgcaaacacatacgattaatttatgtcaccgcgttgctacatgcaaagtgcaggctatggcaagtggccggccgtgtttccataccttgggcctgtaggactgcgagaaggacatggcggcgcagcacgctggcgagcgcgtcgccgccccgcgggtgtagctggccgcggccaccgtctccatggccggcctagctagttagttaattcgcaggggtgacgccgccggacgagaaaacttaatggcgagggaaagagaggggcaggcagttgctgagcttgatagtgtacaagtttccgtagtacgtttttacgttgccaggcaaagctgctgcggggtgcaccaagcccgggctcgcggatttgggaggacactgggactggaccagataagtcgtgcgacggggtgaagccatgtggcgctggagaagatagagcgtcatggatgcaccacgaccatccgtggtttgtgtggccctgcggggaggatcgctcaaccgctcaggtctgatcacaagttcagcaactgtaaactggactactatctattgggttcgtccgtagcatcagcaacacagtgccatttgcagtttaggtcgggggatgggtacacttcacacactgtgctgtgtaggggtgtgttaattcgcaagtgcaggatttgaacccatcctcctgcacgcaaaacggagcagccttttaacacatgattaattaagtattagctatttatttttcaagaatagattaatttgattttttaagcaactttcgtataaatttttttttgcaaaaaccacgccgtttaatagtttgaaaagcatacgcgtggaaaatgagggagaggggttgggaacatggggttgcaaacacaaccacatgtgaagcagcagacagtcgggcccgcatgttagatccgcacttggactggagagcagagcatcgcacacaaccgccaacgcagccgtcagcgagctcggccaggagcagaccatcgctgacgagttcgatccgtaccatgccagctgtagaccccgattcggagcttgttgccacagacagaccaagagcacgccgtcgacattctccatgagcaaatcgaagaagcaggtccgctgtgagggagatggaaagagagggatcagttccgctgtgtcgttgccgacctggaagtggaaccggcgtcctcgattcagagcactctactgccgtcgagcttctgtgtctggtggagtggtggatacctcatcgccgttgctgctttttcattgaacaatcagagatctgctgtttcgttgaacagacagcattcacaattttggagattgaactgtataggggtagagattattttttttatgaacatatatcattaggatgtactatgagttggatttttcataaaccatacagaatgagttgaacatagcagcctgaatgagtataagacacactatgacacaaactaaccactcatttatttttaccacctaacttcctcttacttggaaggcatggaaagtttcacatgccagatggcattatagtttcaagggacgttcatgaggatgagatgctggggaccggacattcataacaaactaaagaaaccttggcaagcgaataagacaggggttgtggagcaaggcagctgcaatgggcggaatctccaaatgtgggaggaggaggagctgcatcagcaactgttggctcaaaatccagggcaaacctaggtgcgtgcgatgaatggtgtcccaactaggagtgtccagcactggatcgaacaaacgggattagtaagagatggagccaggcatgggtgcgacgaaatcggcgatcaattgcttcaaatgtagccgtgatggccaccaccactcaacatgccctagcccacccctttgctatacatgtcacaatactgggcatctcattacactgtctgatgaaaatatgatgaaaagagatgttaaacagtgtggatttgggattcctcgtcaaggtttctatagtttgcacattgatattttagaggttgagttagctagaacttgagtgagggggatcctaatagtgaatcatggtgaggcttctatccagaaggtggttacatatctgagacacttatttgttggtttgaattgggatatgcaaggtgaaggtgaaccagtatccttattggaattggtctcattaatttcccttctgatgaggtgaggagtaagatttcagcatgtatgagctttcatttggagagtttttcaatcaaggtcaatgtagtggatcacttgtagcttgggaaaaggtttgtaagcctatgaaaaaagttacaatgggaatcattgatctcagggtacagaacaaagctttattacccaaacatttgtacaagttcaattacaaatgcccttatccttcggtgaatttgatttggactacatattactcctcttcagttccacatgctgccagattatgtggtcgaatttggtggaaagatataacgcaatttgatatcattttcaaaggcatgactaaacctattgtggaca

SEQ ID NO: 74594 - DNA, 2110 bp, Oryza sativa
taatataaatgtgacacatactagtacaatgaatctggacagacccataatataagagatttttggtagatatgacacatgtcacgaccggaaataacccaacgggtgttccatatgtgcgtgtattattccttgtcctaggaggcaaggtacaccaaaagttgatacaattcagagtttaatcaagcggaagcgtaaatagttaattattacatgggcaacgagggcccagcacacacgaagacaacgaaaaacagcggaagactagggcgacgaccacaggcgcttgacggcaggcacgagctaaacaccaaagccttcatcatccaggagctcctcttctgggtttgggaaaaattgagcaagactgagtacaaccaccgtactcaacaagacacactcacaagtgcaacataaatgcaaaggagtacaatggagttatagtataggggttaggttttgcaataaacagcatttaaaagactcttagttgctcaaagccaaatttaaaacacgatcctagaactatttaatattattaaacaaggccgtgaacccacacgaacctgccttaacccaaggcctacgatgattcagaccgaaccggcaacccgaccctgggtcccagctcgtcccaagccaacccaggccaaccattccacattttagttattaagcaggttttaagaattaaaaacactaacttgggtacattgctaggcttgcccataaccgagggcgcggctattcgaataggttttactctgatcagaggtgtacatctttacccacaagacacgtcttcctcatgtgcaaccacgtgccacataccaccacggcatatggacggaagacatgacatagtttccaacccatcctagccatagacaagagtaccgacccaaccccacctactgacggaacctccgggacaggtaggtaggactgagcccctagcagcaggacaccagccttgtgccatgacatctcgactaccgggccgcagctcgtgtagccttcatttgtcctagagatgtccatcgacccccgacttcgtccatctccatccgtgtacttttgtttataaccagactgagccacaaactaagccttacccactatacatgtggaagtacggtagtgctttgcaacagaggcccgaagaccggtccttatgtggccgaggtgctactatcaaaaccatgcaccccaagcccagcctataaccattttgagagttttgaatagagggagaggtgtgcatccaattccacaatagtccaaccattccataaagtccaagagatatgaatattcccaaagtctaaagttataaaaaccacctaatgttgtcttattaatcagcgaagcatctatctaaattcatactaggggaaccatgagtagagcgcccactagttggggttttgtttattctagggtgaacaaagtaataataacaataacaaaaataaggtcataacaaaggtaaataggcatggctaaataaaacagtgataacgcgagaatttaaataaagcgataatgcattaatttaaatcaaaataatttcataaagtgggatccaatatgttcaaagatgatatgacttgccttgctcgctttcccaaacgtcggcttcaacctccacgaagagcggatcttccgaagctgcagcgtctacacgaccaacggaaaagaaaaaggcttttactctaataaacttcatataacaaacaggaacaaagcacaaaaatgggttcttgacttcttaaggaaaaattagagacttgaacggtccaattccgagttcaaatggccaaagtatggccatttgaagtttatatgctctttaaatgaatatttacgaatttcttcatttaaattttaatttaaaaatggtttattgcgtcagccgagggggagaggtgcgaggaccgggtccacgggagtggggcccacgcggcagcctcacggtccacggtggaccgggtgcacccgggctcacaccggccggcgccgtgggccccacgcgtcagccgtacccgagggcgcgggcggctgacggccgggccccacgcggcagccgctcggcgcgcccgaaggcggc

SEQ ID NO: 74595 - DNA, 2891 bp, Oryza sativa
acccatcacattatctcaacagcaaaataagttgatcaatatactccatgttcatgcttttcaacttttcgttagcggcatgaaatttcgataataagtttagaactaatacatcatgtggagaagcatcattgatgcaaaagaatacaaatgtgcttaattatggcgaatcatgtgtagaagacaaatttatattgaatgtttttttttcaaaagaaaaggaataatatatgtgaccacgtttaatacttactgataaactgagcataccaatttataagaataaaagtacctgtggggtaatgaagtcattgatctaacggtaaaaatgaatggcattgatctgttggggtgacttcgatgtctcttatcctgtcattgaaagaaaaccatgctatagaatcagtagcaccatttttaagattaggatcatatatagaaaacaatatgatagcagaagaaaatatgtaaaattattttagagcttgaattgatttagtaaagaagtacacctatattagtccgttagtccgttaaagctctgaccatattcaaactaaatacatcgatttctagctagatgcagcataccttgggattatgtattgacttacagacacactgctggactattgtagttatcataatatgattcaatgagctatggagcttgttacagatttttcagctaaaaaaaccagcatggggatgataatatatgattaccccttaagcataggccaattgtttgtcttcattgctagtcgatgagagcatgagtttcgaagtagaaggggaaaagggaggagggcagcaaatcagctgaacatgattataggagaaggtaacaaagaagcatgtcatttctaatttgcattctagcgggaaaggaaaaaaagaatataaatcatatatttgatccggcaaagacataaaccacttggctattcaaatacagaccaccagggctgtaaggcaacaatctcatctaatcctgttctagaatatgcaactgtatttcagatttgtaaccttggatgtaaaaagggtactgacctacactctcattcaaaaaagggacccagtgatcaccattgtagataaactgggcttgagctaacaataagtatttgcctacttcgtagaacaataatctgaagtctataaccatcctttagagtttagacatgcaaacaaaaactgcagcataagagcaagaacaatcacctttaatgacataacagtatatgggcaaggaagaccacatacatattaattgtagcattcgtcataaagcagtggtcacacataacagcttagatatttaagtattggaggtaatatgtttcaaaagcaatcaataagccaaggctagctagagataatttttagctgaaaataatatcaacatataaatctttgtagatcctaagtgagcacaaggtttactttttttttttcccaaatcgatgcatatggaaagctgggcttacactaaatgtttagcaatatacagagttatagaaacagttaggttgttagaggtagagctagagctaggtgaataaaaaatcagtaataaaagcaaaataattatcaagtgatcgattatgcttatcttttcaaaatgatatacaaatcctagactgaaagtctgaaatctgcatacaaactggtatatagtgtatacaacaaaaggggattttcgtgctcaccttgaggtcaggagtacacaggttagcattatgattaagggaaaaaataccatgaaaatgtcaacgatggtgaaaacacaaccttaggaagtaaaatatacaacaaattgagttttctatatcaacatgtaccaaaaatattgtcattgtcttataaaggggaaaagtagagacaacatatctgagatgcatataaatggcaaatcatctgagtggcagcgagagcaacctcgaacacgcttcttctctttgcacaacacctgaaagaaaaggtttcatcagcaaattggggtatatgctttcacaggaccatcgaccatcctggctcctctccttaggagaatagcagatcttgcctatctactggtactgattatagggaggagacaaacctgctatatatgctacggctagtgccggctggctgtacggtggtgtgaacttgccactgttggtatttcttaacgacattactagaaatataattcccagcaatggcgcagaaatactcctggtatattatggttacagagtttatccgtaagcgcacggatataccattgtagcatttcactcgagagtattgcaagagtatcatatttgtttaatcccgtaggaagattatagtagagagaaccgtgctaataatttatatgttgcttgtaataatcatagtctaagtagggattaatataatccaaagggtaggatgacacacaagcatagaactactcattctcatattaaactatctaagctaagtggaaagaaaatagaaaagaatctattcctatacttctagtatacatattatacattcatcctagttatataattaactagctaataccctctttctgatgccctcatggtacttcaagaagccacccctgactgtcgagttccttacgacagcccgtcatgaccatacaaccggggctaaatacggaggagtaccctccctaagaaattaacttaggactatatatatgcgtgaaggaatacccatactgagctgtcaccatcaacgacccacctctcattcgtagcatataaccccaaataatgatacctagtaatctagacaccaggactaaactaccagatactactctaatatcatcgtcatgacatagagtaattgcaatagcaaacattatacccgtacctatgcat

SEQ ID NO: 74596 - DNA, 5172 bp, Oryza sativa
  unsure (1)..(5172): unsure at all n locations
ggcagaatggaggccaaaagcctcagcaagttagagtagtaggatttattagctctgtgtactgtagataagtaccactaaagagaaggcactgggaagggaaattatcacaagtgccatgttgtaccgataattcattgtgcctcaccatcaggtacatgtacatatggaacttggaacctctttgcttgtttttagtggcaaaatggacagctccatcttacttgcacactcattcagaaacaaacattgattcattccgccagcactacaccggagctgaagagcgcgccgccatgccaattcggagccggaaaagagcacgccgncgncacgccatgccgctccggagacgcggccacgagccgccggtggcaagggtggaggccgaggcgttgagcaagttcaccttcaccttcacctccacctccacgacactatcttcttcctttcccgcgcgctagtctccctcgataactctctgccctgaactgagttcaccagctcaagccaacgtggtggcccaaaagtattgatacccggtccaaactgtataagaaggtaatcatacttggtgctaactgaaaaggtagagttagacctggttcatggtgaaactttggccaaaaaatcaggcccaaagtgaaatttactctaaaataaataaatgcatgaagtaatgctacctatccatcttttatattatcatgtgttgttttttacaataatatgatttattacttgtggaaagagttaaaaatttacgtatatttgttacactattttttatgatcataatcacttgttaagctggccccctcgtgttaaaattctggcttcgccgttgcctaaaaattttatacatgaaaactctctatatataaagttatatatataaactttatatatgaaaacttaataaatagaaacattaggtatataaactttatgcataaaaacagttcgaccatctgcatgggagggagagagagaagagctctcagcaacggctagacacgagtagtggatgtcgatgatggacgtctcgttatctcaatcggcatgtggaaaacaacaacaaaatgccaggaaatcaaatagcggtcagaaattaataatcaatctaataaaaattaaattggaactgccaacccgaatagtgcggcgtggcttggatcgtgagtgatggccggtgacacgccgtgtgcgtcgatcagcttggctggggcgattcaaaaaaattaaccaccaccgcatgtgtgtatctgcccctataggcgatggctatcttgatgccgtcatcagcagtagccggcggatctcatcatcagctgaattggatcttggagcgaagacggtgccgacgactcctgagattagttccatcgcacttgtcgatgggaaactcaacacagcctctacctgacacgtcaactgtagaaactggaattcggcaatatgaaaaggggtagcgcacaagacctaaaagtggatggatgcggagacaatgatttaaacatgtttataccctctcattgagaggtattgatctgacgatcgggttgtgaataccccctaaggggcgtcctgccctccttatataggtgaaggagcagtcttataagatagaaacttattcacttacggtttaagtttcctatatctaatccacaaacttaacaaactaggattacaagtcatttcttgatacacaagaaaacataatacccaagtcctagtcttgtacgtattctatatacattatctatcccctgtaaccagttggatagcccagccgagtgaatatgtggtaaccataatctccaaaaaaaatgaaatgtagttttgatcttgattcattccctagggccaaaggccttaatatgtagcttacaattcaggcgattacatccagctgtacaggtaaaagtaagaagaaataatggaaacaatgagctgcatgatttcagctgaaaataacaacaggtaatcactacagttgtcctggtgtagtgacctccgcctgatctccttcgcttttctctccatcgttgatagtcgtctgatcctcataagtgtacccatcaaatcgttatcccagctgaagcttcctctgcttcccatctataacttcagtcctaagtctgaactccatttcagttcacagctcctgacaatacccttccctcgcaagaaccttgtcctcaaggttcaaaagtaggaaatgctgcttggatgtatgaggtagcctcagcaagagttaaattctgcttaagaattaaccattgtgttactgaagcatcattcctgggaaccgagcttcttttataaccatcctatgacaattgtgaagtcggttggttaacacccctaaccattattggcattgaatgagaagttgccatctgaagggccaagatgagggggccaaaagaggtttggtcaactctctagtcccacctatcggccactccttcggctgggatactgactggagggccctctacatgttgcaccatggattgactcatttgtagtcggttttgattgacacgtggggcctccaatcattgtgatctcttctgattggctggtagtgtgttcttcatatggtgggtggttgttggtatttcttacgaccagagataaatctgcaagtgcatgaaatactgctgtagcacttcaccttcgggtaaccccaaaaggatagcaaacttagggaacgtgtttaatctacctaaggctaagactatatccaaggactacaactattggtagctagctaggctagagaggactttctacatgttttagttatctaagctaagtaaaggtaattttctatccgttgctttgggcaccgaccgctgctggtctgccagcatggttccggctatagttgtatgatatatccgaacatggaggattactaggacgggattcagggctgtcaccccctaccggctacctcttacaaatccgtgggatacacaacaaacaaagataatctctaacctagacatcacgtctaagttattaattactaatctaagggcctgtttggcacagctccagctccagctccacctctcctggagctggagctcagccaaacagtttcagctccacctaaaatgggagcggagctgggtggagctctctcacagaatgaactagagaggtggagttgggtttaggcagctccacaactccactccagacccaacttctggagctaaatttaggagttggagctctaccaaacagactctaatactttcgcaggaactttcccctttatccagagtcttagtactagagcacttagtacaaatactaaacaatgaacccgcaaagatggaaatctatctcacttagactaagtaattaaataacaaaagaaatgatcccaaatgcttacttaagagaagaagtttctccgaatctagagcagagtgtaccgacagctccggtactcctccagaattcctcctagaaagctacacttaccgaggtagaagtcggagagagcaccaaacttccgggcactcctccggagcttttctcactctctacctattttctaatgtacaaaagatataatagagcctcttgtaatttacctcaaagttgtgtgtattggaatgagagcctctcctccttttataggctccaaatgacggttatggccatgaaaaatgaccaaaataccctccaacagtcattggggagtaatcagggccgtccacgtggacacagatggcgggaggcgctaggaatggtttggccaaacccaaaaatactcctcctggcctctccttcggctaggacgttgtttatttgggccccaacatcatgtactatgatttggcccaattctaagtggttttgattgacatataggcccttcaatctgtgtaaacgcgtcctgatggtgcggaggtgcattttgtcgcatgacgggtgtgttttctccttaaaacacctgcatagacatatttcaccaataatagtggaaatgattagtaataatccctatcactaagttggataccatattttatttcattatatgcaggtgttaacgatcagatattatgatttaaggaccgtcaacaacacccccacacttaacctttgctcgtcccgagtgaaggctatggactctacaataggttataacttcattactaataattatgcaaacaaactattcaaagccatacctgtacttgtgagtctttgtagtgtctaccatgcgatcctgggcaattgagaaatggaacaatcttgattcaagttactctaacttttcatgaagaacaacttgaggtttttcaagtaactcaaaattataactttgctttgcttctcaattaattctctcgatcattcaatgtgtatgattcctcacaaaggcttatgattgtgtcttttcattttctaccatctaataaggcttatgtggagctcagggtatggaaaagagtagagcattacttgcatcacatatattgcaaagtcaaataatggatccacggaaatacaagacataccttctagtcaagaatgtgcatgtgtatgtgtatgctaaatttgtgggtggaaaaaaggataatactactactaataataataactccttttgtatacctactcatcctttagcatggcaatcttttttttcttttctttctcttttttcccttttaatcatcatgatgctccatactcatgtgagcaacactttttatttctttctttttgcataggcatgcctctctctgtttttttgttgaaagaactttggagcaagagacataaatgacatgtagtatttattttatggactatggatgaaatgaatgaaaaatgagaaatattaacttccagtagaagtcaagcataggtgggtgtatgtgatcttgacaatgaaagtatgaaaagtatgtcacaagggttacaatatttgacaacgctcagtgtaataacaagcagcgtatgtagcaagctaataatgaatgatcaacctatatatatgtatatatatgtatatacatatatatatgtatatacatatatatatatatatatatatatatatatatatatatatatatatatatatatatatatatatatatatggggcaacatatcctatgcacacagg

SEQ ID NO: 74597 - DNA, 3468 bp, Oryza sativa
ctactacctgataagaagaaatgtaagcctccaaatgtaactattaattgctccttttgtgccagcctgatactagatagaccggataacacctcttttttttttagtgagttcagtcagaactgttggacaaagattagttttcattggaacctaaaccaggagatccatgggatggttcaacagcgaaaaaaaaatctcttttggaggttcatattttatggatgtttttcggcttgctgcatggaatatttggaagcaacacaataagtatattttcaataatgtccaacactctataaagttgtagaagcgtgcactaaaggatgacctaagtctatatttaattatgcttagagtagttgatagatcttttattcaatcatggattgagaactttagggcatcagcaatttttaagaccctcttgtatcacaaggtggaaccaagtgggcccattctttatataatagcacttgttgtagtgtatgtgtgacaaaggtgatattgcacctaaataaaaaattcgttccactactcaactaccacatcccttcaatccccttatggtgcttttttattttgcctcaaatcccctctgatccccttccgtgtgagcgaatccaatcactgcaacgatgcttgtgagaggagcaggtgatggcggtgaccatcgtgggaggagcaggagatggcagcaacgctccgtggtgctggtggggagatcttctggcaacgacggcagtgctcgcgagcacgcgtggattcgacgagggtggctgcggcgacgctcgcggacgcattgggggtgacagcagcactcgcgggcacatccaacaatggtgacggatctgcaacagcggctgcgacagcactcaccgacagatctggtgggcatcatcacaagggtcttatcttcttcgagagatagcatgagagggaattgtgattatttttttatttcttatggatggttcttatgcataaggataactcatcctaagaacatctattaggactactcccatagtatataatgcccactttagaggtctaagatcctcccctgcgactacattaattgtaggtgccctaagattcacataccagaggggcttcccatactttttttaaggtaaaacaaaggccagtgtattgaaaactgggatggttgaagaagctgtagatgaacttgcggctatttaggtgaagatatatggcatcccgaaattggctagaactgaagatgcagtcaaatcaactgttgaattagtgggagaatttgaggatttatactgggccagcttgcgatgtaatggtccagtaagcgtgagggttgcttgtaaacatcccagggagctgcacttctcaaactatgttgtatatcaactgggttggttacttgattagattgtagaaagagctaccctacatatgagaatagacaaaaccaacctgttgatggcgatgacatggatgataaaaaggatgatggagaggaagacataatgtggagaggaatacaaagagcaaagtgctccaaggtggaggcaacctgaaaagagtgatgtccggtaggtgatggtaattcttatgatcatagagaaaatccgcaagcgcacggatatatcgatgtagcacttcccttacggagtattccaaagggtatcgaatccaagggaacgtgtgtggtcagatcttcctctggttcatccaaggacaccaagcaaaggataagccaggatagagaagatttacaggtgagaaacagtgtctagggaaagcttaagtttaatcctaacacaatacttcaggcactggcaacctgctgttcccaaatgtcgctctactgcatacccggacaaggaggacttaagtgatctcgagggctatcatcacctctacatctacctcaaacgtactatgggatacgcaacaattatttgataacaattacctaaacaccatgtctaagcaattaatatctactttagtgtttataactcaccaaatcaatcactatattttagttgattatagtgaacaataatcccgtaagctatttaggaactaacaaagagataattctcacaagataaatctaaattactcgggaagaatattatattgaaatcagagtaataaacagaataaaaaaatgatagaagattactgacaactctggaattcatccgacatcttctactctactctcttcctattctagtattcaatatagtacaatagagcctcttataattcagctcaagcttggaagtgtgtgtgtgaagtgagggagtgaagtctatttatagggcagttatgacggttgcgagaaggggaactgtccgaactgctccacaaccgtcatgaggagagcatctggagcatccacgccaaaccctaggatcaacggtgattggaggggtttggccgaacctgggctgggccctcccgacctggccttcggcctgtggactcccctaactctcctctgtccatttctcggaattttgggctgagtctttgatattttgatgacgttcacaacccatccttgtatggatacatgtttcttctcactttagtctagatttcctcccaactttgggggtcatcacttgcatacaaatgtacaccaacacttgtggaatatgtgagatttaacacctatcactatgttggatgttttattatctggactttatgcaaatgttggcggtatagaatcggcatttagcagccgccaacaaaaccccccacacttagctctttactcgtccctgagtaaaggttagtgtagaatgaatttctccaagatataattcaggcatataaatcattcacaaccatacctgcacctgtgaactttattagtagctacttaccatcttgagtaattgataaatggaacgatcttgattccagtccttcttgcttctcctgtcagactcatgggattttatgaattttcgcagaccaactcttttactcatattgactttctctcttatctctcaaagatatatattttcttgtggatgctcaccaaggcgaagtgtgccagagctaatccctattctaaggctgatatatggagctcggtagggataaatagtgatatacctacatcatatttattgcaaagccaaaaatatggactcaagaagatcatcagtcatactcctagatcaagggtgtttatttgtggtggaaaatggaaaagtaaaatattttgtggaatgatgaataaagaaatggctctccctttttcgtatactttctccattttttttctttgcataaatatggaagctttatttcttttttttctttcttcaatagccatgccttttccttcttttctcattttctttatgccaagggattttctaggagaagaaagcatagtctaaagtaggaatttatttgaatggattttttgtgggaagccaacttccggtgtag

SEQ ID NO: 74598 - DNA, 1876 bp, Oryza sativa
agtattaaaggaaggaagcctgagacatgaataaatatgtcatatattatgtattaagttagtgatataaacttaggtatagatgtagataatgcctaattgatcgatttaatatatgatggacacttgacaaatatattatttattgtcagtatatatatacaggataaaaattccatccatacaaacaatatactccagatttggctagaaagaaagtagtatgtgataaatacgtgtatgtgatctaaagttagttgtactatgttatattttgatatgctccaagaacctaaacttctgtatacttatatgttcccgtgccaggtaatagtggcaaattaaatgatcaaatcatatggagtacataataaataaattaatgtgatgtattgtgacaattatagtttgtataattactagataacatgcacgaaaatcgggcacaagacttgtactaatttgattggaaatatatatcttcatatcaaaatggttttttgaagctactaggtgccgtgtggcaattattacaatatttgatactctaaaagaaaagaccaaactggattattaattgacagatggcttgcaatccttgcacgctttcaggggcgccggattcacctgatcttcagattgatccccatgagcctgaacgagcaacttgggaggatccactctaatcttgacatcagtgagtttatctgcgtctgtctcctgtgatcagcaaacaagggaaatgattatattggaggtcggaaaaaaaagaggtacggatcatgatgcatgaataaaattggaaaaaagaaacccaagaatcgttttgatccgattcatcatctattattttctgcgcattttggaggtattcattctcatcttgcaagccatagtgattgacaaaagccacccaagcattttcaaactcctgtgctgtgcatcctttatcaaggacagagggcatccaatactttgcaaaatcctgtgatgtgtgtgcttgaccaaccttgtcgacgtttgatcttacaattctagtatttgcatagtatgggcatcgtcggtgctaggatatacgcgagactgaggtaaaagagatggagacgaggatttttataaagattcgggcccctgaactgtcaggtaataaccctacatcctgttggccggagccggagttacttttattcaccataatcacaccagtacaatatgtgaggtagcctatctatctgttgtcgacatgccggtttaaaagtctgactcgtagtcgacaacaggggtaaccttgctcctcgagctcgcgcccgacgaaatcagagacagtgctagatccctacggacggcctctgaaggtaccggatagagttgatccaggcgtatctctgatgtcgatatccggcggcttgtcttggcgtatgttggcttgtatgctgtggcttctgttgttccgtatattgtggtaggtgtgttgattgtggtggtcgtcgattgtgttgtccgtgtcccctctcctcctagggggtcttgtatttatactcataggtgtctccttgtccaagtagaattagggtaaccaatatggatacaatctaagtagttcttgtcgtttccatgtagaactcgggttgtctttccttatccggaactcctcctatatccgcaggttgttttcgtataggacatggtatgtggtgggtcctgccgagatgtagtcgactactattaggtatgtggtatccataaccctgacaattattaattgacagatggcttgcaatccttgcacgctttcaggggcgccggattcacctgatcttcagattgatccccatgagcctgaacgagcaacttgggaggatccactctaatcttg

SEQ ID NO: 74599 - DNA, 2575 bp, Oryza sativa
catagtatgggcatcgtcggtgctaggatatacgcgagactgaggtaaaagagatggagacgaggatttttatacagattcgggcccctgaactgtcaggtaataaccctacatcctgttggccggagccggagttacttttattcaccataatcacaccagtacaatatgtgaggtagcctatctaactgttgtcgacatggcggtctgaagatttgtctcgtagtcgacaacagggtaaccttgctcctcgagctcgcgcccgacgaaatcagagacagtgttagatccctacggacggcctctgaaggtactggatagggttgatccaggcgtatctctgatgtcgatatccggcggcttgtcttggcgtatgttggcttgtatgctgtggcttctgttgttccgtatattgttgtaggtgtgttgattgtggtggtcgtcgattgtgttgtccgtgtcccctctcctcctagggggccatatatttatacctataggtgtctccttgtccaagtagaactagagaaaccaatatggatacaatccgagtagtccttgtcgtttccatgtagaactctggttgtcttttcttaatccggaactcttctatatccccaggtttgtttcgtataggacatggtatgtggtgggtcctgccgagatgtagtcgactactattaggtatgtggtatccataaccctgacaatagcccccgacttcaatgcaaatgaacaaattcatattctcgaccgctcactatagagtaactgttatcgagctcaagtgaccgttctcggtgagttcagagataatgttagacttcctttgtcagcctcgtgcgggcacctaaagggtttgtttgagtcaatctccgacgtcaaccaagaaagtacatagcgtacgactaagtctcccatcttgctgtaatcgagaatttggattaaagtcaagaaattttatctcggcgggtacaccatctcttcattccgtattccttgtcgagatccagcaaccgttctcgagcgatcgagaaggcgtagagtctgcgacggaaccttgtcaacattggtcgtactcgccttagtcgatcttggtgtagaaccatagagacatggagccttcgtcaatgtcgaataggattttcctgaaatcaatactcagaaaagaatattagatagaaatagcccccgagcgaatgcccaaagggtgacatgttataatatatatggtaaattgaaaatgaattaaatttatcaaccaatgttttgtgtatgagcgtcttccctcttaccgacttcgatcagtcagtttgtagagttatatactctccctagcccccagccttgtcgtcggagaatcgttctcggaggagaaggctcttggacctttgacctgccttggttgaacaagcactgatcctagcccccagccatgaagttggaaaactcaatttccgattacacgacttggttaatacgcacggcgagaactcttacacgactagatcttacatggtcttttgtctctacaggatccgacaaggccttatcggctctgggcgtccccagccgaagttcccttaagttcctcggaggccttgtcaagacggcgtaaagggacagtaggataggtttcaacgctaggtgtcgtcatggtaagggatctctgggtaaaacatttggcgatagtgtgtacctgatatcaactttgttgaagtagaggtagtaggagaattgctacaccgctggtcgaggaccaggtagtagtcgtaactcgaccactagaagtggaaatagtgggagaatcgctacaccgctggtcgagaaccaggaagtagtcataactcgaccactagaagtggaagtagtgggagaaacgctacatcgctggtcgaggaccaggaagtagttgtaactcgaccacttaaagtggaagtagtgggagaaacgctacatcgctggtcgaggaccatgcagtagtcgtaactcgaccacttaaagtggaagtagggggagaaacgctacatcgctggtcgaggaccaggcagtagtcgtaactcgaccacttaaagtgaaagtagtggaagagacgctacatcgctggtcgaggaccaggcagtagtcgtaactcgaccacttaaagtggaagtagtgggagaaacgctacatcgctggtcgaggagcaggcagtagttgtaacttgaacacttaaagtgaggcgagagagatcactacgttttactggttcgagaaccaggagtaggagtcttttaatcacctataggggcgctaaagttggtttattacatgtgcatatcatgtggccagcatgactcacatacccaacttacagcatatccggatgtccgttcgcaatcatgtcgggtgatcaagccgacggcgttcgcgaggaattatccgttaacaaccttttctcgagtagtccagcgatggccggtgctatgagataggtcgtcggtcttcgttggcaggttgggtgcgataacttcgcatttgtcgagaatgttctcgataatggagtgtactcgaccataacctaatcgagtgctca

SEQ ID NO: 74600 - DNA, 1993 bp, Oryza sativa
ttaaacatatagacctccaaattacagtttcacatagatgattttgtttccttccttctattcataaattttttgacaatgtcccatgtggcatttaatttaatcagaataaaacctcttatgaaacctgcactaaaaatggcctaatatatgttttagccatttctaccacgcaaagtcagtgctccattcaaggggagctaggacacattgactaatgatgtctgtctgtatttaatttaatcagaatgaaactcttatgaaaccatggtagcaacatatattttgaacatttaactggtcaattggaatcagtacttcctgagtcctttccaagcttgcgttgcagaagtcttcaagtcccccaggtccacgttaggtcaagacggtttagtccctagccattctagtcttaaaacaatttagtccctcgtcagttcgaaaaaccctatttgccaccctgcgaaagaaatctaagtcaccacaccttgttctccatcctcgcagccacccaagcacactgtatgtttgtgacaggcttgaagaagacggcagcatggctatcttcttcgtttttctcctccaccccttccctctcaatgacttagggatccttggatccgaagtctctggcgccagccacagttccaatgcagtgtcgaggaggacggttgtgactttgacattggtgcggcaaggtatcatcaatcatggttttggcattactgacaactccgactttagccatggctctggcatctctggtgtgtttgtgacaaggccatgtcggtcatggctctagcatatccggcgacgataaggcattccggcatggcacggtagagatatcctctccctgtcatttgctgcattgtcatccgagcacgacagtagcaggttgcaaaggcattgcctagcttcttgtgcgatagacaaaggatatgggggcacccagatctcaccaagaacggtatgacttcgccgacaaaagttgcgctggtagctaatggcagtgcaacaagggcgtcatgccttgatctagccttgactgccatcaccttgtagctaatcctcatgacagcattttcatcaatagttaagggcttccacaccaacttgtagagcaatgtcattttagctataatttatggtattatctacaccctcatatcattcattcttcatggatcatacggattgcggaaatgtgtattggcttgactgcaacacaataattgtatggtagcatgtctagagaagattgcagactgtcacaccctgaagttttctctttttctagccttaattcaattaataaattgcctcaagaaataattcaatttaacctcgagctaaacccaaattaataaatgcaattaataattggaaatagcatggtgggatttttcttgagttccccatgtttaaatacattaagaggattattagtggaattttctgagcaaagaaaataattttaataattaaaatcaattattgaaattaaattaaaagttaacctccttttatctctcttttcggctgtgggccattttcagcccactcctccgcgcacacgctctctcctttgggtcggcccgtagccacagcccagctacagccgccgcgccccatctctccctaggtgtaaacatccctccttccaaaaccgcgtagctagcctatcccacttatacataccactccacttacacttttcattctcacatcgtgtaaaagggttatctcgagagtgatatggttgaagggacaagcccttataagttagttccactcttgctaaactagcaaggtggtactaaacatacgtatacaatgctcatgggccacacatgcctcatcctaattgggccaggatgttacatacacccccccaaggacctgatgccccgttgacacaacttacccagatagccacacatgcacattgggaaatgtccaggaacacactccccccttagcacacgtccag

SEQ ID NO: 74601 - DNA, 1043 bp, Oryza sativa
catgcggtcctcctaaggagtcgcatgcgcccgtttaggaggaccgcatgcaaaaataagctccctcctctctagatcttttctgtctcaacactttgaaaattttcatccttatccccctctatctctatctctcaccttctcattcttatccacccacatcctctctctcattcatcatcctctctgcctttctcaactcctctcctctctctcactggtcgacagtgagaggtgagaggcgagtggtgggtggcctgggccctcggtgggcgagagcggtcgagagcggcggtagtgggctcagaagaggtatgtcgtgggcgggagcagccatgagagggctcgacggccggaggtcgcggatccagcccgggcggatccaccggaggcaggtgatggcgacggtgggatgggaccgagagcggcgggcgggagcggccagcgacgatggcatggatctagcgctgacggcccatccctacgcggatccggcatcaggggccctctctcacgaggatccggcactggcgacgttggagggtggtctgcgaggcggatctggcgcagaggacaaagtgacgtggggtggcaacgacgccgccccacgcggatctggctgacggcggcaggctagggttcggccggcggcggtctattgtccgcctgggtttttttcgaaaattagatttttgcatgtggttggctggccacatgaaaaatccgattttcgtagacttttttgtgcatgtggttgtgcatgtggtcgggatggctgcatgcaaatatcacttttgaccgcttgtaaaaatgatttttttagcagtgcacccttaaggccttaataatgacaaagaatcccggtgacacatcaacttcgattgtaaggctggaaacataagtatactaggtgatgtgaccatggctactatggatacgaccattgctcacatcatgaatcaacaagaagacatcaagatcaagtcctccatgtgctgcaatctgattcggccacgtgttacattgctgacttcaaacggccg

SEQ ID NO: 74602 - DNA, 13815 bp, Oryza sativa
gatatatgccggatatatctaccaaattagtagatcaattaaattaattaatctactaattaccttgtttgtcatgccgtgcgtccttagtagagattcatgcctgcggtagattaggacgtggattaatatatcaccaggatcatgctgactgtgtacgggttggacacggtgccgagttcggcctggattggccgcaccagccgatgtcgcgggcggagggcctgatcagtagctcaaaccgatcccacatgccgtcatcattggggtgactctccacggcgacgatttcctgaagcttggtcgatcttatgagatcgaattgttgatgatgatgatttcgatctcatcgagggacatactccggtccggttagatctcctatagccgaagttgtcgagtagtatgttgtcggagaatccatctcttgaacccatctcgtcgaaatcctgaagcaccaaaatccccctacctggcgcgccactgtcgacgtttgatgtcgcaattctggtatttgcatagtatggggatcgtcggtgctaggatatacgcgagactgaggtaaaagagatggagacgaggatttttatacaggttcgggcccctgaactgtcaggtaataaccctacatcctgttggccggagccggagttgcttttattcaccataatcacaccagtactatatgtgggtagcctatctaactgttgtcgacatggcggtttgaaggtctgactcgtagtcgacaacagggtaaccttgctcctcgagctcgcgcccgacgaaatcagagacagtgctagatccctacggacggcctctgaaggtaccggatagagttgatccaggcgtatctctgatgtcgatatccggcggcttgtcttggcgtatgttggcttgtatgctgtggcttctgttgttccgtatattgtggtaggtgtgttgattgtggtggtcgtcgattgtgttgtccgtgtcccctctcctcctagggggtcttgtatttatactcataggtgtctccttgtccaagtagaattagggtaaccaatatggatacaatctaagtagttcttgtcgtttccatgtagaactcgggttgtctttccttatccggaactcctcctatatccgcaggttgttttcgtataggacatggtatgtggtgggtcctgccgagatgtagtcgactactattaggtatgtggtatccataaccctgacaattattaattgacagatggcttgcaatccttgcacgctttcaggggcgccggattcacctgatcttcagattgatccccatgagcctgaacgagcaacttgggaggatccactctaatcttgacatcagtgagtttatctgcgtctgtctcctgtgatcagcaaacaagggaaatgattatattggaggtcggaaaaaaaaaagaggtacggatcatgatgcatgaataaaattggaaaaaaaaaaaacccaagaatcgttttgatccgattcatcatctattattttctgcgcattttggaggtattcattctcatcttgcaagccatagtgattgacaaaagccacccaagcattttcaaactcctgtgctgtgcatcctttatcaaggacagagggcatccaatactttgcaaaatcctgtgatgtgtgtgcttgaccaaccttgagttcatctgatcgcatgtacgcagagtgcacatttgcttggactgaactgaaagtgtgccaacgacaacgttcgtcgctatacttccacaatccctgcttgatctcctggcttcgagctgcagtgttcatcttgtccatatgatctgtctgcatgaacataaatagaggaatatattgagtagtaccccagtagcgttgaacacatatcagaaaaacatggatagatggagcacatacctgaacgtcgtcgccgataagattcaacagtaggaactgaaaagccgaaattcttgttggtgacaaaaaccagaggatagaacgtatgagaagaacaaagtcatccggccctgatatttattgtcacctgtagtggcggccttgagttggtagggcggcaaaaattgaaaggaatcaccatgtataaagattgtatttatggatatagatacagctatgaaagtggtacctttcagaatatcatttcttaccatttatatgaatatctccattaagacctggatactgattgcataaatcagtatacagctggtgattttgtttcgtaaatcacatatacatctgatggacaataaaagagaatgaaatccatttcgatctatttcatgccaatttattattctactccaataacaaaattcgaatgttgcacatatacctgacgtatcagtatgataccatgggatgaatacctactgtctcagccatactatttgttaccttgttcctttgttagcttggggttataacatgattagatgttgggttagggattgcttagccatgcttagctcaactagcacataataggggaactacattaatgcatagatttcagattctagattggtgttggactataaccaccgctctggtgttggttaactaaaatatactaaatggtgcgctgtgggtgcatggttttgatggtcgcacccatggaaattaaggaccggttcgtgggatgtcctggaaaaacttaccatacttaccacaaaccagcatgggcaacggctgggcttgtagtgtagctttcctctagctgacgcatccaggcaagggtgagcgtgatggagttcggatgggccctgcgatagcctgtgcggctttcagattcacctaggcacgaaaggggactgcccgatgccttgcgaggagtgggggtgaaacctgaggtgtggtgtgtttggttagaggaggttatgcgaagggtcctgtcacggcctctttccggtatgttgtggtggcatgccggcgcacggaaacatgtcgtggggctgtgtcttttgggtacagttgtccatctctgatcagagtaaaactattcgaatagccgtgcccgtggttatgggcggtcaaccagattcaccgtgattagtctcaccctagcttagtctaatggaattgattagttcaggtggttggttgggcctgttgcaatgcggtgtagcgttggacaatggatggttaatattgattaattattacaactgttttactattttcaactactgtttataaatgctagctttatgcaaatgatcccctttagccttcctttggttatatattgcatcataccctccgttccggtatgacttgttgagtacagtgggtagtactcagtcttgctctatctcccaaccctcagagttcgagtatgcgttagtggtggtttctcagaggagtaggcttcgtccgtgccgtcgaggatgcctatggagtggtgttcccgctgcaatccaagtcaaggcttagctccagttatctttaattttccgctttatttatgtaagacttttattatgtttgtaagacgtggatctgtatgtcaactttgttgtttgtgtaccttggccggtcctggacaggggttataatgcacattctgcttggaattctattcgagaatttctgggcgtgacaagttggtatcagagccgaccttggccgtaggacaagccaaatagaaaccctaagagccaaattgtatttgtttcgggaaaaatttgggtttgttccttgggtccatgggaaaaatcttgatcgctccttcaattgaaatttgttcaaatgaggtcagtctagggttttagtaaaattatttgagaattatttgacagtcagtcgggatttaatgggaggtatgcattaggtcttcactaaggaacatgggttgcaagttatttatgctcttattatcattgttattattattacgtatctaattcctcattatcttattgtaatgtatgtcagtcttatttattcgctctcatgcaaaaatgatctatgcacaaaattctgctcttattcgcttactttatttcagtcctttactgtttattttataattggatttgatcatacattgattctccatcctttgtcttctatagatggccgactgtcccctaaagcaccaaggtcagactatgggaggcttcgttgcagagttgtcccgcatggcgtttgtgattggttttccaagggagctgcagtacaccagcatccaccctcttagtggcgagttcccacgtcaggtccgcttggagattcacggcatacactcctacctgcacaacatggaggtgacagcttgtgggggcacatttgagcatgcttgtgaggaggcctccctcaagatgatggcccatttgagggagcggcatgacggcaccctgaacaccaccgcctaccgcttccaccctcgccgcggttccagctccaacaccagcaccttcaagtcagcttggggagagaacgacgtcaccttcggccacatgagtgaggtgatggagggctacgacaagctgcacgccatgctccacaaggcaaccaagaggctcaacgaccagaagcttgtgaggatcgctgagttgcaggatgagaacggtcgcctcaagaaggaggtagccaggctgcacggatgctcaccgccaggaggagcccgcatccgcaccatgccaaggaagtcgaccatagctccagtgcgcattcagcttgcgcccaggaacccgccaccacctccacctccagcacctcccgcagctccggcgccagctccagctcctgctcccgtgccagctccagcatccgccctctccttcgtgccagcttcagcctacaggggtccagcaggtggcagtggaggatggctgccagcttctcccagtggtggtcgtgtgatcatcagcagttccagctctgaggcaggcagcggcgacacctaccagctatatatgctgattttctttctacagaagtatatactggactctgtatgtactgcttttttctatggagtgctaatatgctgaatttttctatggtcgggtatatactgaactttgttacacaaaagtatatactgcattttccatagatatgctagattttttcaatagagcggcacatactgtcttttctaacaacgaaagagtagtaacatacttaaaaaaaaagaatagtatgtatccccccccaaaaaaaaaaaagaaaagaacagtatatactccgacaaaaaaaatcagtatacactacaaatttagaaaaatggtatatactataaatctagaacaagtggtctctcctaatactctagaaataacggtatatatatactactagtttctgcctctctgctttccatctcgtattacatgtattgatgcgtcaaatattttcttattgatgttgatctaatattttaatattttcgtgtagaacggtcgccattaatttggagtgaggaaattcaaacaaagtactgtgttgaacgccttgaaacagaggaataggaaggtttgcttgttctgatcaactagtaatgccgagggagatcgaggtgtgacaccgtcgccgtccgccagggaatgtcatgggagagtgcggcgagatgtcgcccacctgcgcaagggatgggaacgctgccgatgagatttagtcgtcggcgtcggcgccgccgcctggacactagggtttttattttctactatttccttttgatatcgggaatgatggatttgtgcgatccgttcggtatggacgagtccatttattcaggataattaacaattacggaaattatttctttccacaaaaaccggaacgggttcgtgatgctgcgcctgttagcaggtatggggatactcatcatgcaggttgggatcaacggtggatgagagtaggagtacgtacacctgggagtatagaagcattttttttgaaacatatatatgcataatatatataaactattgttgacggtcattagcgatcagtttcgactgtcaatattactgagatagaggagaactagttatgcttgcattgcatatccatgttagaacaataatattccactagtatttggttcactaaccttttacagagaataatcataaagtggaagagaatcgacatcgaatcagacgataaatcaatcggacgatgtcgagaatcagacttgtatgaattggccaagaactcagaattgacacgatgaattaggccaaaattcacaagtttgcaatgagcaacagaacaggaggccacctgccgagtttgggccaggtgggcccagcccatggtttggccgaacctgccatggtgccgatggatgcagggtttgatggacggctgggattgatccccaatgtcggttggagggtattaccgaccattccaaccgtcataatcgtcattacctgcctataaaatgagctcactctcttcacttcaacatacacctcaagcaagagctctctcgtattctctcaagttagtttagtgttcttaagctagtggaataggaataaagtagaaatcggagtccggaagccttcggaagagttcgggtatggctctagtagctcttctcttctcttttgtaagttttttacttttattagaatactcttatttatacaattatggtatttgtcagggttgtggataccacatacctaatagtagttgactaaatctcggcaggacccaccacataccatgtcttatatggaaactgacctcggatatggagggagttccggataaggaaagacaactagagttctacatgtaaacgtcaaggactactcggattgtatccatattggttttcttagttctacttggacatggggacacctatgggtataaatataaggccccctaggaggagaggacacggaacaatagatcaagacacaagatcaacatacaagccaacatgcgccaagacaagacgccggatattgacttcaaagataagcatggctagtcccctacggtatctacggatactgtcaggagagacatagcgctgtctttgatctcgccggatgcggattcgaggaggaaggctaccctgttgtcgactacgagtcagcacttcagatcgccaagtcgacaacagttagataggctacctcaaatattatactggtgtgattatggtgcataagagcaacgaccggcttcagccaaccggagtagggttattacctgacaattcaggggcccgaacctgtataaaatcctcgcccccatctcttttacctcaatctcgcatatatcctagtaccaatgatccccatactatgcaaataccgtagtcgtgacatcaaacgtcgacagtattgaaatactttccgagtatatgaatgcgaattttacattatgttcgtgttatattgaatatactgctagcttatctgggagatgcgttggtacgggtataatgtttggttatgcaattactctatgtcatgaagatgatattagagtagtatctagtagtttaggcgtggtgtctagattacgggatattattatttacggttatatgctgcggatgagaggtgggccgatgatagtgatagctcagtacgggtattcctccgcgtgtatatatagtcctaagttaatttcccggggagggtactactccgcatttagccccggttgtatggtcatgacgggctgtcgtaaggaactcggcagtcaggggtggcttctcgaagtaccaggagggcatcggatagggggtattagctactatatcagataactaggatgtatatatactatgtatatttgaagtataggaatagattctctttctgttttcttcccacttagcttaaatattttagtatgagaatgagtagctccttgcttgtgtgtcactctaccctttggattttcttaacccctgcatagactatgattattacaagtaacatataaattattagtcaggttctctctactatgatttttccatgggattaaataaatacgatacccttggaatactctcgggtgaaatgctacaatgatatatctgtgtgcttgcggataaactctgtaaccataatataccaagagtatttttgcgccattgctaggaattatatttctagtaatgtcgttaagaaataccaacaacaatgcagcaacatggccatggaaataaaaaaaaatgaatcgatctttagtcccggttggtgttaccaaccgggactaaagatggctcaaccggccacgtggttgagcgatctttagtcccggactaaagatcgatctttacttccggttttttcacctcggactaaagatagcgatatttagttccggattggtgatcccagttggaaaaccgggactacatgggttacaaaccgggactaaagacggtttcttcaccagtgtagtggccagatttatatccattatctgaaaaaaacacacgtgcatttttctcaaccgcaaaaacccatgtagtttccagtttcctcgtactctctcccggcaataattggtgactgcttccacttttagctatttcctgttcacggttccccacatcttttgctagcatgcccctacccattcatattgaagctcatagaatagcccattgccagagatgaggaccagatgaggaaccaacaattaccatttaaaactccataaaatacaaaaagggaagggatagtacgcactttgctgaagagatggcagctcctttgttgttatcaacaatcattttggctctagtggtggtagcatcctctactcatggtaccatggccaatggggtattccaggtgcgccgcaaattccatatcgtggacggtgtgtacaaggggagcgacataggtgcattacaaacccatgatgagaaccgccatcgtcgccgtaaccttatggctgcagagctcccacttggtggcttcaacatcccatacggcactgggtatgcttcaatcatctctgcatttggtcatgtctgtgtttgcttggttggttggtttggttattagggttaaaaaatggatcttggcataggctatactacacggatatagggatcgggacacccgccgtgaagtactatgtgcagttggacaccggtagtaaggcattttgggttaatggcatctcctgcaagcaatgccctcacgagagcgacatattggtaggtttccttgtagtgtttctttagtttcagtcccttaatttgcttgcaaaattcttttgcaatttagggtttttattcattatagaagttgaaattctggattgtaatatgtttttgtttttgtcgtgggtacgtgtatttgcttgtgtgcagagaaagctgacattttatgaccctaggagctcagtaagttcaaaagaggtgaaatgtgacgatacaatatgcacttcgcgaccaccatgcaacatgaccttacgttgtccgtacatcacggggtacgctgatggtggcttaacaatgggcatccttttcactgatcttctgcactatcatcaactgtatgggaatgggcagactcagccaaccagcaccagtgtcacatttgggtgagttattaaagaaagagcactgctacacgtactatgtttttcttactaaatttttactaacaatcatctcaactgtttgattttgctaaatggaagttataaaaaatctagatacactcatagcatgacatatcaatgtattacaattcgtatgtgaaatttattgatttacaactgaagtgatctattgtaaaatgccattgataagcaatagttcaacaatatgttttccatacgtgcaatactctttcttttttaccatcacatcatggttaacctcaaattctgtctctagtttttacaaaatgaccaaaatatcattgagaacacacatatacccttgacagacttcttttattttttacagtgaccaaaacacctttgataactctgttaaaccctcgacagactttcgcgagtgcctgttgcagtttatggtgaaatgaactttccattagaggacaacaaaggccccttaatggttagttcacagcaatggagaaaaggtagaaaaataacatgtatgatggcataacatataactcatatttataaaatcgaaacacaataaccaaatctaccagagagttgtgaatggtacgaacaccaaaaaccaaaatggaataaaaataatcctctaaccttacagagtccacgatgaagtctggtgtgcaccggtctgaccgctctgatgctgtcggtctgaccggtgtagagtcgccggtccaatagccttgcttctccctttgcctgacactgctggtccaaccatctagaagtcacctgtgtgaccactgtgccgccgccggtcagacctcaaggatgctaccagtctaactaccgaaacaaagtaaaatacaaatcaaagaactctttagaagtaaatcaactttattgtttctaattgtgctcacaaagtgtaacaataacactcatttctcaacttttgactatactcaaaatttaggctaaacccttttttttttcaaaactgttatctcacagaatggtaccaagaggctcaacccctcttttatttataccttgaagtggctgcacaaagccacgaattcaacttggataagtagttctaatctcatagaaaacctacccgaacaagtatacaacttatcgctttacaaatcaaactccaatcttttcaaatttggattccttccaaatttgagtcatatttgttgatggcatttcatagagtcgagtggctgcatgttgatggcattttatagagtcgagcacttgcatgctgatggcacttacaatgttccttttcataccaaaggcattccattgcacaagtacacagtaggcaatcactgccggtctaacggttgctataggctagcagtgattaactatatataatgccggttcatgctggcttggatatttttttccctaccaacccatgtgtatgggctatgatagacctagcatctctgtcggttcagcaactggtagtgataggtgaggccaccactgctggatgacctcatctagttcaaaaactgatagtgatgcattagttatgaatcgatggtgatcggagtttccgtactggtattgttttattaaatctgaagcattattttactgcatcacatggcaacaattaaaccatacatatattttttgttcactattgtctataaggtgggtatgctgtattgattgtcttttattgtagatattctttttgagaagccatgctatataagtttgcccacttaggacctgcttgaaattgattattgactgtatttttttcatggattatctgctttgattatatggatagacaaaatattttcagaaatatattcaacagatagcttagaacaagtggtccaataagtatacatgcaatagaagaatgttcaattttagaggcgttgagcaaatccatggctataatccagcgaagtagcagaagagacatggcataagttaatgctcctgtggggggctaccattggatgttgcatcacacaacacactagttctttttcatatgaatggtattttattgcactagcacacatgagctaatcactaccacccatcactactggttgacatgcatagtgccaacaattattgactattaatgccatatcatgccagccgggttgggcatttaccaaatcctatgtgaattcactatgatagcctgagcatcgctgtcggttcggcccccggtagtgatagccgagatcactagtgtcggctggcctctgctggtttagaaattagcgtagatgccggtgatgggttttgtgtaagtatttttatttgcttttcatgtaaatctctgatgaactcatcacatgacaataaccggttatggcggttataggtatattttgatattttctatgccttgttctccataaggtgggcaggctgtattaattgtgttttattatagctgtgctatctaagaaggtgtgctatatatgttggcccactaaggccatgtttgaaacaaattattactagtttatttttgtggattacctacttgagaaacaatcttaacaaatggcttggaaagtaatctaacctatgcagtagaagaatattttttagcaaacatatttttagggacgtggagaaaatccgtgacaataattcgatgaaatggctcccctgtgcttctaggtgtggtttacaacaatctggaagtttaaacaattcagcagtagcgattgatggaattattggttttggcaattctaatcagactgcgctatcacaattggctgcagcagggaagacaaagaaaatattttctcattgccttgattccacaaatggaggtggaattttcgctataggagaagtggtggagccaaaagtaaaaacaacacctatagtaaagaataagtgagttaaccatgcactttattatgtttcttttatggtcacaatttaatttggctctactttaaatacatatatttttaccctggttatagcatcttccggtatacttgtttaagaagcatttatcaacccccctaaaataagatgcatttatccacttaaacatgaactgtgtcaagtggtacatctctggtacaaacgttgtgaaaaaaatgtatgtgttgttgttcttgagtgttcttattaggcacaatgtttcaaagttttgaatgcacatagctatgtgaaaatttatgttggctgtcttcaacatggactgaagggtgctcttaggctggaatcgcttgaaccttaaactataatttttaaaaaagctatttatatactttagtacatgatcttggctctccaccagtccctgttggatgttaggtttatgacaagtagggatatatgcatataatatcaatttgtattgtagtgcacgtatgccttcttacatgttgtaaccttttgagaatacatgtctttctgcgtgtaatccagactcgtggttccaacacaaagaccataaccaaccttgtttggttctattctcgtttccaccaaactaatgctattgtatccattttgaatctgtataataatcactggacccaaagcatggatttacaaatttgagggaatatgcatagttttttatagaaatacttatcatgtttatctgcatcttctgaaaattaaaagcaacaaggcatttggaacttttgagcccactcacacaccacgcacactaactcacatcaattcacgattctatcacatagtgaggtatatcaccttgtgaacctcaagtcgatcaatgttgctggcacaacacttcagcttcctgccaatatttttggaacgaccaaaacaaagggtacattcattgatagcggttcaaccttggtgtaccttccagagattatatattcagaactaatacttgcggtatggcaaaagtactgctattcttttctagtggtagaattgtttgcaattacgtttacatataactctcaaccaattgcaggtatttgccaagcatccggatataaccatgggtgctatgtataattttcaatgttttcattttcttggaaggtatactctataacacaaaatctagctatagtgcagagacattacattcaccaatggactaaataccagaagattcataggattcatattgagttctaattcaatcttttcaatgcctctgaattccgctttatccatcaaataaccccaatttgttggtactccgctaacattacccttgttttaatacccaa

SEQ ID NO: 74603 - DNA, 719 bp, Oryza sativa
agggcgaattcgagctcggtacccgttttggcatggacatcccagatcactccctgatggcggttgcggggcagttcggacatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcatcaacgtttctcccaaatcgtagttatcacaactcaccgaaagatcgggccaacaacagccttgagtgtcgagaggaactcagggttcatcactaggtgaaaccccgcgcattgttgtgggaatttagtatgataataataaaaaaataatgtgtaaaatagctagataacatcagattaagtaaataatgtggtttataataatttaaatttaaatagtatgtagaatggtgattcaaacgtaaaaagtaaggtggtatgacttcatggaagaagaaatgaagggagatagtttggaccttagattaatcatctaaaggataaaaacaattgatgtgatatgacttaattagaggaaacaatgagaaagataatttggaccataaattaatcatttaagcactactaagtgaggatgaactatataagtataaatgatatcataaaacataataaagatatacattaaaacattatgtg

SEQ ID NO: 74604 - DNA, 3044 bp, Oryza sativa
tatcattaccctcgattattgtttggcaaaatttgctatatgatatctaaaatttgtgtaattggttggagaacactgaaggcactattttataatttttggagaaaaagtggacaaacattttgagtttaaagttttcaatttccaaatgaaggttttgaaatttgagttgaatgtttttggagttcaaattaaaagtgttgaaatttggttgttttttcaattttgagtttaaagtttgaaatttttcactaaaaaattcccaatttccttttcagatttgagtttgatacactccgtaaaaaataatgtgcgtcattgaaaaaagaaaatcatgtcgcaattcacattgcctatactgtcctcaccaagatcgagtcggtgtttgtaccgcgttcctgttcctcgtagttctatgcataacagtgcaagccattttctcctgtaaaatcaaagtgtaaaatcaaagtgtgtttgattgttattctgtgatgaacaattggcatatgagattattgattttgatatttggagatcattgacgaagtggttttggagatgattgatttgcaggtgatgaacagagactgttgctgacaggtagtgaccggtcaggccgggttgttgtagtcagtcagaccagaggtatgtgtgcggttagaccagctagctcgtggcttgaccggccggctctgtaccggtttcggtttagggttgattctttggatatccatggacaatcaatgtttattctagatggatactatgcatatgtaatactgttgttcgctaacaatgagtcaaattggtgagaacttgtgctcggatattgtttcttggttgatgcgtttgtaggtggtcttgatgcctcgggagagtgttgccggtgatggatcgggagtcaacttgggataagatgacgtccggacgatcagaatatcacgtgggatatttaagctaaagatcaatacacgtggttgtgtgtatgggatacatagccgaatttagagggagtccaaatttggttcaattggagtttgtaaagtttgtttcttgtacggaaaggtttcttaggggattatgacttcttgtacaaggttggtctgtggctttaggctgcttacgttgggtataaatggagaaggagggtgtgtcattctggtatcatttttgatagagttgcgttgagataagataggcatatttgtaatctctatacatccaaaacttaaatgaagagcttgtcttttcgtttggcaatatttgattcaactcctgttcgagagagtttatagtagctatagcttctcttagaaactccagctgtcagacattccccaaagagttatttttaaccagattctgataatttgttgatgtagaatccatataatgaactagaagccaaaagatgagaaacccaactttctagatcttaccaacagcttatcagaatcttaagttcccaaaaacatgatttaaattgttgactctatccaaacattcatcttaatacttctgggttatgcagacttttggataaaacgagtaacatagttaatggacgaaaattaaaccatggccattggtaagggaagaaatagactttggttaaaattaagaaaagagaagagctcattattgggcggggctgagtcttttgacgcagctttagaatctatcgagctttggtctacttttctttttctagccagacaaatcattaaataaaatgaaaacgtactactgtgcaaaatcaccgttaaaacaccaccaacaccaaagaaaacgaaataagaaaatactttccctattattatatacatcctgagtttaactcggtaagacgggtaagtctcaagtgagtacgccaagactgtgaagagcttttccttcccacgcatagtagtagccatagtcgatacagcaaaagattagcatgagcctcacttcaggagacatatccagattaaaattgtggcaagaaagcaaataattcagaagttaataagaacaaataaatgtaaagcgagaggtattcaggtttttttgccaaaatgaatacggcgaatagcttcctgagaacgtcgaaacttctgattcacatctatcatctgactcgtctcagctggcatacttcattgaagggcctagctaacaaactaaactgccttctcagcgactcaacagatcagagacataagaaaggattaaacgacacgctttgccaactgacagctcaaacaaatgtacagctgatacccatcagtaaacttgtacatggccaaaaaacagatttacagcggcgatacctaacactcatctaattaccttttaagtacccggagagatctatacaggccacagtaaaaaagaagagaacacatccagtctccaccaggacacccctattggctattacagtgtatctcaaaacaaaaatctccacatttgtcaattcaccagatttgcttattgatgccaatgcttaaaaaggattagcgtcaacatctgtacagcttagtgactgctgacattggctagtcttggaccccatccgcactcggttttctgaaaatcaaggagaaacgttagaagttggaaagatttcggtcccgattgcatgtcacgataaacaaacttatccgctcacctcctgtaatgattaacttctccacacgcgcaactatatgcttcccgaaagtgtagttcttcagttcgttcaaatgcatcttgatgcttgagaggatcacaactaggaatttgtcatcacatgtctgaaggattctctgtacaacataattgccaaactgatccttcatcagtccctgcatagattggtcaaaatgtgttattacaatcactgaaaaatcattgtgcatcaagacattgtcatacagtactagtacaaatacagtgaacattatattaaaacccagtgccatactgccatgtgttctgtatgaacaataaatcctaaaggctcttgtgcacttacttgacatacaaaatgaaactaaacacaataaatacagcattgatgt

SEQ ID NO: 74605 - DNA, 660 bp, Oryza sativa
tgcggctttttttttctttttttttgcacctttctgcctttttttttcactttttttttgattttttttaacaaaaactgactcaaggcccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggacttggccaggaggtggagtggatggcagccgaatttggtgtatgggataaaaaggaaactgatttttaaccaatccaatctactgtatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctggaaactacaaaaatagaaccgtggcagcgagccgattccgttttcgtaggtcccgacaacaacagagacacggtggcagcaacga

SEQ ID NO: 74606 - DNA, 4887 bp, Oryza sativa
tacccttgttttaatacccaagtaccctatacatttgttgattgtgaggaaaaccagtaattctctaacaattcccattgggtcataacctaataaagaacgctgcctactcaaaccgaagctttgttatggacaattttaagtcttgaataatactctaaatgggtgaagttgcccaaattaccaaaaccttagagtaaaaataaaaataaaagaaacttttgcttttctatatgagtttcagacaaaatataaggtacgatggagaagcagtagtggaaattgttttcattatactatttactcggtaaaagacacataaactgctatttcatctgctacagcagcaaaacctatgtcaaaagtgcagtaagggtttatttagaggatttcctatttcttttcggattacttagactgctccatagttctgagggatggggtatattatatgcaacttagtcttcagatggtagaatataattattccattttactttgtgattattctaactatgttgttgttttcttgtgcagtgttgatgataaatttccaaagataactttccattttgagaatgatcttaccctggacgtgtatccatatgattaccttcttgaatatgaggtaacatgacatttcacccccatgctctaccaaagttggtataaaaatttgttcacaaattggtattgccttgtcttattacttctgacaacttaacacttcaaacttgtcacggccagaaaataccttttccgaatgctagtgtattaatccccgtcgtaggaaaatccggggacaccacaacagacttgatacaaaagacacatctttattaattatcacgatgatatttatattattacataggcacattaggcctatcaacaaaagaaaaacaacagcggactagaggacctatgactccatcttcacaagcgctcaacagtgctataagctaggactccacttaagacttcttcaaagcttctccgattagaggataaaagattaagaatgagtacaaccaccatacttagcaagccacaccaagaaatgcacacataatgcaaatgggtacaagcaataatgatacatgttgacttttgcttaaaacccatttttaaatagtttagttttaaaacacatttcaaagcatgatcctaatctagtcaatttttttagtcaagctgcacacttgcacgtacttgcgttaacccaggccatcaaattgcagttccaatcattccagtttaactaaataaaatctctaacttgggaacattgctaggcttgcccataaccgagggcttggctattcgaatagatgatattctgatcatccatgtccttttgtttctgaccatattaagctatgagttaagccttgcccactagacatgtggttgtaaggaatatgcattgtaacataggcccggggaccaatccttatatatgatggccaaggtgcgactaacagaaccaagcacattgagcccaacctaaaacaagtttgagaattatgaaaagaagtccaacatgtccaggctaacaagcctctaatccaccattaatcaagattatatggttattcccaaagtccagatcattagaaaataactatatgtttatgttagggcattgttaagcataatcctaaaatctctagtaaacaccgcacatagagttctcactagatagttttggttttctagggttgtcaaaggtaattactcaatattcaataaataaggccataacaaagaatataggaaaggctaagtaaaacagttataacgcgataaatttagtaaagcgaatgcaaaaatttaaattaaaatactttccgtaaattgggattcaataaggagagcgtgacttcccttgctcaacggaacaaacttccgagacttcagcaacgaacatgaactgcacgactggaatctccaaaatgacaacaactataggtgacccaaaacaaagccacaactctaagagagaaatgataacaagacataaaaacaacatacatgggtaatttaagttataacaaaagttcaactggtcaatttggagctcatttggccaagagaagacaatccaaaatttaactgtagtttaaatgaagatttctgaattgtttaattattattgttcccataaattatgtgtaacacaacatcgctcgaggagagaaaggatcgagcgactaacagccaggaccaacgggtcagacggctagttcaccgtggatcaggttcaccgagacgatgcacgggaatagagcacctacatgtaagcctcaaagaaaagactgaagagtggatcccacatgatgccaaacaagcagtcacgtgcgtctaaacgcagctacactttacgtcaaaaaaatgcagctacacgcggatggagacgacaactggtgactgcggcacatgactggtagtcacctaaggcaaggaaaataggagggaaagagcggaaaccggattctcaccacaaacatggcgacatccaaaatagcgaggagggaattgttggtgaggaagacaatggcgagcttgagcagtgacgacggcaactggtcaacgacgaggggacaatggagggattggtgctgcagacttgagggaggcggtggtgagtggtgacgtcgggaagcacttggacgaggaggggacagcggccagaggaagatagtggtgacgtcattcgggttgatggcgggggtgcgttccgatggtcttcacttgatgagaaggcacggttgaggaagaggacgatgagggaatcgaagaccgacattgaaggtagacaagttaacgcagtggggtggtgctctggcaaggctggagggactgccgaaggaggaagaagacggcgttcttctctgatcactagcaaggatgaacttccagcgatctccaggcaaaatggtggggttgctgagctataggaggttaatgcgtggccaggggtggcggcgccgaggtcttccatacgtggcttgggtgggtctacgggaaagggtggcaggagctcgccggtgcagtcgagatggcaggagagcaagagagctcgaggtggctgtgaaaatggatcgaagggaggaagacagcgccattttataggctgggagaggaagaaggggaacggtcgtgagaggagccacaggccattaacagcgactatgaattgggaggtttcaaatctgcgatataaagccaaattaataggggggaaaatatgacagaattggagagatgaaagtagggaaatgatttttgcaatcaatttgaagaagagacgtctgggaaggcggatcaacctcggtggcagtgctagtgctagctagggagaggggaactgaattggcgggttggaggtggaagacgacgacgcaacgacttcctgggctggctgagccgtgcccacctaggccgagcaaggtagacccgggagaaggaggggactttgctcatgagccaacggaggaggacaggaagcggactttggctataatcggcccaaagagaggacatacttgtttttaggttttttattttcataaactctgaaatttgttttgctgcatattttaggatgctctgaaaaaatcaaggaaaaactgaggtgacattttagagcatggagaatttaagaaacatactctaagccacattcaaacttttcttgaacatgttcttgaacttttctcaaactattatagcttttaattatttctattattcattttagaatgtgatctttaatttgggatgaatttatcaagacatcacaaaaatgaaacatgaaacaattatatgaagccaaaatagttcaaagtccaaccatggattttatcccatacatattgcgggccacatcatgcgctacatagatatatgtgctagtcatataatgggtacccattaacaaacattcgctaaattgaatatatatgtacttcgtgtcatactttttttcttctttgtactgacagagtaacttaggctcatcgtcattggcattataatgtagagaattgtttaattagttacaagagagataagaaataatctatatacattaaatagacgatgatatctccaaaagtaactgtacggttttgagtttcaccttcagctgtcaaattttagttcttgtttcgtacgtgaagagtcccattctgagattctcaatcaactgacagttagttgtttcagtcatgcatgctactctgtttggtatacatgcttttgtttaatattttatagtgcaagtctatagatatatgttcatcacacttagacttgtttggagcagggtaaccagtattgctttggattccaagatgctggaatacatggatacaaggatatgatcattttgggaggtttgcatatattgctctccaaaagaaaattcctttttcatatttttttttatgctagagccattgccctgttttttttcagacatggtcatctcaaataaggtggtcgtctatgacatggaaaagcaagccattggctggacagagcacaactgtaagtttcaacttgttcaaattttatcgataaattgttatattctgttctaacaccagcggttgaggaggcatgtggcggtagcgagggcctcagcccaataggaaggatgcatggaggcttgtagatggaggcacagaataaagtcattggctaggagtaaggagtatgaattggatgctgaactagctatgcccctgcatcttggctgttctagccatggcaaggatagtgttacggctacaatttaggaggtgatcaaggtatggcgaggttgtataattgtcaaactagtggccaaggccctagcactctaggaatccgaggcgccag

SEQ ID NO: 74607 - DNA, 714 bp, Oryza sativa
gggagaggagagagggggcgggagatgggccgaattcggcccattagagagaagtagggattttagggttttctttttataaaacctttttaactttgtttatttcttaataattattatttgtgctttgaaaattccactaaaattaatttacacattttgggcttttaggaaatatacaaaaatcctccaagccctatttgacttttaactttgcacattttaatttttgaaggctttcacaagcattttaattattctaggtataatttagaggatgtattttagggtcgatttgggacgcgacaactggtacaggtatggctttgaataatttgtttgcatgattattagtaaggaagtcgtaaccctgttgtagagtccatagccttcactcgggatgagcaaatgttaagtgtaggggtgttgttgacggtcattaaatcataatatttgaccgtcaatacctacatataatgaaacaaaacatggtatccaacttagtggtagggattattactaatcaattccactagtgttggtgaaatatgtgtatgcacgtattttaatgagaaaacacacccgacatgcgaggaaacacacctccgaccaatcagacgcgagcacacagattggagggcccacaaatcatgtgaaaccggccgggaacggtcataactgccataaccgccatcagggcccaccagtcattgt

SEQ ID NO: 74608 - DNA, 7932 bp, Oryza sativa
ggaaaaggggggggaaaagacttcttttagggtttttctttttttataaaacctttttaactttgtttatttcttctccattattatttgtgctctgaaaattccactaaaatttatttacgcattttaggcttttaggaaatatacaaaaattctccaagccttatttgacttttaaatttgcacattttaattgttggaggctttcacatgaattttaattattctcggcataattttgaggatgtattttagagtcgttttgggacgcgacaaacctacctcccttaaacggaatctcgaccccgagattcggaaggactggcgaagagatcgggatgggctgccttcagctcgtcttcacgctcccaggtagcttcttcttcggagtggttgctccactggacctagcaaaaacggattacccggttcctggtcctgcgctccatggtgtccaggattttcattggcctctccacgtaggtcaaatcttcgcgaacttcaatttgctctgagtcggcctgctcggatggcactcgaagacatttcttgagttgagacacatgaaacacatcatgcacgttgcccaaggaggcgggcagctccagctggtaagcgacttctccacgccgagcaatgatgcggaaaggacccacataccgaggtgcgagcttcccctttgtctgaaacctatgtacacctcgcaatggcgtgacccgaagatatacaaaatcacccactgcgaattccaggtcacggcgacggttatccgcataacttttctgccgggactgtgccacctttagattatcccgaatgattctgactttagcttcagcttctctcaggatatcagtcccgaacacttgactttccccaacttggtcccacaatagcggtgtccggcatttgcgcccgtacaacgcttcatagggtgccatttgtatgctggcttgatagctgttattgtaggagaactcggcataggggagactcttatcccaagtcttcccgaaatctaggacacatgcgcgaagcatatcttcgaggatctgatttagacgctcggtctgtccatctgtctgcgggtgatacgcggtgctgaaattcagccgggttcccaactccatgcctgcagtttgactctagaaatccccggtgaattggcttcccctgtcagacacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatcttcgtactgcccgggtgaatggaatagggactttcgtgagcttcctagagtatcagctgtttaagttctctgttatctgggacgcatacccgatttccgttccataaggttccgtgttcatcttctgtgaaaccagcagctttaccctgtttcatattcttgaggagtccatgcatgtccggatcattcttctgagcctcgcggatttgatcgagcaaggtgggcttggcttccaacgcagctaagaatccacgacccactatgcttaggttcagggcttccatctgttgattaagttcgggtggaatgcctcgggcgttaagagtgttgcaatggcttttccggcttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccaccgctgctaactccaaatcatgggtagggtagttgccttcatggggccgtagctggcgtgaggcataggccaccacatgaccatcctgcatgagcacgcaccccaatccttggcgcgaagcatcacagtacaccatgaaatccttgcgagtatccggcaagattaacactggcgaggaaaccagcttttctttgagagtttggaatgccttctcgcattgcgggctccacacaaatttctcttctttcttcaacaattgtgtcatgggccgagcgattttggagaaattctcgatgaatctccggtagtatcctgccaaacctaagaaactgcgaatttgagtgactgtcttgggttgcttccaatcggtgacggcggtcactgtttcggggtccacagcaactccttcagcagatatcacatgccctaagaatttgacttcggacaaccagaactcacacttgctaagcttggcatacaattgatgttcccgcaactttcccaacaccagacggagatggtgctgatggtcttcctcagattgtgagtatatcagaatgtcatcaatgaaaaccacaacaaacttgtccaagtattccatgaacactttgttcattaagttcatgaagaaggcaggtgcattggttagaccgaatgacatcaccgtgaattcatacagcccgtatcgcgtggtgaatgcggtcttcggaatatcttcttcccgaatacgtaattggtgatatccggaacgaagatcgatcttggagaatacagtggcacctttaagttgatcgaacagatcatcgatccggggaagaggatatttgttcttgatggtgacttcattgagagctctgtagtcaacgcacatcctcttcgtcttgtctttcttctccacaaaaatcacaggagcaccccatggggaagtactcggacgtatataccctttttctttcaactcttccaactatttctttacttcggccagttcatttgctgccatgcggtagggtcgcttgtacagaggagtggttcctggagcaagatctatccggaactcaatctctcgcttgggcggcataccaggtagttcttccggaaacacgtctccgaactctccgactatggggatttctgacagtcctatctgatgcagttctgaacttctaacagaggttgggggtgcaaagaagacaaccggttgttccggccctcggtacagggtgacagtgcgtctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgattagcagagggtttctaagcctttctacccccaactgatttctccccacgaatggcacagatataaacgagtgggaagctccagagtcgaacaaagtggtagcagggacggaatggatgaggaacgtaccaacgatgacgtctggagttgtcagcacgtcctcggccgtcacatggttcacacgaccccgagtgacatccttcccaccgttgttggagcgaggaggcgcttggccttgctgacgcctcggctttgggcatttatccgcaaaatgcccgggctcgaagcagttgaagcacagacgctgctgaccttgagcgtccctgcggccttgaccaggctgcacggctggcgtaggaggacggggcacacgagtcccttgttgattctgctgctgctgcggctgtgggacgcgcaccacgaattgaggtcgaggcgcggagcgaggttgttgctgctgctgctgcgaagaggatccccctgggtagggattggtgtagcgaacccgctggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcccgccaagaacttctcttgcttctcctcatcttcccgcacatcctccggagcgtaacgggccaggttgttgaactcgtgcaaatactccatcacggagcggttgccttgcttcaactcccggaactccctcttcttgagggccacgactccggcgggcacatgggttctccggaaagcggcggtgaagcgagcccaggtgataggttgcccctctggctgcgtagcctggaagtggtcccaccatagagatgcgggcccctgcagctggtgggcggcgaagatgactttctcctcatcgctgcactgcaccgtgtctagctttttccccacggcatgcaaccaatccaacgcatccacggggttgttggagctcgagaaggtaggtgggcggatgcggaggaattcggcgagtttagagtgttgtggaggtggtggtggagcattctgttgtggcggattttggaggtggtggaggaaagcagtcatcatgttggcctgctgagcgaggatttgggtgagaatggcattggtatctggtggtggtggtggaggcgaagcagaaggtgaaggtgggttgccctggtggttggggttgctgccttcaggttgattgccatcaccggtgttaacatttctcctggtcgtcaccatctgaaaaccccacacagaaccagcaaacagagagagctaacaattaaaactaaccacccacgactactataattcttgaatttattactgatattaaatgagttcattaaagttcaagttgcttaggcaaataaaataaagacaggctccgacacagttataccacaaccggcataaccatgccccacacgactccaacaagaagacaaacgagaaagaacacacacgcaagcctactaactgctcgtctaccgctgcgacgggccagggcggaaggtgagcaacagcgcatcctccgtgctaccaacgccggaggtttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcttgggacggcagtcctctccctgagcgatcttgagctgatgcagctgcgcctccaccgcatctaggtccttcttgagctgcaggttctcctgacgcagctccaggatcttcatgttgttctcgaccatcccgcggcgcaccatctgatggaaatcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagtgctggtgaagagtgccgatggcgaggagagcggcgttctgacaagcggcggggaaggaatctccacccgcggtgactgccagcgaggtccgctcgggagagccggagaggatcactgcagtgacctcccaaccagcgtggggctctgcatcctcaccctcctgctccgggagtggcctggcctggtaatccactccatgtggataccccaagaccacgcacatgcctcgcagctccaagacgaagccagtcatgtccaaaccacgacgggtgacgctgccggccatctacaaacaaaacaaaaagaaaaacaacattttagagatcagattttgggcgataaatgaagcagcaagacagagagagactagaggattttcacaaatacaagagatttttatttcgaaaatactgctaaggcttgggatctaaggctcgtcctagggtcaagggggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccggcacacaaagacaaacgagaaacagcggaagactagggtgacaaccacaggcgcttgacggcaggcacgagctagacaccaaagccttcatcttcaaggaactcctcttctggggttgggaaaaattgagcaagactaagtacaaccaccgtactcaacaagacacacccgcaagtgcagaataaatgcaagggagtacaagggaatcatactgtagagggttagggttgcagtaaacagcatttaaagacatttagttgctcaaagctattttgtaaacgcgattctagaactatacaatgttattaatcaaggccgtgaacccacacgaacctgccttaatccaaggcctatgatgatttcgaccgaactggcaacccgaccctgggtcccagctcgtcccaagccaacccaggccaaccattccacattttagttgataagcaggttttaagaattgaaacactaacttgggtacattgctcggcttgcccataaccgagggcgcgtctattcgaatagattatactctgatcagaggtgtacatctttacccacaagacacatcttcctcacgtgcacccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccagaccattccagagtatccaggtgatatgaatatttcccaaagtctaaagttgtaaaaccacctaatgttacctaattaacttgcgaagcatctacctaaaattaaactagtggtgccatgagtagggtgtccactagttgaggttttgtttaatctagggtggacaaggtaataataacaataacaataataatatggtcataacaaaggtaaataggcatggctaaataaaacagtggtaacgcgggaatttaaataaagcgataatgcattaagttaaaattaaaataatgttataaactgggattcaatatgctcaaggatgatgtgacttgccttgctcgctttcccaaacgtcggcttcaacttccacgaagagcggatcctccgaagctgcagcgtctacacgaccaacggaaaagaaaaggcttttactctaaataactccatataacagcaaaaataaagcacaaaagtgggttctcgacttcttaaggaaaaattagagacttgaatggtccaattccgagttcaaatggccaagttatggccatttgaagtttatatgctctttaaatggatatttgcgaatttcttcatttaaattttaattaaaaatccatttattgcgtcagccgggagaggaggcgcgcggaccgggtccacgggagtggggcccacgcgtcagccccat

SEQ ID NO: 74609 - DNA, 1816 bp, Oryza sativa
ttaggaaatatacaaaaattctccaagccttatttgacttttaaatttgcacattttaattgttggaggctttcacatgaattttaattattctcggcataattttgaggatgtattttagagtcgttttgggacgcgacaatggccgaccacagtgcaagttataagagaggttgacgctagtggtaggcccacggcgcccaggactgtcattggaagatggtctaactgctgcgggctagcggcacgtgagaacttcgggatcctccataaaaatatcgggaaggtcacagaagccgagaaagaacgagcttggatggcaatggagaaatggttcacatttccagccaaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtgtgggaggaattctgctctctcaagaccacccaagagtttagggaatcaagcgaggcacatcgcgtactgcaacagcggaatgagcacccgcatcggctgggcaccgcagggtacatcggcaaggaggcaatatgggcccaagaagatgcagccgctgcagcagtgaatgtccctgccccgttttcagacatccctgaacaaagagctcgcaactgggcgcgggcaaggggtaaggtcaacccggacggctctgtcacatttgagaacaaaagtgatgccgtcgtctatcaggaactagtgagttcactacttaacctaactaatttccgttcgtataaagtacaagttcgtataaacgactatcttcttttctagttgggcttggttgctgaacaagcttcacaaagcgaggttgagtccgtgccgaaaaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaatacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcattctttcacctaatgcagggcgcagcacagtgtgtcctactagcgagagtccacccaactttcgctcctgaagtcgctgagggcatggctttcaagccctcggttatagacaaggtccacggcgcagacctgctagctaggtatgccaaggtgtccatcgatacagtaaaggacacctggtcaggctatccgctgcccgtgcccccaaatgatgaaatcatgactttgggcgatgcgtgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctca

SEQ ID NO: 74610 - DNA, 5873 bp, Oryza sativa
acatttattctatatgcttcgttgatatgttagatctgccctctatgctaagatcttgttgcatttacatatattaggcctttgtttagtatattctacttgctttaatatcttagtatagagtggtatcggagtattagccggtacatgctagatctatctgatcggctatgctatgaacatatatagtcccattattaatatatatttcgatctaagtgatttatactgtctcggcatgacgaccgatctatcccaatcacttaatttaagtatatattgatatgaggagtatatattgttaatatctacaactgatcgagtagatttagttccttcctaattatttatgactgccgatcgatacatatatgacatcggctccaagataaatgatatgtcatcggcacttagccgatcggctatcgtttataggtttaaccgcggtttctttgtcttttttccttgttgattgcaggatcaaatcaactggcacgctagcatacccgaaggcgagttttggacctgcactggagttaagcagatctcccaggcctcgtgtttttcatcaacaggcacgacgacgggttggcgtggtcggcaagttgacggcggcggcggcgtggagataacggcggccggtttcttagcggccacggaaggcgttggcggcggtgtgcgcgggtgcaacacgcgcacctggatgaggaaggcggctcggctatgggccgatttgggccggcttgggctgaggggagaagaaaaaggatttcggcccaaagtgaacagaaactgtttctgaattttgaagggggtttgggaaatggaattggattggatttatatttgaaaagaattttaataggaaagtttggaaggaaattatatttggatataatttccaaaagtgatattttctaatttgagtgcaatatttttggaagtggaatatagtggaatttatatagatgcactccaatgggggagagagagatataattgggaatgtgtgaggaaaatggagggaatggaataaataaaattttagcccaaaatatgtggtaggaaatctagaattgattatgggctaaatgaggttttggatttgggatggaaggatgaaatatatcttcttagcaaacgagcaatatttgcaatatttgtaatagtattattcttgtgccgaggaggaaatcaagccaagggaattaaattggcggctagattgaaaggaggaatttggatacttgagatttggaaagggaactaaggataggtttggaatcaaaggatgggtcgacaattaattccaattaaaattgaaattacaaagaattggtttggagggttttctttgaccataattcatacaaatgaaaagggttttcaactaaatttgaataaaaggaattttgtcgaaagaaggttttaatttaaaacccaaaatcaagaaacaccttaatttaactaaatatatttttaaatgaaaaacacaaaagaagttaaataccaaagagggattttatgcaagttagttttaggaggtctcactaattatattttcctaggtgtaggaagttattaaaaacataagaagcggcatgatgcaggattagaaaattgtaaattttcaggatgttacaaaaggataccgaactcagggaacgtatgtaatctacctaaggctaagacgatccaaggacaacaactatgtaggctggctaggctagagatgactttctatgtattttaattatctaatttcctatctgttgcttcaggcaccgacccgtgctaatctgccagcgtggttccggctatagctctatgatgtatccgaacgtggaggattactaggacaggattcagggctgtcaccacctgccatctacctctaacaaatccatgggatacacaacaaacaaaggtaatctctaacctagacatcacgcctaagttattaattactactctaatacttgcgcatgaactttcttttttatccagagtcctagtactagagcacttagtatgaatactaaataatgaacccgcaaagatggaaatctatcttacttagacaaagtaattaaataacataagaaaggaacacgaatgtttactttctagaagaagtttctcccaacccggagcagagtgtaccgacagctccggtactcctccagaattcctcctatgaagctccactcgtcgaggtagaagtcggatgagcgctaaacttccgggcactcctccagagcttcccctcactctctacctaattttaatgtacaaaagatacaacagagcctcttgtaattcagctcaaagttgtgtgctggaaatgagagtgagctcctccttttataggcaggtatgacgattatagcctatgcaaaatgtccaaaatggcccggaaccgccattaggaattaatcatgaccgtccacatgaaaaatggtgatcaacggcctcatgaatggttcggccgaactggtggttcagccgaaccctggacggctccgttcagcccatttttcctcgcggacactaattttgaggcccttagcccattggcatggtggtttgggccatttggaggtgtttaattgggttttttgggtccaaaactctataagtttggatatgcgtttgattatcctccttcttcatgtatatttcctctcaactttgttagtttgtcacctacatccaaatatatagcaacattagtggaaatgattagtaataaaccataccactaagttgaataccatattttattccgtatatgcaggtattggcggtcagatattatgatttaaggaccatcaacagtaatagaaagatgcatggttatcattttatgaggtttattattcaaatacctttacaaacttaggaatccggttaaaatgggcatttgagttgatgttgtgattgttgaaagttatgaatgttggaatttatgatgaagtttgttggtatggaagttttggatgttgagataattttttgtggtttaaccggattataattacccccttataccatggaaatgacatagtttgtacccatccacacgaccaagtaattggacttagcctagtatattgtctcactatatgaaagactgttgggtggctcgttaggagcaggttttggggtgaacttgcgtaaggagtttgggcggcaatgtttcacaatagtgggtctcatgaaaagtgtgatgatatagataccttgcctaggcctggcaagagttcgaccactatgatgagccaagaccccactgtgcagtaactagtagtaagtgggactctcgaacgctatggtgttttcagcattacaaactgttctcatcgtgtgggtaaagctgggcagacactacagagtcgtactgtattcaaatacaccgtgctcccggttaaggagatatgtcatcaaggtgatttctactcctgaagtataagtagttttaaaattaaaatgttgaggataaagatgatttatggtttttatttctcctttactttatcattgttgtatttaatcatatctcttcacctttaattatttataatatgtcttgctaagtacataagtactcacccttgcataatttaacatatagatattgtgctaacaagaagactagaagatagcgaggtctatgacaatgacgagtttttcttctaggctagtctacactcgagcttttgcctgtggaattcatagttgtagttcaggagttcaagagtttaatagattaggagtttagtagtttagtagtttggatttttcttgtattttcaaataaggatgtattagtttggatcttttcaacctttaacaattgtataaatagcttctatgaacaaatctgtgtaaactaatcaaaagctgctctgtatatcaatctgtgcgtgatcaaaattctggatgatcaccagtggatatttggggcaccaggctaaattgggtgtccccacacgtggaccccacatgtcaggatgccacatcatcaccctctctctctttcccctcctctcccttcctcctctctctctctctctctcacttttctcctacaagtcggtcgacagatggggacagcggcggtgaactcggtagggcgtggtgtggcgttcaccatacctcacgccacccgcctaccccattcctcctttcaacggtccggcagcagatgtcgtcgtcgaatcgtccgcttgttgtgcgctcgcgtaggcagaggcgtggtgtcactgcgtcgggagaagacgacaccgaagtcatgctgggcgcctaggtcgctcgcgcgattgagtttgttttatgttaatttgggtatcaattgttgaccactgaaccctatctcaaaatttcccatctcttctactcttcatgtcctggcggctggcgagcagcgacggacggctcgacaactcggtcatgcgcgggaggcggcaggcagcagcaggccagccgcaagctgccaacggcgccggcaagcaagcacatagaggcgcatgcggcaggcacaggtggtgggctgggcgtagccgcgtaggcgcgtaggcgaagcagcgggctgctgcagccggtaggcagcagtagcaccacaggccgcagcggcaagagcaagcagcaagccaacaaggaagccaaggagcattgtaaattcaaagtgtattgaaaattttgaaattacatttgtgtaattgatgcgaactctcgcatcgcgagttccccgttgccgtcggagaggaggagcacctcatcacgacagcgaagaagccgagccatgcacttgaggaaggtggtgcagaatccgagggcgccactgaggacaagcgcgtggtttggcgagccacttgttggacgagcacgtggttgccgagccgaggacgagcatcggctgcggtggcggtgggggtgctgtgggggaaggtcctcctgctctggtgctctcgcgccgttgtcatcgccgccgcctcgtcgcccatcgccaactgccggactctcgcctcccccaccggctggcctgctctcgctcccgctggccggcggcgagcgctccgtcgacaccatttgcgacggcgcctggccctgcctccacctccgcggccaccactgtggtgcccggccccgcctccgcctcccgcccaacaccggtggcgacaccgcgctattgacgccattcacaaccgcccgccaccctcgccttgtcccgcgtcgcagccgccgccgccttctcctctcctgcctcgccctggcgtcctcctccccagccgccggtcggcttggccagagaagggaagagaagagtgagagagagagaggaggaagaggaggggaaagagagagagggtgatgacgtggcatgctgacatgtgggcgcatgtgggtcccacactgacttagccaccacgtcggatgaaaccggggtcaaaaccttcgaaggacctaaagtgactggttttgattagttaaggcacatttgatatctgattttgtggtttgagaacgttttttttatcttgatatcaaattgaggaaccgaagtgtactttttccgaggcatgtgactcagcccatcccgtttggttggagggtatttttaggagggattgaaagtttagagggatgaggctattaagtgttttgtttggttgagagacatgagaattttagtgggatggggatcgagaattgaggaaggaactccctccttttcaatacctgggtaggggcaggtaattgggagggaattcctcctttactttgtctaagtaaatctcagccatacgtttttattaatgaactaatctccaaccaaactccctatcaatttttgtcacctctaccaaata

SEQ ID NO: 74611 - DNA, 5876 bp, Oryza sativa
atcttagagttagagtttgttagagataagcgtcgtgtccggcaaggacatatcttgtattttgggtataaatatgacccaaacccatgtaatcaattaacaatcgttcaatacaatctcggcgcatcgccacccttttactttcgtttatttcgatgagttcttgctttcgggttgagctgcatcaaatcgatcttcaactagagataaagcttgttatggcggcttacgttctcggggttaatgcttccatctttatgacactttaaccctgtttatgtaatccgtcgagttatcatatacatgttgcaatctatgttagttgccctatataacttgttatcggctggttcttattgttaggaagcaatcggtagagttatgttttattgttaatctagattgtgtcgtgtatctaccatctcttatagattttcacatcttgcttagatctcatagttgtctttatgcttaatgctacatcggttgagttcgatctattgagtagtatttataattatgatatctggctggttttatgatcatctagagagatagtatcggggtttcagccgatcttacctgatttagtcttatgacttacatgcttaattgatatgctaaatagcttgtttttctataaaacccatcttgatttggccttttggctggatcgagatggttggcgactccatatcactgcaagacatttaggtgttgcgattgtgcttgtcgacctgtaaaaaaattgccaacacgatttttggtgactctgctgaggaagatatctattcggctttagaatagccgaatttgcaatctatctgtcagtgtttcgtcaagacgactgtgcggccgaaatcaatctgtacaaattatccactgctgttgcatattttcatcggatcaatttgtttggcggcagtactattcggtcgtcaagtgaaaatcaatataccacactaaatgttgctattgcttcatcgatttctcttctaatcaagtgtttcggccatatagccgaaatcgatctatattgttgcgtggaaacagcaacaagcggccggcagcatctttgctgtacacggtcagaaaattggaatctcaattctattcggtttgctgtgtacaaatttctaaaaaaaaaaaaagaagcaaaaaagatcaggctataccagagccgatctgttcagagtaggcaaaaccgagtctgtttccattagtgcatacattaggcaactgtgttacccaaaaaaaaaagaaagaaaaatcaaagccgatttacatcggctgtgaaaagttccaaatttttgctgctacacaaaattccttctgttacgtgtacacatcaagtataccaaggaaatttagagaccgtacattaatctattcggtcaacgattttggctatgagctatatggctaaaattaatcaagaaatttcttcatcaaccatgatgagcgggaacgagatcgataattaaggttacatcggaggatcttgatgaggagcaacgtcaagtcatggaggagcggatcaaggtgattacacaagagatgttgatgagatcatgcattaggacccgtcaaggtgtggttctcaagcctagtcctcctctcaaatttaaggtaacctccaattcacccaacccatctattgctattcaaaatgttaatgatcgttgtgtagatgcatctgctacttctagttttgcttctgtacagtatgcctataatgctatggagggatcaatgggtgtttatacaaccgattgcacaggaatcggctataagcagaacctatatgatggtgtaactggtcgtaacaccggtgtaaccgcatcctacgacggtcaggctgtgtctaccatggccggtcagactgtgtactaccatagccagtcagaccatgccctatcctggccagatcgggcctcctgtggccggtctgaccgtaccactgaccaccggtcagaccggaccatgggccgatcagacagggtgctcggctggtcagaacggactatctatagccggtcagaccggttccctggaaatttctccaggttttcataccacgactaccaatacttactttaattattactcatcacatgttagtactgttagtcatgctgctccacatatccataatgtttacaatgatcctaataggggatatcctcctgacactaggtatggccaatataatcatattgcgccgcaacaaccacctcttaggccactaaactcaccaccaaatccacataggcctgaaaatatggagaagttgattagtatcattattagggataaatttgggattaaagcaaggaatcgtgttagggtgtaccaaaagctgtatcctgattattatgacaatatctcgtatcctcgtggttatagagttcccaaatttaccaagtttagtggtgaggatagtaggaccacatgggagcatgtaggccaatttttagcgcaatgtagtgaggctagtagtacggatacatataaattgtgcttattttctttatctttgtccggtactgcttttacatggtttacttctttaccggcaaattctatttatacttgggctcaattagaacaaaaatttcatgattatttttgcactagtagaactgagcttaggttgtctgatttaacatcagttaggcacaaatacaattaatctattgctgattatattgagaggtttagagatattaaaagccgatgttatagtttgaatataactaaaaaggatttggcggacattgcatatgatgaattgcttgattctattcaagagagattgaatggccagatatttcttaatgttgatcatgtgttgcatgaagctctagctcaggaaagctgagtggatgacaatagcttaaatgctagtttagatgatagtgcagtatcatgcatagccgaaccaagcgatggtttggattgtgttaataatttgtgcaatgatgccgtaacgagtatagccgaactaagtgttggttcggattgtattgctggtttagacaatgacaccattgagagtataaccgaactaaatgacggtttggattgtatcacaagcgaaagtgaaatagcattgtcacctaataccgaatcacaaatcgatcatgtggatgttggaaaagatgatgacagtgtcttgcgggacagtagtgaaatagaatccaaagtacctatgcatacatatcaaaggccgtatcctgaacatgtagatttggtcccatacctgcaaggatttgaggtgcccaacttcacaaaattcacatgtgagaatgctatgactacaatggagcatatcggccgctttattgatcaatgtggtaaggacggtagtaatgatttgtttaagttgaagttgtttcccctttctttgtcaaactttgcatctacatggtatagtttatttgctcctaattcaatttctacatggtcacaaatgaagcatgagtttcataattatttcaaagatgcaagcttgatggagcaaagaccgattgatgattcatcggtcacttgtgaaactattccggttacacctatgcctaagaccagaattgttagtaatcctctccctattagtcctattgattctgacaacaaagaagtgttgattcggcctagtcaagccgaatccacgaaagggaaaaatgttattattagggatcctcggcccgagacaattaggatcaatgatgctaaggccaaagattgtagagttacaaaagataaatcatctagttcccaaaagactaaaaagccgaagctcacttttgagatgcttatggctaagtacgagaaaggattagcgagtcaacgatttcataatcaaattagtgattcaaaaagaccaagatcatctcgcaggaagagatttggtcaatcaccaaagcaatcgaagccatcaattataccaactccatacaaacttccggttgtgatgccatcgtatccatatccaatctcactatatggttatccttttatgtattacatgccgtggatgcatcaaccacctatgcagtattatcaagagtggaaggaatcacctaggtcagtaccaactaattcatctaattcaagacaagaccgtttctcacaaaagaatcggtccggtggatcaaaggtgaaaaaagggaagaaggtatgggtgaggaaagaagccaaagctccggaggtcgtttctatcaaggaagagtttcaagatgttgaagtacgtactggagatgcggtggaaaccatacaagcaaaggagattgaagccaacaccgtgattgtcaaaagcggaggtctgaccgaggcgtctggccggtctgaccgccaacctatggtcagtctggccgaccctactggccggtctgaccgggcctagaggccggtctgactggggggcattggagaagagtgggaaaattgagagcaacacaggagctcccacttcgattaaaaatatcaagaatcatcatttgactcttggaagacaaccacagccgaagtggataccttccggattatctcgctctcaaaagaggaggctacagtgtcttcgagccatagttcaaaaagaaaaggaggccatagatgtagagaacaaaacatgtaacaatttagagcctcgaaagacacttaagtgagtatggagacctaaagaagtaaaagttaaaagaccggtgatttcccatagtagtgataaatccaatttcatgagagaagaatcatcgatcattagagataagtctccttcacatgatgctatgggtctaagtgcggtatccatcttgccttcgaaatcacgcaatctagaaagccgattttgcttggggggtaagacattaatatgctcatgaagaaatcaagagagatgaacggcgatggatacaacatcacatctttgagccgtcgttcgttggatgctaaggcaaggtatgggtttatggtgttcatcgttatattatatgcctatgccatgttagaacattgcttgatatttagcacatgtgtgtttttctcttatcaaattgatattatgcatacatgttgcaaatacctgttctaagtagtggaattgctaagtctgcatataatttgttcaaaatatgatttaggtcttgagtctttgatatttatttaaagccaaatcacatgtgtttttatggatcaccatataatatatagatttcatatttattgcaccatgaaggttttgcttattagtaattcggcaaatgtcaatggtcaatttgatgatttgttctagagttgttttctttagggacattggccttgttaatattttgcatacatgctcaagtcgattacttccatttgtagtttattggaatctatgcatgtgtcacatatgactttggtcattcattattgatcatatttcaattgggtaagtgttttgatgccatgttgattattgtttcaaaagccacttgaattagtattcatctagacatatccgttggatgttgtaatttttcatatgtctagaaagaataaattttggtccaataatttgatacaccaagcatctgggtgtaatatgaagaaaggagtatttttgatactagaaaagtcggtgcttgattttaaatctttgggcaacattggcagaatcacagaccaagggcgatctgaccggcattgcacggccggtctgaccggctctgcatggccggtctgaccaggcagatggggcagtctgaccggcattgcatggccggtctgaccaatcctagacagaaagctggggggcacaaaacaattgatttagaggccgaatttgttgtaaattcggacatttgtgcccaagagttagaagaaagcgggtgaat

SEQ ID NO: 74612 - DNA, 13920 bp, Oryza sativa
aaggataagatggggccacatgtcaggtgtaactgtcctcgaaaccgtcataactgccacaaccatcatagggacccacttgtcagtgccctagagtagtttggaggcctgttgggccggcccaagtatggccgaaccctggtgacgctagcttcgactggccttacacatggacgctcctgatcgctccccaatgacggattgacggtttcagggcatattggacatttcgcataggctacaaccatcatacctgcctatttaaggaggagctcattcacacttcaaaacacacttaagaaagctcaacatttctatctatactttagtttagtattctagtgctaagtggagtagagtggaatagctcttgaagtcctcggagtctttaggggggaattcgagtatggcggtagtagcttttctttattcttttgtaagacttttggaattaatggaatattattctatatatatttatatattcttggtgctttagtttatgtaagtatcgactttactttatatctgtatcggtatagttgtgtagctagcctaccagagaggtgcaatggtgtgggtttaatgttccattattcggttgctctatgtcatcctaggggatatagagtagtatttaataatgtagacgtggtgtttagattattaagtatcattatctaggcatatatgctgcgggacagtagaggtgggccgctgatggtgaaagtttagtacgggtattcctccatgttagtatatattcctaagataaattcctggggagggtactcctccgtatttagtcccggttggacagccatgataagttgtcgtaaggaactcggcaacccaggatggtctctcaaaacaccaggagggcattgttagagggtattggccatacaactgtatactagcggatataaactaattgatggaacgtatactagaagcataggaattaattgcttttttatttcttcttccacatagcgtaggattgattaatgagagatatgagttctttgctttgtgccactctacccttatgattatattaacccctgtttagactctgatcatacaagtggcatatatacattattagcatagttcttttttacaatcttcccttgggattaaataaataaggctaaattgtttcaggacattgaaaatttgtgtaattggctgtgggacaccacaaaattgtgtcactgctaaaggacataaaaaatagtgtaattgtctgtaggacaccaaacacattatttaataatttccatgacaaagtggagagagaattttaaaatgacaagctctttctcccctagctaagaggaggtggcggcggcgagtagctgtgcaagcaggcagcggcccgctgctatgggcggcccgctttggggacgtcgcccacctgagcaatgctagcctggcgctgggcctgtcccttggcagcggccaaggaggaggaacgaccaacgcgccggcacaccatggtggctaccggtggccgtattgctgtcgctgcagccatcgttgcacgctcgacaaaacgagggacgcagctgcgacggcgaccgtggccctacgcatagcgtgtacacattgttgtccgtgggcgtggtgctaaagagggagtgtgtggaggagatctacggtgagcggatgttgctggagttgttgtcgtcggcgggtggtcggacgagcaagacaacaacaactacgtagggcaacatccgcaagaagctccggtattgatttgtatttgttcatccgcaaagcacggtcttcctggtacatcacatatgtcgacacgttcttgttagactctattgatttgtatttgttcatcttttgttgatcgaatacatgcgagtcactaaaccaaagctttgtttctttgagcagaagcagaaagtcccaacttaagctcaggccaagccaggagcaaacttgtcttttttaaatttctctctccgctttttcttaaaaattataaaataatgtatctagtgttctacagacaattacatcatttttatggtgtcttttggcaatggcacgatcttacggtgtccctcagccaattatacaaaatttggatatcacgtagcaaattttgcctaataaatacgataccttggaatactcccggataaaatactacaatgatatatctgtgcgcttgcggattccttctgtaactgtatatatagcaggaccatttctagcgctattgctggaaattcatatttatagtaatgtcgttaagaaatatcagcaccccacatgtaaacgggaagaagatagaaaatatgacggtgatggcatggttccaatttcgtaaaatttaagttgcacgcttagaaattgaagaattgtaatgactttttttttaataaccacatttgcaatggcatggatcgaactaatgaatatgcacataacgacagatgttgtagcactagcactgttcggaagaattagtgccagtaatttcttcaaaactacttcttccgggttgataatacttatcgttttggactagagacggtcttgaaaactaacattgaccattattttttattataatatatataaaagtgttaacagctatataattttattaaaatattttttaagactaatctatacatgtagttatcatatttgaaagataaatattttaaaaatgatttataataaaaattctaaagtttgatctcaccttgtttaaaacgacaagtattatcggtgcggatggagtattttggagaagacttcaattgtgaaaactctaccctcgtactgacaaattaatggcactactccagtgcactaggaacagtacacatgtgcgtgcatgctctgttcttatttcgagtttgtcctgcagaaaacctcgcacccgactatccaagcacagaggcccccgacacgagtacacgacacgccgtcatgcgccacgccgccgccgccgccgtgccgctggcgaccaccgtcgccatgctgtacgcccgcctcgccgcctccctgaccggccctggcccccgccgcctcgccgcgctcctcccggcgatggcactcctccccgtcctccctctcgccctcccgtactacagctaccgcggcttctccgccttcgtcttcgtctggctcggcgagttcaagctcctcctcctcgccttcggccacggcccgctccacccggcgctccgccctctcccgttcgtcttcactgccgcgctccccgtcaagctcgtcgacgccgccgcggcagcagcaggcgcgtcggcgtcgaggccaccgccagctgcacctgcagctacgttcaagttcgtcgtctcgtccgccatcaaggtcggcgccatggcggccatcgtccgcgtcctccacgccaaggaggagatgcaccgctacgcggcgttctccctcaacgccgtcttcatgtactgcttcctcgacgtcgtcctgccggccctcggcgcggcgggcgtggcgctgggcatggagatggagccgcagttcgaccggccgtacctgtcggcctcgctgcgggacttctggggccggcggtggaacctcgtggcgtcggcggtgctccgcgccgccgtctacgaccccgtcagggcgcgctccggcgacccggcggccggcgtgctcgccgcgttcctcgtgtcggggctgatgcacgaggtggtgatactctacctgacctcccgggctcccacggggcgcgtcacggcgttcttcgcgctccacggcgtgtgcgtctgcgccgagcggtggtggtgcgcgcgccagcacaagcgcgaggcgaggccgcagctgcctcgcgcggtggccgcgccgctcgtactgggtttcgtcgccggcacggcgttctggctgttcttcccggcgatctacggcggcgggatggacgacctgtacctcgcggagattgcagggtttgcaaaaggcctcggccttggcggaagctggacaggggaaaactaattctaatatgtcccatcgtgtacatttttttcttcaaattcaatgcaactaattgtaaaatgggacgcggatactatatgcaagtatgcattagtagtatatacatcggtttcaaaatatagtaatttctagctatctatctgaataaattagtcagaagttgttatattttagaatagagtttcaagcaacacataccaatgagaagtccatagaattttagagggcaactaactaaagatactccctccgtcccctaatataaaggattttgatattttattttgcattgtttaaccattcgtcttattaaaaaaatttagaattattatttattttaattgtgacttactttattattcaaagtactttcagcacaacttttctttttttatatttacacaattttttaaaataagacgagtagttaaatagtgcaaacagaatgtcaaaatcccttatattaggggacggagggagtaaaatttaccgctaatgttctacccaatctactggtataataattccataataataaaaagatagctcgaagaggagttgttaacttctgtagaagaatgtctgcattatagatccaagatcacacaagacagatgtttggagttcaatgttaaccttaacagagacgaatgtgaggtgaagtacacatgtgacatgccatcattttgaagttcaacgaatcctgtgttggcctcaacttcttgaggatcaaacaagttccatccaactgtattgcagaggcggagaaaagacttgaaacagaaagattttttttttccaatgttcatatcatgatatggttaatacatcgctggcaagacgttctaatgagcttatgctatactccctccgtcctaaaatacaagggattttcgatgtgtcatatccacccaaaattccttatatttaggacggagggagtacgaccttttcttcccagctctatgctcaaatgtacatttggattggatgaatcttgagcttgtggaccgtgggtagttcttccatgaagtggctaggatgcagcagagtcagattgacttctggtgataaaatagcagtggagatgtaaaaaaagaaaagaaagcaaaacatccatcagattcagaaatctaatcttttggaacatctagattatcggatgtcaaaccaaagcaacttttctactagctcaaagaactcttcaagcggtacagaaaatgagaggaaagaatcaaggtaaacgattcacaagcaaaactgtaccacagaaaggacaattaacttaatgaagtgagcgatggccgatggacaagggcgctctgacgaatcagatcttgaggagttcgcaactgttcagacatcagcatcaatttgacgagttgatgaactgatggcactcgctggagcagcatccttggtagactattcctgggagcagagcagcccgccagctcatcctgtggcctgtaatatgcatagccgagaattgtgacaggggaaaacatttggaaaattttttaaaggaaaaatggaggaagttcacaggatttgaacccaataggaaattctatcagattagcagtagcaccatgaattccatttgatagacagtgttgcatcaactgctacaagaagacatccagatacatcctatacggatctatcataaatatctgtgaacaatcaagcattacaattcaaagaacgcagccgactcaatgagtggcacaccatgagatcagtatgatttctatcttcaaaacattgtgccacctagctctgcctctggatatgcagcgagagtttcttaactttgcagctcatctttcttagctcattgtttccgtttgcttgctatctttgtggcttctcttccgcttcctaactctctttcgctttgcctccccatcagctttgggcccctgtaggacacatgttctcatcagtcctcgtgttgcatcgacagcaaacagctcttctagacatgcttttccaacaacataatagatactaataatgggcatgttaatctgaaagtaacagttttaggtattattacgtacaactactgagagaaaaacaacagtgatataaaatgaaaattacctgattttgagcagctgacaattggggctttggtttctttttcttacaggagagtgggtttggtccctgcagaaatgacaagcaataaaaattacttacggaagcggaactgttgtagcaaactttctttccacactattatggatagttaaataatgggaaaaattggattcaattgtcaagcggtcctatcgaaaataggattgactatggagtaaggctgatgatgccaactagatcatacgtattgttgcgcttgcgtatacatctaatacatcagaagccagaagaaaataacagaaaatattaacctttggtcttttcttcttaaatttgcttttgtcggccaccccaagtgcattttctacaagagaactgataggccttctgttcttttcatcatcacttgcgttttcactggcagccgcctttccatccgatggaaccttcagtagcttctgatattctgatttacccatatgcagacgcttctcctcgtccaactgagcaaatttacgttgctgcacagagggttgttcaatgaacaaggagctcttcagaccatatatcacaggaacaccaggaacctgcatccagtcaaaacacacatgaacacataaactgattcaagagaatatgtaatggcaacatgtacattattgtgcaccctccgttccatagtgtaaggcgttttgggtttgtcctaagtcaaacttctttatgtttgatcaactttatagaaaaaagttgcagtacttccaacataaaacagatatactacaaaaaatatatattcaaatgtggatttaatgaaactaatttggtattgaagacattgctatgtattttttaaaaacttggtcaaacgtgatgaagtttggccctgtttagttcccaaaacaaaaaattttcacctatcacatcgaatgtttggacacatgcatggagtattaaatgtgggaaaaaaaaccaattacacagtttgcgtgtaaattgcgagacgaatcttttaagcctaattgcgccatgatttgacaatgtggtgctacagtaaacatttgctaatgacagattaattaggcttaataaattcgtctcgcagtttcctggcagaatctgtaatttgttttgtcattagacaatgtttaatacttcaaatgtgtgtccgtatatccgatgtgacaccccaaaacaaaaatttttgccaactaaaccgggccactgactgtccctgtcaggggcgggcgcagctatgattcaagggtattcagatgtatgcccaagaattttacacaaaaaataggtatatatactatatatttcgtatatgaattcaaacaaataaaaaagagcctcaaatacccaataagcaagcaaactagttttcttgggcttgcttcatcctccctcctcattcacccattagcccaaatgtattgggcccaaattccccacttccctccctctctccagctctcctctcccctacccacttccagcctcacccatcaatctcacacatcccattccctcagtctcccctaaccctagccgacgggcggtcggcgcaggcgcacagcctcgcggacgttgggtggccggtggctggacggcggtggcgcgggcgcgcaagtggccaaacacgcagcggcgatgctcgggcgcaagcgtaggcatggcgtggcggcaagacggcgacggcagcgcggggcaaccgaacaggctcgtggtgtcggtgccgcattggcgagctgacgacgtaggcaccaggcaggcagcatcgcagctcgcatggaccaagaggcagggacgctgggatttgggagcctgggatgttagtacttcactgatttcattttttgttctgcacttctacttttctagtattctactaattgttcactgagtacttggaagttgattcatcataattgctaacttgcagacttgatttaagtaactagttaggcgcatgtaggggaatagtaagtaggatttgtaagattacatatcattttaccattttcaaaatatcaagaattgaaaagttcatctctaaattgaaagatttcttatcattttaccattttctattcttttgtgtgtacttcatccaattagtacttacatatgtgctatatattataaaattatatcaatatacgaacttatgtgtattttgtgttatatatgctatatattatataattactggtgtgttatattatatacatcatttattaggctcttgggtgtaggaaatttttttaccctactcctatttcgaatacacaagttctaaatcctgggcccgccactgactccctgtccagatgcttttgcataacataattaaggtgataattcttaaattactctgaaacagcgtgttggcacgagcacgaaagggtagtgaatttccatacctcccgtagctttgcacggagatcagaatcctgggtggcaacaaagaagtgttcgggattcttttcacctatcagtgacagaacacaatccactgcactgactactttgtcatgctcacacctgaacccacaaacaaaaatttccaatggaacaaaaccctcattgcctcataagagaaaaaaaaaaaccatcgttagaagtagaagtgtgctactacttacttggccgtggcgagcagggcggcggcgtcgaaggcgtcggcgtgggacttgccgaggcgcctgagctcggcgaggacgcacttggaggtgaagaggggagggggcctggaggcggagaggagggactggagggcgtcgtcggcggggaggaggctgtgactgaggaggtggtggacgaaggtgccgtcgacgagcaccctgtagggctcgcggaagccgaagcaggtggcgtagaacctgaccaccttgcggttcttggaccgcctcttcaccctcatccttctcgcgtctccctcgcgggcggcggcggcggcggcggcgaagggcggcgctagtggcacgaggcagggaaggaggggagggggctcggtcgcctcgccggcgcgggaggggcggacaacgacgtcgcggttcaagataaaggtggcaggcgcagcgcgacgtcggcgtggaggtcgaagagtcgaacggcgccggcggtctgtgacggtggaggttgtgcttgaaggagttagggttgatggatttgggctttgatgggcctggattgaattggttggtttcttcgcgctggaaggggttttcccttggaaaaggtgcacttaaggcccctcattctgtggacgagctacaaaatcatccttgaacccaaaaaatactctataacatatcccttatcttataaaaccggatcactttgggtcctaaattagtactgttcccgattttaggtgacgtggtggctgagtcaatgtgaaacccacctatcatactcacaaaaaatcattgccttttctcctcactctctccctcactcaacgggtgtccttggcgccggcccagtcgatgttgcgggagattaggtgccatggcgaggaggaacacatggcgcttgtcgtagccatcgccgtccccacgcacaaccagcaacaggtgtcgccacgtcggctccgacgcaaacatgatgagcgagtggatggcgcagtaggtaatctcctgagagggccgggagtggttgccaatgaggtggccgaggagcgctggcggcgcggtgaggaagctgtaccaggctccaggcacaaatagggcgctctgttgggtagtgatgtcacagtaggtgacatagcagtcgcaatcgtgcttgttgttggggcactagacttggacgagcgggccacaaccgtcgacgagtgccctccctacccccacggaccctaacgacaacgtcaacaaggcagacaagatggtaggcgaggctcagggtggcaaggtgaagcgagaggacgggtgtgcttggcgccagccccattggtgtcatgagatacaaggcgccatcgagaggagaaggccaggggcaggcggagccacggaggcggcgaagcccgtcttcggagaagctctgtcgagctccagtgcagagtggcacccatcttgaggaggagcagcgagggcccctccttgcccccacgaacccaacaacggcatcggcaaggcgaacaagaagggagcttctccaatcaaggtcccctccagctacaccaccggcgtcaacaccaccttctacgtaagtactcgtcgtcttcgtattcatttcataagtcaatttgtattgccgtccatcactacccactcgtcacccaaggtggccagatcttccccgaccgctagatgtgagatgcctctgattgggccactgacggcgagcgcttcaagtccgactactgctaccatatgttcgtctcgtgctatagagacctcaagatcgctggctgtgaggttgacgcatcggcgagctgtcacctggtgccggcatcgctgtcgggcggcaccaggctgagtgcgcaatagaacgacaccatgagctagacacaacatatactaatggagctcgacatagcttctcagaagacgggcttcgccgcctccacccgctgttggcgttatcttctccatggcgcctcgtctcccgcaacaccgacagggccagtgccgagcatgcccgcttgtgcggactcatgctgtggatggtgggtggagcgggagagattggggactcatgaagaggatttttttttgtgagtatgacatatgggtaccatactgattcagccaccatgtcacctaaaaatggaagcaatactgtcttagaactcaaaatgatctgattttgtaaggcaaggaaggcgttatatctttcttttttttttcttttagggatgattttgtaactcggcagtaaactgaggaacctgaggtgaacttttttccttctcccttcgggcatgatactaggccgtgatgggctgggagcctgggacgtttttactgccaaagtggacctattgggccactatcctatgatagtgggatgaaaaattggactggatttaggccgtgttcttttctaacagagatgcatgctttctattaccaagcttttctaattgctgagcgatatgttccgtgcaaaaattttctatattgaagttactctaaaatattaaataaatttaatttttaagtttataataattaaaacttaattaatcatacactaataactttcttatcatgtatggccttatttaatctttatcttcattagtacgaataggtttttacaactttgtgacatgcctttactactatgttatgggttcctagcgcttgtacgtttttcatagaaaaaatagatataatattttaggggtgactataaaaacttatcaaaatttctaatgccaaatctcgataacagtaaatcaaacatcaactacacctgcgggtaggtcttaaatatcagcaatagctattatagacacggtactacagagaacgacattattctcccgctattaaggatttggggtttagatttcattgattggtttgtttacttgaaacaaggtgcatgaaaaatcatgctattacattctacaatgatatggctcctcaacacatgtaagcataaagttgatccaaccatttagaaaacatcctcttacatacaagcgttatcataactctaacgtcctcttacatacaagcgttatcataactcttccataaatagttagtcccatcacatctaacaaataaaaccattttttaagtacataacaaaatatcaccagcaagtaactttagaactggatttttcacattttggtccttttgaaaaacttatttcgcaaatagacctctgaaaaaacttattccagaaatggtcctttttgggacgccagagtggttggcgccgtccctcttttgaaaaacttatttcacaaatagacctctgaaaaaacttattctagaaatggtcctttttgggacgccagagtggttggcgccgtcccccttttgaaaaacttatttcacaaatagacctctgaaaaaacttattccacaaatggtcctttttgggacgccagagtggctggcgccgtcctcctgccaccgtggcactcgcgaaccgacgtggcaggaagagggcgccagccatgctggcgccgccccccccccaacccctcgcctccatccctgtttctctgtatgtagttgcaacagtgtcatttttgttttattttttcggatattttttcacacttaggatcatgatacaaccaaccataaaaaaaatataaactcgaactaccacttagctaagtctgaaaatagctagcataccacttagtctactttgcaccttcactaaaattagactataactcctttagtaaaaccctttgcataactcctttagtaatatcctttgatcagcatgttacacataatgcactctatcactatatgaaattacttaatctaattcaaaatatagccaaatgaaatgatagccataagttaaacagtacaaaaagatacaattttttttatttttatttcatttatttgatattttttcacacttaggagaacataggaaccaaccatataaaaaataaactcaaatggacaaaatatgtgacttgtagaattttccaaaactctaccggaacagacaaaatatgtcatttattaaaataggcgtaactttctcatatggactcggaatcaggcaaataatatattcacggacatctacagaaaaagttacatccgattctccatggcttcgccgggtttggcgatattaaaacctctgaattccgcttgcaagattgtgtttttgaggagagaagtttttcggtaaagctttcgaaaattccacaggccacatatttcgtccgtttaagtttattttttatatggttggttcttgtgagtttctaagtgtgaaaaaaatatcaaaaaaataataataaaaaaatttgcacatctctctcctctgtactagttcggagagagatgagaggagaaaaaaaattctacaagtcacatattatgtccatttgagttcattttttctatggttggttcttatgtgtccctaagcgtgaaaaaaaaataaaagaaaaataaaaaaaattcgggggggaggggcgccagccactatggcgtgctccccctagccacctcagcatcgccccgccacgtcggcagggggacggctggcgccgtctagttggacgacggcgccagccactctggcgccccaaaaaggatcatttctgggataagtttttccagggatctatttgcgaaataagttttttcaaaggaccaaaaagtgaaaaatccagaaattcagaaactattttaaaagcttgactacgatggatgatcccaagagcttgtagcacgccataatttcataagcaaaggataatgatcacgaatgaatatacgtataattgacaactaaaaattcccggcccatgtatatcttttgaaaacttccactaaatcaatctacaccattacctctttttagagaaacatcccagacgcgagaaaaacactgctcacagaaatagtgagcattatcctataattacgtcgctgcccacactcccagaaattccaaatgcccccattttcttcggttccatcgcttcgcctcctcctctttttctttttcttttttttttctctcgcccatccatcgtctcctttttcctcgctttctcccccgccacgaaaggaaccaaccctcctccgcagcccaacaaagcgcccgcggcggtcgctcgcg

SEQ ID NO: 74613 - DNA, 4416 bp, Oryza sativa
ctacccaagtatgaaaagagggagttccttcgtcaattccccatccccatccaccaaaattcccatgtctcccaaccaaacaaaacacttagagcatgcccaacagccacccaatatttgattcccaaaaaatatgaattaggaattccaaagtaaaaattgggcccaataatcaccctctcctccaagagaggcccaaaaattaattccctattatttgttagttttccacataagcaaggtgggcctagttcggtaccgatcgatcgtctccctccccgcaattgcgccgagtcttctccctccccgcaccagcgccgtgagtcttctccctcagcgtaccaacgccgccatctgagtcatcaccagccaaccactgactgctgcggtttctacaaaaacggaatactgaggatatgccgtagctattcgtgtaatcaaggaggtaatccctagcaaatcttattgatctcttgtgccctagtcaatctctatgtgtttattttgatatgtgaagatttactgtatggaaaatattaagtttgatctgataattaattttgtagattgattattgttctattcctgccatcggttcccctacatcgcacttcatccctacggtaataaacactccaaccccgtgccaaaaaaaggagatgagtcgtcgaagcaccctcctccaaatgctattggatgaggagtctttatcggatggcgaagaagaatttattttttcggcagttgatatagtgcactgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaatattctcggatttttcggagcacaattcctaattttaatcatacaaagagcatttcagtaattaaccacatattaaattaatcattaaatggtctaattataattttgttaagtactttgagtgtccaagtattttcaggatttttcttgaaattatttgagcattggaagtatttttaacaattcaaagatcatttaagtgattattttaattgggaaagtaataaaattctcctcccttgtcttaggctgaatcggcccattcctttccttcctctctcttccgccggcccaacctgagccgcctcctctcctctcagcccagccggaaaagtctactttctctccctgcgctactgttcatcttccagctcaggcagagcccgagccagccgtgccgtgcacaatgccgcctttttccaaatctcgcctccccgttgctcctttttccaatttagttgaggggaaatattcctcttatcctcctctatctttaccccaaaaatcggagctaatcgttgagtatcttatccgaatcgaactcgttttcgagtttatctccgaaaccgagtttttgatttcccggatcgatttcttgcgggaggagtccgatctcttcaatccaaggctataaataggaccccctagtccacctctttcgtttgcccctctcccgtggtctcccgtgccccgtagcctctccgccgccgccgccgccaagttcgccgccgccgccggccgaacttcggccgtgtcgcgccgtcgcctccgccgttgccgtcggtcgccgtcaccgccgaaaggtgcgccgaggtgtgggcaagctcggccgctccctccccgctgtcgccggtcaccggagccccgtcgccgccgtcgaccgaagccgcgccgccgctagacctcgtcgcctgccgtcgtcgttcgtcgtttgattcgagagtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgttaaaaatatccatatgtactgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacaaatcctatacacaatcctttgagcatgttgatcttatatttaaattctctatttatttcaactgtgcatttatttttgaatgtcactgggtggtgtgaatctattcttttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacagctttaccttttgtatagcatggttcattgcagagcaccagactaagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttaaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttagagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattgtgccatcctttggtatccttgtgcatttgcatatttgctgtgtggcttgttgagtatgtcatatgctcattcttgcaataatcaatcaacctcagttgaagacaagttgcgaaggagaagacgtttggcttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacatgcacggtgagttcgatgacgatgaagttccaaagcgtggtggatctgtcttaggtcatgcagtaattaatcgggaaagattggctggtcaagattgtataatgattatttttccgaagaacctacgtacctcgatgttcagtttagacgcaggtttgtagcagtgctttttgttttgtcaatctttgtttgcaaaattgatacatatgagaattattattattaattactatgcaggtttagaatgaggcgacctctctttttacgcataatgaatgctattgaagcacatgatgaatattttgtgcagaagagaaatgcggctggtatccttggactgtcatgtttgcaaaaggtaacatcagcggctggtatccttggactgtcatgtttgcaaaaggtaacagcagtgtcacatatgttatgttatggaatagcagcagatgcagttgatgagtatgttcatattggaggtagtaccgttattgagagttttaaaaggtttgtggtggctgttgatgaagtttttggagaggagtatatgagaacaccaaacgaaaacgacatagctagattacttgctcagggggaagaaagaaggttcccaggaatgttgggttctttagattgtatgcattggcagtggaagaactgcccgactgcatggcaaggccaatataaagggaaagagggggttcctactatagttttggaagccgttgcctcacgtga

SEQ ID NO: 74614 - DNA, 2996 bp, Oryza sativa
acgtagaaatattcatggtatatttatggtcgcagatatgatccgcaagcgcgcggatataccattgtagcatttcacccaggagtattccaaggtatcgtattattttaatcccaagggaagatatgataagagagtactatgctaatagtttatatattacttgtatacatgaaagtctatgtaggggttaagtgattcaaaggataggtgacacacaaaagaaagaacaaagatactctcactaatataaatactaagctaagtggagaaagaataagaaaagaattcattgctatacctctagtatacatacacacatttagtctacacttgctaatatacagtcatgcaaccaataccccctaacagtgtcatcctggtgtttcaagagaccacccctggttgcctagttccttacgacaacctgtcatggccatccaacctgggcaaaatacggaggagtaccctccccaagaaattgcacttaggattatatatacgcgcggaggaatacccgtactgagctgtcatcatcagttgcctacctcgacgtatccgcagcatataaccccaattaatgatacttaagaatctagacaccatgtctacattattaaatactactctacatccatgcatccgacatagagcaaccgaatactcggacactaaacccacaccattacacctctctggtaagctagttacacaactatatcgatacaagtataaagtaaagtcggtactaagaaaatataaatggaataacataccgaagatgtataaagaagaatattctattaatttaataagtcataccaaagaagagagaaaagctactagagccatacccgaattctcctgaagactcgaggactaagattgctattctaattcctactccactagcactagtgtacaactaaacttgagagagggagagagctctttttctttagtatgtgtgggaatgaatgagaggaggggtatttataggctatgaggtgccctgggagagtggagatgctcaaggtatccaacgagcatctttgctctcctcatgacaagtggcatgctcaagcatccaaagagcatctttcaccctcctcttcacaagtgtccacttccatgacggtttctaccggtagaattgctcccaaccgtcataagatacccgtagataattgccggtgaaaaataggctagattgggccagctaggggttcggccgaacccctggttggctcccctggcccacagccttcttcaggatgctgacatgtgggccccactttatggtacaccatgttttggctcagaatgattgctcattttatatgttgtagctcaaaaccaagtgggtccattagtgcaaaatatattcacattcttcatgttcattctctcccaactttgatggttgatcacctctcgatggcttccgattgattgttcgttttttttttccgtcgattctcctccatttatgcgtgcttctcctgcatacatgttagtagcatagcacatagtggaagtagatattttatttggaaattatgcattgcaagcataactagtcttcattaattgggtaatattgacgatcgaaactggtcgataacgaccgtcagcaagcttgttccactctagatcggtcatcaaccatcttgtagtcatagaactgttccatgacatacaactcgctggcagcatcggagagtcaaaagttagcctcaagagcatcccacatgtcgttccctgaatgcatgtgtatgtacacgtccactatgttgtcagctagtatactgatcaattttccacggaacaggcaacccacagcctcgaacttagcctccttctcaggagagaaaggtggtttgctcggtttgccctatgaaacaaagaagcaccgcatagccgtcaaccacagtagtgcacgtgctttccatcttttatagtttgaaccatactcggagaacactccagtgctggatgaggctttttcggtgttgttgtctccgttggtgtggtcgttctcacttctaatcccgctgccggtacgtcctctgttgacgcgtcctcaagtcaacatggtgtagtggaagcagatgtagcagtgcagaaccgttgtcgatgcagaggaagcagatgtgtcgcagagcagtcgcaccggaagacgctctcaaaaacttaatcacctgcatacccgtgtaggtacacaagcggatggagtttcggaggcatgcttgtcccaaatatattttttaattctaatgctacaaaagcactccatcaatactaggtggaacgaagaccaggtcaccgtgatataattgccacgtcagtgaaaccgtcctccaaaaccatcgagtgaatcaaattgcatcggctttaaaagttatggtgttaagatatatgattgtcacgaccggaaataacctaacgggcgttccttacgtgcgtgcattattccttgtcccaggaggcaaggtacaccaaaagttgatacagttcagagtttaacaagcggaagcgtaaatagctaatttattacatggacggcgaaggcccagcacacacaaagacaaacgggaaacagcggaagactagggcgacgaccacaggcgcttgacggcaggcacgagctagacaccaaagccttcatcttccaggaactcctcttctgagtttgggaaaaattgagcaagactgagtacaaccaccgtactcaacaagacacacccacaagtgcagaataaatgcaagggagtacaagggagttataatataaagggttagggtttgcagtaaacagcattaaaagtcacttagttgctcaaagctattttgtaaacacggtcctagagctatacaatattattaatcaaggccatgaacccacacgaacctgccttaacccaggcctacgatgattcagaccgaactggcaacccgaccctgggccagctcgtcccagccaaccaggccaacca

SEQ ID NO: 74615 - DNA, 4766 bp, Oryza sativa
gcgaagtccgctcgggagagccagagaggatcactgcagtgacctcccaaccagcgtggggctctgcatcgtcaccctcctgctccggaagcggcctggcctggtagtccactccatgtggataccctaggaccacgcacatgccccgcagctccaagacgaagccagtcatgtccaaaccacgacgggtgacgctgccggccatctacaaacaaaaaaacagaaagaaaaaccacattttaaaggtcagattttggcgataaatgaagcagcaagacagagagagactagacagttttcacaaataacaaaggatttttatttttgaaaatattgctaaggcttgggatctacggctcgtcctagggtcaagggggctctgataccaacttgtcacgaccggaaataacccaacgggcgttccttacgtgcgtgcattaatccttgtcccaggaggcaaggtgcaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccatactcaacaagacacacccacaagtgcagaataaatgcaagggagtacaaaggagttatactataaagggttagggttgcagtaaacagcatttaaagacattagttgctcagggctattttgcaaacacgattctagtactatgcaatattattcatcaaggccatgaacccacacgaacctgccttaacccaaggcctacgatgattcagaccgaactggcaacccgaacctgggtcccagcttgtcccaagccaacccaggccaaccattacacattttagttgttaggcaggttttaagaattaaaacactaacttgggtacattgctcagcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaaccccgggacaggtaggcaggactgagcccctagcagcaggacaccggccctgtgccatgacatctcgactaccgggctgcagctcgtgtagccttcatttgtcctagagatgtccatcgacccccgacttcgtccatctccatccgtgtacttttgtttatgaccagactgagccacaaactaagccttacccactagacatgtggaagtacggtagtgctttgcaacagaggcccgaagaccggtccttatatggccgaggtgctactatcaaaaccatgcaccccgagtccagcctaaaaccatttttaggattttgaatagagggggaggtgtgaatccaattccacaataatccaacaattccatagtgtccaggtgatgagaatatccccaaggtctagagttgtaaaaccacctaatgttgcctaattaaccagcgaagtatctacctaaaatcatactagtggtaccatgagtagagtgtccactagttggggttttgtttaatctagggtgaacaaggtaataatatcaataacaataataataaggtcataacaaaggtaaataggcatggctaaataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagctgatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaatttaaaatggatttattgcgtcagccgaggggaggggcgcgcggaccgggtccacgggagtggggcccacgcggcagcctcacggtccacggtggaccgggcgcacccgggctcgcaccggccggcgccgtgagtcccacgcgtcagccgcacctaagggcgcgggcggctgacagccgggccccacacggcagccgcggggcgcgcccgaaggcggccacgccggacagccgacgggaggcggcgcgcccacgcccctatggtcgccggcggcggccataggtacggcggagcggcggccgagagaggggagggaagggggaaacgaatcggcggtccacggctcaccccgggtcgacggcgacgacgggaacggcgaccggagcggaggaaggcggcggcgcggctcgggtggacggggtcgacggcgctccggcggtcggcgaccaaaacggagaggtggacgaggtcggcgaggatgcggcgaagccaaagcaggcggcgccgaggtgggaggtggtccggggcgacaacggcggcggaccggagctcggcggcgacggcggagagagagcgacggcgcgagctcgattccggcaaggagagagggcggcgagaggcggaaactgacggaggaggagcggggagggtttaaatagagccgggtcgagagagggtggccggggaagggaggaaaccggcgcgggaggtccggccgccatcaatggcgccggcgagatttgcgggggcaaatccgcccgtttgaacgcgagagagagaggggaaaatggggggaaagggagaggggatcacggggagtgatttccccctctttattgcacgtggaggcggtgggagcggcgggaggaaggggatgacgggtgggccccacccgtcagcgagggtggcgggcgggcccgcccgtcagtggcgcgcgcgcggggagaggccggatgggccgcggggagaggagagggagggggagggagatgggccgagccggcccaagagggagagggagggaaaggggactttttatagtttttctttttataaaaccattttaactttgtttatttcttaataattgttatttgtgctctgaaaattccactaaaatttatttacgcattttaggcttttaggaaatatacaaaaatcctccaagccttatttgacttttaactttgcacattttaattgttggaggctttcacacggattttaattattcttggcataatttagaggatgtattttagagtcgttttgggacgtgacaaacctaccccccttaaacggaatctcgaccccgagattcggaagaactgccgaagagattgggatgggctgccttcagctcgtcttcacgctcccaagtagcttcttcctcggcgtggttgctccattggaccttgcaaaaacggattacccggttcctggtcctgcgctccatggtgtccaagattctcactggtctctccacgtaggtcaagtcttcgcgaacttcaatctgctctgagtcggcctgctcgggcggcactcgaaggcatttcttgagttgcgacacatggaacacatcatgcacgttgcccaaggaggcgggcagctccaactggtaagcaacttctccgcgtacccagctcttcttggagcttcttccaaaagtgagaggtgaattggcttcccctatcagatacaattttcttaggaacgccatggagactcacgatcctagcgaagtagagctcggctagtttgttccctccataggtggtcttcacatgaataaaccgagccaccttggttagtcgatccacgactacccatatagaatcataaccgccctgggtttttggaagtccggtgatgaaatccatcccaatttcatcccatttccattctggtacttggagaggttggagaagtccggccggtcgttggtgctctgccttgacacgctggcacacatcacaaagggccactaactctgcaatttcccgcttcatactaacccaccagtatttctccttcaagtctaagtacatcttcgtactgccagggtggatggaataaggactttcgtgagcttcctgtagtatcagctgtttaagttctctgttatctggaacgcatactcgatttccgttccatagggttccgtgttcatcctctgtgaaaccagcggctttaccttgtttcatattcttgaggagtccatgcatgtccggatcattcttctgagcctcgcggatttgatcgagcaaggtaggcttggcttccaacgcagccaagaatccgcgaccaactatgcttaggttcagggcttccatctgttgactaagttcgagtggaatgccacggacgttaagagtgttgcaatggctttttcgacttagagcgtcggcgaccacgttggccttaccaggatgatagtgaattcccacatcataatccttgatgagttctaaccatctcctttgccgaagattcaggtcggactgagtgaagatgtatttcaaactcttatgatcagtatatatttcacagcgattcccaatgaga

SEQ ID NO: 74616 - DNA, 90249 bp, Oryza sativa
tgctgacgcagtctcctcctcctccgccgccgccgccgccgtcgtcaccgcggactccgccccaggctccgccgcagggtttggtcccctccgctccttggccctctcgcgcggggttttttttttttgagcgagaatgtgatttgatcagggtttgctccgtgggggtgtggatttcgcaggatggatggccttgtgacggagggcgatctgcgggagctggtgggcaacctcggggtggccgcgcgtgagccggagagggaggggtggcagcaggtggtcgccaaagggaacgatgacgtctcctacagggtgtggtgcgacaagcccatggtagctctatctcctcctgttcttgttgaatccattgatcttgttttatattgttgcgggtcactggaaatgttttattgttttatattgttgctggccaatggaaatgttctaatgatctgcttcttatcgtaaggcggattgtgaatttactctgcctacttgtgtccatgcgatttactagctgcgaaaggccacaactaatgcttactgtatgggtagttcatacttcatagtgcaagagtacaagtcgatcgagaaaattaagattgtaggtattagaataattcaaccccatccaccctgccttaatgctttaaaagtggatgcgtagttgtagggtgtcatttgatatcactgtttggagctaattttggtatcaccttctcaatatcccttggtctattcccctaatgggcttaaatttttatgggacggtgggagcatgccaactctgtgggtgagatcttagaaccacactagaattattgatattggtttatgtgtgctctaggtacttgatcatgatttttttggttaagaattgacaaaagaaactaaagctatttaggctctgtttgcaagaacatgttcccaacccaaacagtaaaaacggaacacggagcggtccattagcacgtgattaattaagtatttgttaatttttttgttcaaaaatggatcaatatgatttttgaagcaactttcgtatagaatttttttgtaaaaaacacactgtttatcagtttgaaaagcgtgcgcgtggaaaacgtaagtatggagttgggaaccagcttttgcaaacaaagccttaatactttagaattcaaaatagttgggggattaattactgatcagctgatgcagtctacgtgaagttacctagggtttaggaattttcgctgggttctgccatgattggattttgatgcctggtttcattttgtgatgctatttccatgatgtcctttgacccattacatttttgggaacatcacaattcccaagattctatttgcttgctcaagtttaacaattcagtttctttatgtaacagttatattcccctatgcaggaaggccctcctagatatcttagtgtgacaacatatgagagatgctcaacagagctattgagggacttttacatggataatgagtatagaatggagtgggataacactgtgataaagcatgagcagctacagtttgatgaaaatagtggaatagagatagggcgtacaatcaagaagtttccgctcttaacaccaagggagtacatattggcatggcgagtttgggaaggaaatgacaagtctttctactgtttggtgaaggttagtcacatctctctctccatcctttctcgtcattaaattctcaactgtttaaaagcgatattttttttgcgaggtaaaagtgtgatatactttggtgtcattgttttggcttttgtacttatgcagtaatgtaaacattgtagattattcgttcagtaatgtacttatataaggtctaagctttcggtaatgctcatggagtcagttgcagaagaaaccaatgatgccacaattgttgattgtgtcctaactacatcttcaattctaatatgaaattcaagttgaattggttttgatcctatgcttgacatttttaaatgaactaaggacctgtttaggatgtgggaatttcacctattgtgggaagtaaactgctccctgtagaattcctgcattctgcattgtaaacaaacagcctaaaacaccactgatatagccgagaatacacaaattctagggataatgcactgtacacgcccaatttgagaaaatacaaaatcagttgaaatctaattgaatatacaaccttagaatgaactcaccaatttcacacgagtatttcatatgcaattttgatgacattaaccttatccccattatcttattttctttgaccactcagtcattttttacaatttgttctgttgttgccaatttgttaacctggacaggaatgtgagcatcctgttgcaccaagacagcggaaatttgttcgagtgcaacttttgagatcaggatggtgcattaggaaaagtaagtcaactctaatattcatagaaggccttctttttgcggtccttattgagtttagaatgacctatcttgtttcagtggtatgtattgcgtcgatgtaatttctaaaaaatacgcatagaataacttcaaatgatctaattgtttggtaatgctttaccagcctctagtatctacagtatatattttatactttaatatttagattgaaatgcagttggatgaatttgttagctgataagaatgaaaggcttgtaatttttgtttctgcatccatgagttaatacactaatagttctgttgtacttgttaaccaaacagaatgggaagagttctactgaagctataagcaggctgtgtatcaactgaaaataaaacaaatattcttttaagtgtttatttttgaagaataaataccattgtcacacatttcttctccttgccatcaattttctttatgaccttgaatatgcaactgaaagttgagccattatgacatgccatttttgctagcttatctcgactctcaattttctttgttataattatgatcaaaaggcatctataaattgttattttctggggatgtatctcatatatgttcaactacttttaaatttgatgttgcttatatgctttatgttactttacagtccctggaagggatgcatgccgaattacagtgctgcatcatgaagacaacggcatgaacatagagatggcaaaactggcatttgccaagggcatttggaattacatttgtaaaatgaacagtgcactacgtcgctatcctcaacgtaacatttcatcaatatcaattctgaccatgcaaagacttaccaagaaggtaaatagtcttgacctattgaccaatctgtggttgatatttctttaggaattggtctatttatgttcctataagcatgaatctgtttttgttaaaaatcatatgtacagtgtgtgtccagtttattttatttgttttatgtatacaatcttttaggtttgaggataatgattatattttttgaatttagaatatatgttatagccagtcgagatcataaattcatacaataatttatgtgcttatgttgtatgctagcctgctgaagcctaccatgtcttgtagattgtctgtcctttacttttgttcacaaattacagctactgaaataggcaatgataatctttctggagatagaatctgttttttaaagtttgaattatgtagtatgtaccccccacaaacctgtgaacggtttactgtcctattatttcgaattatggccattttatggttcatgctctgatgacgcttgtttttgcacatcagtttcctcaggccttggagactgatgtagatgcaaatcatcatcctcaaggaaatacaagagcaaatgttgttcctacacattttgcaagaacttcatcacgccaacagccagggaagaagtcatctcgggcaacgattgcaagtggacttctgcttatcggaagcattgtttgtctatcccgaggccgatctaaccttggggcccagcttgcaatggcattcttcttgaagaaggcgttcaaacaagataaaggatcgagctcgcagaggagcataagtagaactgatgtgactgaacccaggcacttggaatagtattggttaaccttggagacgttttaccttgaccttttcttcctctttcttgagaaaaagtgggaatatcgtttgcttgataaggcatatctgtacacagcatgacggattatgtaaataataggtttgtagttgtctgtgtttgccaatgagtacttctgtggagtactacatcgtctcactgtagaaatcgggtacctgagaatattaatgtatgaaagttaattttggagcaaaagagttctgattgaagaaggtgactgcaagatatgtttggatggaatgctgcaaggattgttatagacatttccaaaactgtacccctcatctcaaggtaaaccgtagcctcaggctgggtccgctgggatgcaatttactttccgatttaccgcatgataccgaccccagcggtaggcggtttttgtatttcgaacaagttcggtccaatttattaagttgggatttatactagacaactgacggctaacaaaaaaaattcagccgactgtcagctagtcagtccctattaagtttatgaaaaaaccttttgaaaatttgatcgaaacctgctttcgcctacgttgaaaccttaaaatttggcggttttggacggccgtcggaaacatgaacaaaccaggtgccgctctcgtgctgcaggcagagtggcgggtactggtgcccattggaataattgaaaattgaaaactgaaattataaaaaaatatattttttttcaatgtcaagcataaggtagtatattaatgtattttatctgccggatctatgaggaaaaaatgaattagtcatgcaagaggtttgaatcaaatatagtattaattttgaaaccacttttcgatctgattaggaaagcaaaaccgcctgctcgctgcacttctgtacttgtatgtgtcgactttggtagcattgtttatcaatttgagtaaggatgatctgcaatgaaggggcaactatctacgaactacgggacacacacaatcaacaacttctgtgattgatcaattacactcatgtgagcttcggtggatcttcaaactcatcctcggttccactgtgtgtccattggtagctatccatgattatgtggtctagcattaattatctctcaagtctgccacctcttgcttgttgtagtatcctcgtgttctaatgtagtgcagtaacaagctatgtgtagttttaaccctgaggtcccgtgtttaatcctaacacgctcacaatttttttaattttttcttaaaagaatgtttgaagacacgtatctccctccaaacagtggcgaggccacatgggttcaccacagggggtgccggggagggcctggcacccctcatcctctgatcctcccccctcctcccccctcccttccctagataaataattaatagatgcaagagtatatatcggtagctagcaactcactaactgcgagtatggatatgtgtagctgaatgcgtatgcatagctctagctgggagcatcgatcagcaactcactaaaactcccgcaagcagctgggtgaagcttttgatgtgatgcgacaaattaacaggatggagtcttcaaattaaagaagtaattgagatgttttgtagtgcatcaaatctcagtgctagactgctagtatagaactactttctccgtttcacaatgtaagtcattctatcatttcccatattcatatttatggtaatgaatctagatagatatatatgtctagattcattaacatcaatatgaatgtgggaatgctagaatgacttacattgtgaaacggagggagtacataaattgtgtttaactctctcttgcatgattcaattatgtaattcttaggttgcattcgattcagcgattggaagtatatttctaacggcagcatatgattaattaggtattaattattagaaacttataaaatatattaagaaacttatataaaaaactttcctacaaacaatttatttaaccgtttaggtagtacctcatgaaaaaccgagaagttgtccaaaacaactcagccttactaaagaagtggatggatggagataaaccgcctagacgtccacacaagattgattgcaaggacaccattctgtaggggggtgaaaactgatcatgcatacaacacgttgttcaccaagcagccaataagctttcttttggatacattgaccttatggttggcccccctaatacctaaatcctggcttcgccgctgcctccaaatctccttttttttaaagtatcctcgtgatctgaaagagagactgtcatgtaaacgtggtagatgccgatcattcccaaagctgcctcacaatcccactcctatgcattgcacatacgacctacgggcatccagtgccacacctatcttatgtggaaatacacaccaacaaacaaatgtaagcattgggtaaatacttgatagccctacatcattatctatcaaaccgagaaaggcatgtacctcacattagagaatgtcacaatgctgttctccttcactctactaaaacttgagttcttttgactctccagcacctccacggctccacattattcttggcttataactagaggttgctgctctcctcatcacccaggtaatttacaatggagaaacattggcatgcataggaattggaactcttgcagcagagaaggtgaagccacatggttttgcctttatggcagcagagtactcctacgtttctttgtgctgtgctagcatgtgccttggtgaggatcgagatctacgactgcatgtttagcagttgcagtgcagccgatggataaaaaactgacggctcagatggtaagaaagtattgttcataaaatactgtggcaaacttacactgtagcggttactgtagcatcgatggtgcaacgggatggtagagcgaatccgagctgttgggtccatcgatccaacggttataatgtgctccgactgccaaggttgcagttgttactactacagcaccggatctcaattcgtcagtagatgttgaaatcaagtaaatatggcttccatgtgtgtttctaaaatataaaccatccgtatatatcaattaaaatatattaagttttatacctttgattcatggatatatacactttattgctactttcaactttatcaagttttgatatgactaggttttggtagggaaacaaactaaatataatgttatcattgtcaccctaacaaagattggcaattccggaagttctctcacaaaaactcaaccaaaatttgataaggtttcaaataaacacaaccgatagtataaaaatccggtaacgtcaaaacgtgtcaaaatttggcatcatcaaaatttggtaaagttgattttgactataaaatgaacaatccctatgtttctacaagatttctgagctggcgaatgaatcaaccaaagataatttatgggcaagtttttatatctatgtttagagctttaaaagtaaacgccgaaagatacaatacgatgagagaacctataaattaactttaatttaaaaccacaaatttaacttaaaattaaattcaagttctaaaatttaatttttcatgtggttgataagctaaccagaaaacaatgagagatataggcccggctcaattgtacttaatttcactgttgtgcggccaacacaaatagtgtattgtgtctgcaactgtactgaaccgccgaacaaacccatagtgttagtaggatcaatcttttaattaggcgttgtcagtatagttggagagcacaagtgatttcttcccaatgagcatgcaagaaattggagctagcaagcagggccggtcctgagtttttaaggtcccgatgcgaaactaaatgtagaggttgttaacgtatatatatgagttattgccataaacgtttaaattgcattcagaaatagaatttttatagaaaacattgtacatattaccttaaaattatatttgcttgacgttcacgtgttacctcttaaaaatttgtccaatgctcctttctaggcttttattaaaccatccactctttttcgtttttccccttttctcgctatccgatgcatactttatcgacaatatggcctaatgattgaaaaaattaacataactacagtgttttaactcgtataaagtatgctagaaaattacaaatctagatttagtatatcttaccaagtagttgattgcaagtatccgagtgcgcagcgcacgaccagtccgcaagtgcgtcgggacacacactgccattgttggttcatccaacactcgtccaattgaattagcaacaggcaacaaataacagattacaatttacacatggaatcatagttacaatttttcatatggcaatggtgttgttgctgctcactagaccagtaaagtgaatcagtgatcgtcgcagtgatttaggccgtgcttagatttaaacttttttctttaaacttttaactttttcatcacattaaatatttggacacatacatgaaacactaaatatggacgaaaaaaatcaattgcacagtttgtatgtaaattgcgagacgaatcttttgagcctaattacgctatgatttaacaatgtggtgctacagtagacatttgctaatgatagattaattaggcttaatagattcgtctcacaattttcaggtggaatctgtaatttgttttgttattagtttacgtttgatacttcaaatatgtatccgtatacttaaaaaaaattttggcacacaaactaaacacaacctcagcaaattagcaacagcaagacatcaatgaggcatgagaagaagtgtagaacacggcaacggcaagaaacctgcgcggctcggcggctgcgtctctggcgcctcgcatgggcgtcgcgcggcggaagcggaagtgcgcggaaacggccagcggacggcggccttggacgagatggctgaggtgttgcgacggtgctactgccagcggccgcgatcttgcgttcgcgacttcgcgtcaggacgtgagcggcggttcggcgtgatcgcgcgcgtcgatgccgtcgggattctcaggaactcggagcgtctccagcaactcatccaaattcgatcctgcatattcctatatggatggtcatccaaaaagattcatcttccatatctcttctcactccagcagatcatccaaattgcatcctccatatcacattcttctatattttataatatcttccaactaactttacatttgtatttgaagggatatattttgaataacttaatttaacggtgttatttatcgctataatatttcgaaatgagtaaattttaacagatatatttttaatggataatttttaactcatatatttaaaatgagtataaaagcaatgcaagtaacatatactactatatgctagtactactgctcaactatttcttctttttcctactagtactagttctctgcatcgttcttctttgttcctactagtactacttctctacatcaagctggcgagcccaggggcggcggcagtcgggcgagcgaggggcggtggaggacgaccgacgagggtgcatctggacagggaggaggcacgcggtggccgcggaggctgcgcgcagaggagtcccgacgggggcaacacgatgaaggagcagcggtgcgagcggtggggcggcgcggatggcggggcttccactccggcgatctccaaatggcagacctggtatgtccatcctctctgtttccccatggtacagtccggatggtggcgcgagtcatcggagctaggcagttggggggatgacgtgaggagagagaaacgccaaatttggcatggagagggctcggtttggaggatgtctaaaaatggcgtgtgtgatggagtgtttgctggagcatgatttttcccctccatatgctaaacaaaggatggatgaccggatagaagagctgctgggcatgctcttacctcccgcatgcatcagtttctgttgggccagaggggggtgaagcgggtggagagggacacctacgagtcgggggccagagcggccgcaccgcttgcccccctccagggccgggcctgtgcatgtttataaaacagtattgtaaaagctcatataaagtaattataaaaatctactgcatataaggtaccacaggtattagaacttccgatatatttctttcctgccacgtttacagtttctacccgaaacagggagtgacatatcacaattcatacactctgcagaggtgtgttgctgtacccataaacgccataaatcttttaatgcccacgcccgtcagtgcttgaagcatacttcatggtgtatgccggcaaggttaaggtcacaagcttttcatcaatcacatctgccaattatctctgctgcggtgattctcgcaacaattggcaaatcatcggatcctgcaacaacggcgatccacgtcatttaatcagatttcgcaacaacgacaaccctcatcgttagcccatgctcacaggattcgcgaaagtccttaagcccgcaggataaagccattaaaaaagaactaataagccagcctgtcccatttcaggtcatgtggtcgacacgatcgctaggacgcttgaatgctatataatagttattgtaaaaagtcacaccgtttattaagttaaaaacgtgcacgtcaaaaataaaataggtgaagttggaaaagtagccttttgttcagaggagggggttggaaatgttagattaatgggctaggcccaattaaatcctaataaattccattagcccacattaagtgctatgggtaataataccaccttggaaatcgggtgaagaggtctcaacttaaatacggagttagtggagagtctctgttgaccagttgagatggtgcgcggacagccaggcggggcgagacgaggcgagacagacagctgctgctgctgcgctctctcgttttgtaatggacagtaataaacacagagaattgatttcgtatcaatgaacgcgtcgttacggaattaaacaccatgaattgattccgtcggttacggaattaaatgccatgaattgattccgtattaacgagcgcgtcggtttcgaaattaaacaccgcggttgatgactccgagcgttactctcgcgctcgcatattatatactccgcagcgaccagaaggactggagaagttcttcccgatctctcttgcacttcgagttcctcctcctctgttcctgagctgcaaaatccttccccggttctgttcacctgcgcgcacaggtgtacgggatgagcaggtgcctctgaaactccgtccgcttgagaacctgcacgggtagacggacgatcaagattttgggtagcgcttcaagcgcgactgctcttgctcttcacggctactgcagctgcatcgtcaccttcaccaagatgtcgacggagattggagacaagatgatgaacgacatcaacggaggcagtgctgcctcaaaatccagcggtgggacgttctcggggtatactttcattctcccgattctattagatgtttctttgttaatactcttcgcaatggcatcattgtgttaatatgtaaatgttgatgcttattttatattaagcatactcaagttgtatacatctagcactgtcactagatctactcatattgcaaatgtcatgtttattgtcttactattttggattaaaatatgctgaattatgaccaaatttccaacaatccaaaaacttaataggtctttttcggtagttggctttgctgcatcactaaaaccacatgctttcgatggttcaaattataaaagatggaaagcacatgcacttttgtggttgacggcgatgcaatgtttctttgtttcacggggcaaaccgagtgaaccgtctatctcccctgaggaggaggctaagtttgaggctacggattgcttgttccgtggagcattgatcagtgtgctcgccgatagtattgtggacgtgtatatgcacatgccttcagggaaggacatgtgggatgctcttgaggccaagttcagggtttctgacgccggcagcgagctgtatgtcatggagcagttctatgactacaagatggtcgatgaccgttctatagtggaacagactcatgagattcagatgttggcaaaggaacttgagaacaacaactgtgagttgccggacaagtttgtggcaggtggcattattgccaaattgccaccttcttggacggactttgctacttctctaaaacacaagaggcaagagttcagtgttactgatcttattggctctttgggtgttgaggagaagtcaagggcaaagggcaaccggggcaaaaagatcgagggaggttctagtgccaatttggtgcagaagaagaaccctcacgcatcccacaacaacaacaagaaagtcaaacctgacgtcaaacccaaggctacaaccaattttaagaagaaaggcaagggaaaggtaaaaggagattgctttgtgtgtggcaagcctgggcattggtccaaggattgtcctaagcgcaagaacaagaagtctacaaacatggttattagtgagggcggaggaacatcgaggtatggtaaatttttacctatagttctctctgtctgtcactcacctgattggtgggttgatactggtgctaatattcatgtgtgtgctggcatttctctgtttcttcttatcaggtcgggagaggttcctccttgttgatgggaaatggatcgcttgcggctattcatggtgttggtatggtcgatctgaagtttacttcgggaaagatcgtgcagctgaagaacatgcagcatgtcccttcaataaagaagaatctagttagcggctctgtactgtgtagagatggttttagacttgtgtttgaatccaataaatgtgtcgtatctaaatatggaatgtttattggaaaaggttatgacagcggaggcttgttccgcttttccttggatgatatatgtaataaagttgtgaaccatgtaggcgatgatgatgatgagtccaatgtgtggcattcgcgactttgtcatgtgaattttgtgaattttggttgtatgacacgcttagccaacatgagtttaattccaaaattcagtttagtcaaacgctctaagtgccatacttgtgttcaattgaaacaacctcgcaagcctcataaggcatcgaggcgaggaatttggcaccactagaacttgttcattccgatctatgcgaaattaataacgtgttaagtaaagggggaaagaaatatttcatgacactgatagatgattgcactagattctgctatgtgtacctattgaaaacaaaggatgaagcattacattactttaagatctataacgctgaggtagaaaaccaactggaaaggaaaatcaaaaggttgaggtctgataggggtggagagtatttttccaatgagtttatttctttctgcaaagagtatggaattattcatgagaggatgcccccctattcaccccagtcaaacggggtagccgaaagaaagaaccgtactctaactgagatggtgaatgccatgttagacactgcaggactgtccaaggaatggtgggtgaggcaatattgattgtgtgtcatgtcctgaatagaattcctactaagcttaaggaagtaacaccattcgaggaagggaaaggaagaaattaaatctctcacaccagcgcacatggggctgtttggccaaggtaaatgtacctatagccaaaaagcgtaaacttggaccaaagaccgtagattgtgtgttctttggttatgctatccacggtgtgggatataggttcttaatagtaaattctggagtacctgacatgcgtgttggtacaattactgagtccagagatgctacattttttgagaatgaatttcctatgaaaaatgcaccaagcacttctagtcaagaacctattttatcccctgagcagtttgcaccgatagaacacattgatcaaatgcttgaggaaatcctgaggaggataacattgtagcaactcgaaagagtaagagacaaaggactgcaaagttttttggagatgactacattgtatatcttgtggatgatactccaagaaccattgaagaggtatattcatctcctgacgctgactattggaaggaagcggtatgcaatgagatggactcaattatgtctaatggtacttgggaagtcattgagcgtccatatgggtgcaagcctgtaagatgcaaatgggctttcaagaaaaagcttagggctgatggtacaatcgaaaagtataaagcaaggcttgtggccaagggttatacccaaaaagaaggcgaggacttttttgacacttattcaccggttgttcgcttgactacgattcgagtactactcactctggcagcctctcatggtctactcgtccatcagatggatgttaagacagctttcctcaatggagggttggaggaggagatctatatggatcaaccagatgggtatgtactagaaggtcaagagggaatggtgtgcaagctgttgaagtccttgtatggtctcaaacaagcgcctaagcaatggcatgagaagtttgacaatacacttacatctgctggctttgttgtgaatgaagctgacaaatgtgtgtactatcgctatggtgggggagagggagtgatcttgtgtttatatgtcgatgacatattgatctttgggaccagactcaatgtgattgaggaggtcaaggactttctgtccaaaagctttgaaatgaaggatttgggagtagctgatgtaattcttaacattaaactaccgagaggagatgagggtgggattatacttgtgcaatctcactatgtggacaaggtcctgagtcgctttggttatagtgactgcaaggcagctcctactccttatgatcctagtgtgctattaaggaaaaaccgaagaatagcaagggatcaatggagatactcctagattattggttcattgatgtacttagctagtgcaacaaggcctgacatctcatttgctgtgagcaagttgagccggtttgtttcaaatccgggagatgatcattggcatgctcttgaaagagtaatgcgctatctaaaagggacaatgagctatgaaatttactactctgggtacccaaaagtactagagggctatagtgattcaaactggatatctgatgctgatgagataaaggccacaagtgggtatgtgttcacacttggaggggacgctgtttcctgtaagtcttgcaagcagaccatcttaacaaggtctacaatggaagcataactcacagttttagatactgccacagttgaggccgaatggcttcgtgagctcctgatggacttgccgatggttgaaaaaccagtaccagcaatcctgatgaactgtgataatcaaacaatgattattaaagtgaacagttcgaaggacaacatgaagtcatccaggcatgttaaaagaagactgaagtctgtcagaaagcagaaaaactccggagtgatagcattggactatgtccagacggctaaaaatctggcagatcagtttaccaaggggctaccacgtaatgtgatagactgtgcatcgagggagatgggcttgagacccacttagagttgcacaataatggaaacctgtctattgtgatcagagatcccgtgaatttggatggcgaaacaaactattgtgtaactgagagaagagaccctaaaatgggcttatcttcatgatgcacttctcttctaatctgtatggtaggatggtatacaccttaatgtaatccgagtagcttttcataaagcagatatgttggcctacagaacatcttagaaggaacacacctatatgagtccgactgctagtcacagtctatgagatctggttgatctctagatactcatgaaaaggccgggagtatgacttatacgctccaaacagaggggatgcaaacggcagcctagtaccagttaagggtttgagtgaaacctgaatcgcacaagactgacaattcaaggtatagtccatttttcagttgtaatctggtgtagcttttttcctaggaggaagttcaacttaacagtctccaccgaaacactggtataacaaacaagatcagaatcgagagcatttcctgtgagccatgaaatttggtggggattgttagattaatgggctaagcccaattaaatcctaataaattccattggcccacattaagtgctatgggtaataataccaccttggaaatcgggtgaagaggtctcaacttaaatacggagttagtctctgttgaccggttgagatggtgcgcggacagccaggcgggcgaggcgaggcgaggcgaggcgaggcagacatttgctacactctctcgttttgtaacggacggtaataaatacggagaattgatttcgtatcaatgaacgcgtcggttacggaagtaaacgtcgtgaattgattccgtcggttacagaattaaacaccgtgaattgattccgtcggttatggaattaaatgccgtgaattgattccgtattaacgagcgcatcggttacgaaattaaacaccgtggttgatgactccgaacgttactctcgcactcgcatattatatactccgcagtgactagaaggacgggagaagttcttcccggcctctcttgcacttcgagttcctcctcctctgttcctgagctgcaaaatccttccccgattctgttcacctgcgtgcacaggtgtacgggacgagcaggtgcctccgaaactccatccgcttgagaacctgcacgggtaggcggacgaactgctcttgttcttcacggctactgctgctgcatcgacgccttcaccaagatgtcgacggagattggagacaagataatgaacgacatcaacggaggtagtactgcctcaaaatccagcggtgggacgttctcggggtatactttcattctcccgattctattagatgtttctttgttaatactcttcgcaatggcagtattgcgttactatgtaaatgttgatacttatttcatatcaagcatactcaagttgtatacatcttgcactgtcactagatctactcatattgcaaatgtcatgtttattgtcttaatattttggattaaaatatgccgaattatgactaaatttacaacaagaaacccctcttccccggcacgtaaaacgaagttcattttattgcatgattaattaagtattaactattttttttaaaaaaatagattaacatgatttttttaaacaacttttatatagaaagtttttatataaatcacaccgtttagtagtttgaaaagcgtacgcgcggaaaacgggggaagaacacagcaagaacacagccactcccgtgaagcctagagaaatcctggccatccaaacatacaaaaagagcgtccaagatttgacaaacggcccagccaaggcagaggacactcgccttgctcctgctccgctccgctccggcgccctgcctgcgctgcgctcgcgagacaccacacgagggcggcgccgcgattccacggcgtcctgccgcccgccgccctagcctgtttcctccccagcatccgccgccgcaggggagcatgaaaccctcacccgcttccaccaaagccccgctcccgtggatctccccgctccactaccgaagccccacacgcgccgcgccgccctccccgccgccgccgccgcctccgctgcccgaagcgcccctcacgcagctgcggtacgtccaccaccccgacctagcccgcctcatcgcctcctccccctccgcgcagcgcgcgctcgacctcttcaacgccgccgccgcgcagcgcggcttctcgcacaccccggccaccttcgccgcgctcctcgtccgcctcgcccgctctcgcctcccctccgccgccgccgccgtcctccgccgcgccgcctccgcgccctgccgcttcctcgagccgcagttcctcccgctcctccgcctcctcccgcccgaccactccctcgcgctcctccgcctcctccccgcgctcctccgccggggccgcgtctcccgcaaggccctcgccgtctgcctcgaccgcctcgtctcctcccgccgctgccccgatgttctcaccgagctcctggccgacctgcgcgacccccggagcaagtaccttccgcagcccaacacgtgcatctacaacatcctcatcaagcattacgtcaagaaaggcgatttggggacagccttccaggtgtttgatgaaatgcgtaagatgaactgcgctgatgttagaccaagcttagtcacctattcaacattgataggtgggctctgtcgtggggctcagatgaaggaagcgtttgaactatttgaggacatgatcgagaaggaccgcattgtgccagaccagctaacatacaatttgctcatcggtggattctgcaggctaggacaggtggagaaagcacaatcgatctttggatttatgaggaagaatgagtgcgagccaaatgccttcaactatgccactttgatcaatgggcactgtaagaaaggggaagtggaggcagcgaggggggtatttgaggagatgattagatctggggttcagccggatgctgtcagctatacctcacttgttggatgcctttgtcggcatgggaatgtggatgaggggatcaatcttgtgcaggagatgtggcagaaagggtgtaaggctgatgttgtcacatacaatctgctgcttgaggggttgtgcaaagatagacggatagcggaagcagtgaccttgcttgagaagttaccgtccgaaggagtacagctgaatgtcgcaagctaccggattgtgatgaattgcctgtgctcatgtggagagatggagaaagcggctggcttgctgggcatgatgctcggacgaggatttgtacctcactatgcagcatcaaacatgctgttgattggtctgtgtgatgttgggagggtatcagatgcaacagtcacattgtatggactggtggacactgggttcatgccagaggctagatgctgggcaaggctgattgagtctgtgttccgggagagaaagcttaggagatctattgagctgttggatgtgctgattgctgaagggtgaccaagtcaacttgctccagcatggattgttttgagtttttgactgatttcatcacctgaagggaggtgaaaaaccaggtattgagatgttccaataaggagtgatgacctactgaagccacataggtttgatagacatgggctgatgactgtgcaggagatgactgaagggatgagtgatttgcagcaggactgtgtgtgcaatcaatcttcactaaggttagcaagcaccaagcaatgaccagcctgacccaattcatgatggaatctgcgatcattccgaggttggggaatcttcggaaggtgccatgacacatggttactttgatgtttcatgattatgccaaaaatagtactctgtacatgattaataactgacaaaggaagctgaagtctgaacgaccattttgtggacaggtgttcattttccttatttgctggtgtgttcttatgaagggttactgactgcttgacaatggacatatctgtgtaatacactgtcattgtggaatccatagagatgtttcatggtatttgactgtatgcaagaaggaaatgtgcagagagtcaccattgtcatcttgattgtttgattatagagatccaaaaccaaagttttacacaaggccaaactgcaaagttgagaaacatggtatgagttcatgttgaaggcagagattcattcaaccttcttgattggagactttgcaatggaattatttctatgcaaatgtagagaatgtccaggagttcaggacctgctggcaacataaagaactcagtggcagctggcaatgtaatattacggttgctactcaggctaaaacaactcaataccaaattaatgcattgtccttgcatgagttcctgtttggaacagattatttaccggattattgctgtggattatctacttgaatatagtgctaccatgcatgtatgccataattatggattgttgctattttcaaatctgactaagtttttttgatgagttacagtgtagaacaatattgcactgcaaagtttcctattaacaatgctccttagctctgataatctgaaacctgaatttacttttttttctttatttacaaagttggagactggatatgaagagatatgatactttgatgctataatactttcagccttttacttaaattcttgatcaaaataatctatgcacttataacaccttactccttttctatttcataggtattcagcaaagatcatagttgttttctgaccttcaatggcaggaagcagtcctaaagcagtgcattgaggctgagcaacttgaaagtgtcaacatggctggaataaacctaatcaataaactaagagaagccctcaatgaacaggctttgagcaccttttatatgtttcttaaaaaatattctaccatggtgtggcatataatgatataagcatattattacattcataaatatttatgtttttttccttttatataacaggaaacaaagtcagagcttcttcgcaatcagttgcatgtaaggattattcttttatacattctcacttgttattgtccttgttataacttcatctttcactgcagaagcacaccttagattattctatttcttatattccatgtctattatcgcttaattactataatggaacatttaagggtcaaaattatgatgagcattttcatggatgcataagctttcgtattacagtgtctgcttgctttgagctttactccattcttgatgcctcagcctaagatgacccatgagtccatgatatgtgagcacaacctcagttttgctttgtcaagcacttccataaagtcataaacttaacttatctataagcgtatcctaataaaaaatttatggtcaaaaatcaaatatcatatattttaacgagaggaatagctcgtatcttcaccaatctgttctatagacaattccatgtgtagtactagtactgaaagacctcatgatgtcacaactggtagaaagacaatgagtgacaaagtatgcggcaaaataacggtggtacacaaggaatttgttgaagatttgtacttgtaaatttattttgtattgttgtggaaatttgttgtgcttaggctaaaacttggatactcggagaaattttctttagaactacttgactgttttataactagaattctacattgtattttacgcacatgtttggatgggtcatgggtgtgatctatataatggattgtttataaatagagatattatatttctaccactatgttacactaagttatccaaataaaaagaaaatttatccaaataaaaagaaaatatttaacgactagcatggcctcctcgtccagaagaacaaaaggtatatgatgatgcgaagacgtgtgctgatcctgtgtgccagatcaaatatcttctgcacacttaatcatatgtgacgcagtgagcaatagttgcggttgcgagaaggtggccaacgatcagttgtgaccagcggccattgtttaccagaaattttacggttcttgtacatttacataacttcttcctctataaagattactgtcattgcaatacatttacataacttcttcctctatgaagattactgccaatgcaacacaaacaagggctccagcagtctacccaccacggtctcgctccaaaatctgtggtagacgaggctactaaaacttagtcccatggtatgactgttgataggtttccacgtgcctcctatttccaacatgagtcagcttaataaatagtattagttagatatctcccgctccctttttaggtatttccattagcaaatggattgtaggatcaagcaagaaactgactctgactgctatgtggatatatagtttagtttgcatagacaggatgtataagggatgcaggtcatctgcagtactgtagcatctctgcattttctctttcaatgcagaggatcccaatccaataagaactcggtaggcatcttgtagtgagagatggatagagattaaaatgagactcggtaggcatcttgtaatgagagatggatagagattaaaatgaggcaccaacaaagctgtacacttcattaaaattagccacctttgccatccatccatgtactcggttgtctctctaactagttgatatcccgagcttctctaactaattgatatcccgagctttgctgcaagatatatggatgaatgcacgttatacattatagaaattgtagatgtatgtgtttaaataattgaaaaatattatgaagataatgatttgacatttcttgcatattatcatatttttcaataattgtacatattatcacgtaactttgcatctattttacgtcaaaaggaaaatgttgcatctgctgttatcggtgccaatgcaaagaaagaaattaatgttccttcagctttctcggcaaaaaggcaatacaactttgcaaaggagaaacttgtttaggtgcaaatattatgttatcatgtacatgtcaattctctagtccatctagaacaaaattgctagaatcttcaacaaaaacaagccaacattgagctgtccatcgagcagcaatcctgcaattccgacacgacaacaacattcctagatcttccattcccatgtttgtatgcacgctcgtggcttcgtgcatagtagtgcgagcattcatcgtgtgtacatacacgcctaccttgttgacagaaaagcttacctcctctttttgaaagagccttgtatatgaaacatataaatgcatccatgaactctttcagatatactcctatatgagtagtaagtaggagttgatattagagtaacatcgaacacctagaataatgtccttgctgcagattggtataactaaggctgtgtttagttccacactaaaattagaagttttaagaaaaaagttgaaagtttatgtgtgtaggaaaattttaatatgatgaaaaagttgaaagtttaaataaaaagttgagaactaaactcggcataagccacatgcagtagtactacttttgtaccaccatttgttttggagctagctcttgcttttgtactacattgtatcttcgccaatcttgttctacaggcaattcattgtatgccagtgaaacataagttttttacaaggtatttatgcaagggtaacaccatagaagcctattaagttattacgcctaaactatgaagcaggtatatatttacagatgtatatggatgttgtagaggcaattcattgtaagccctctcaaaaaaaaaattcattgtaagccgctcaaaagtttatcttttcggttagagtaaatttaacaaaactataaatatattgaccaaattatcacaaaactacatatttaaaatggtgtatcacaaaactagctataggtttagtgtcaatttaattacaaaacttgaacatttataactcaaccataatattagtgctaaggatttaaaccccaaaatatatagttttgtgataatttaattattaaatatataattttgtgatacttagagttaaacctgtagttttaggataaatttattgttaaatctatagttttataataatttgatcaaaatatctataattttgtgaaatttactcttttttttgcgaggagaaatttactctttctgttataggctactaaggtcactttttttagacaatataactacatggagtatatggtaacatatataagttcatttttccccatcttgaaaatcaggatctgaggtatagaacctacataactcaccagaaaatagctttttcttttagttggtaagttttcacgggagtgtacgtagttttatatttacaaaacaacaacacctcctcccccactcccaactaggggtgggcaaaaaatacccgaagaccgcaagccgaacaaaatcgagccgaaccgaatcgaagtgtcggtttttttaggcatcggtttacccttcggcatctgttttgcgtttgatcggtctacggtcttttaatttctatggtttttaattgtcacgaaccgaacaacccgagaaaaccggagaaaccgaaccacacgtacacagtatcacaacaaattaggcaacgtgcaagctttaaggcccaacatctctttaatggggcccaacatctcctaagctacccatgtctcaagccctgtttattatcatcacgttatcgtgcgaagccacggctgtggcctcatggcaacgtgttccaacggtttgttcagtgaaccgaagttactccgtttaatcggctcggttttcttttttatatagattcttcggttgcaatagaaaaccaaaatttattaaaccgttgaaaccgagctgaattaaccgagtaaaccgaacgctcacccctacccccaacccacacatacaaacgcacacacacacatcaatgttctctgaaactgatgtgaactttctaaacaatacggttcatctcctacctccagaaagtatttggcatgtcgatcagggattgcaatttcagttcaaaatttcaggcccccttgctggcaagcgattattttagtcgaaattttcggttttctcaaatttttgcaaatttggccaaaatttagttaaattcagttaaattatgctaaaattttgagaaaaaaaaaaggtccaaaaagtaccaaaatttcggatgaaatcaaaattgaaaaccctagtgtcgatccattagctcaattaccagcagctgtcactttagaagaatgcagttcacattcaactagcagcaacgcctcgagtgaaattcaaccccatatatactgagataccggccaagacacatgttagcacattagtatatagtacaactgctactgcagctatccatggttcaagtactaataggaattccagttttttcctgtttgatcgattcctgctgcgagtacgaggtggaaaagagttacaatcccacggtgtcggctcccagagcttcagtagctgatgctatactaaaacttcgtcgattggtgccacagctgatgggattccacatgcctcccatttctagtgttgctcaagttggtaaatagcgtgtgtttcggttactattagcgaccaaattaaaggctggagcaaggaactgatgaccgatatgtacatatgtgaagaggatatatatatacatacatagaaataattaagcatgcatcttcaactatagtaatggatgaggagtttcggcatgatgtactatgtaaacagaaaaactactcaaccatatcccgtggaaatggaataagtaggtaacgctttgttcttatctatttgccttctctctccgagtcttcgtcttcctcctccgcctctcctattttgccctccttttccccttcccctcctctctgttgcagagagctcctctatgaaggcatggcaatggcgaagcaggccccccgaaaacggatcccctccccctcctcctcattgctggttctaccctgagtgcatgttggttacaaggtcatattgcctcctcctccgtctcaatcttttgaggcatggacacccactggatctagctcccatggcggaagggggaaggagggaaggagggaggctgtcgagaaggatgctgaccaacgtgggtttcttggcctcatccttcaaggcgctttgctgatggtgatggagctttcattcgcggcgacgtgatggcgagccaccatgctcattgccggagtgtgtgcaagtatgttgtgcgatgtatcatccacagtcggtaccccataggtaccaagtttgatacatgtggtattaccgctgatacccaggtatcagacccagtacctgtaggtaccatgcttaatatctatggtatcatggctgatacccacaggtattaaacctgatacctggtacctgtgaggtatcaagtatcatggctggctgcgaggtatggctagctacgaggaatcaagcaccacatgccttctctccttttatcccttcccctcggctccatccttgtttcctactactgctgcaaccgatgtcactccttgcatcgccaagcgttggttcaagacgtggagggagcaataccaaggaggagcttggaggaagagggcactgtctgctgcttcggctagctgcgagtgtgctccaccgacaaggtatcgcgtgtggaggcgcgtgagaccgaggaggatccgtgtaacgccccgattttcgttcaggattaaaaatcattaaataatgcattttctagaaattaaataaaagttaaagcaatttaataaagtgaaataatgggagaattaaaatttcctttaaaaatcattggccgagaatattttgtaatattctttgtgccctaaaatactctctgaaatttcacgaattttcggagctcgagaaataatttgaatagcacaaagttcatttaaccaatctctactacttaaaaaataagaggtgcttccatcgtccgtcaaaaaaaccgggcgaaaaaaaccaagtttgtccgatccaaaaaaaaccaggcgaaaaaaagtgcgaaaaaaaaaccaaatatgtccgatccagaaaaaaggcaaaaaaaaatgggcgaaaaaaaaaccaaaatttgtccgataaaaaaaaccggcgaacaaaaacgtgcgaaaaaaagaaaagaaaaaacaaaatagcgacaaaaaaagtccgagtcggtccctaaaaaaatagcgataaaaataaaaaaaagtttgactcctcttgttgcgattcaaaaagtccgactctagatccgaatcccacttctctcagattaagtccgagatactaggcaccacttctctcggtttcaatctataccattattccatacatcttggtgaaaaaaaattgatgtgctggattgaagatctgtttgcaaaaacggaacctacatatcgagagcattccatttttatatgattttaatttttgggtttgtacatttgtatttgagtccctgtaatttttatatttgcatttgagtccctataatcttgcaataaggtgcttttggtcttttttaaaaaaaacaataaataaaagggatataacaaaggtagaaaggtgcataaaaagaaaaagaaaagccacacaaaaaagaaaataaacaaaaaaaacaacaacagaagtctatttcccctaagtggcgaaaaaaaactgtagatgcaaacgggaaaaaaaatccaattcctataaaaggcaaaaaaaaaaaactggtgaaaaaaaacgctagatccgattcctttaaaaatggaaaaaagtctgattcctgtaaaggcgaaaaaaatccgaaaaaacatctaaaaaagtttgtccgattctctaataaagtggcaaaaaaatggttcgtaaaaaaaaaaagctggttcgtataaaataaaaaatgcacgcaagaaaatatggaaagggcgaaacaaagtccaatttctaatcagtataaatctcttctctatctctaatctaatctaactatttaaaaataaaaaatgcatgagaaaataaaaacgatcaaaaagacgtgtgagaaaaaagtcagaaaaaagcgcaaaaaacacgctgaaaaggttttttttccatcttcttacaaaataaaaaaacacgtgtgaaaaattatttccattgccagcaaaaactttttaaaaaaacatacgaggaaaagactgtcagaaaaaatgcgtcatttctaaaaaaaaatggtttaaaaaaaccacgcaagaaaaaacactatctattaaaaaaaccgctctgaaaaatctgtcagaaaaaagctaaattgatggacgcttgagtcgggtaggatccatcaattttttaccatctactacacggcttttatttcgtcatatattctcatgtattggaaaaaagcaaaaaataacatttaaaaaaacaggcaaaaaaaaccacgcgagaaagtaattgtcagaaaaaattgacaaaaaaacacgcgagaaaagcaaaacaaaaaagaggagaaaaatatggtttttgtcatcactaaaaaatggaaaaaaaaacatgctaggaaaaaactattagaaagaaatgcgctatttctgaaaaatggtttgagaaaatcgtggaagaaaaaaaaaacaccgtttataaaaaaagcaagctgctcattaaaatacaaacattgtcttcacatgattatgcatgaaaaacgtatattatcattaaaattttttcacccattgcaacacacgggcatttttgctagtttaataaaaagaaaaacaatcaaatctcccctccttcaatttgggccacttccggcccaaagccctccttccctccctgcggcccgtcccctcccctcttccttccttcctccttgggccatcgacctatcttccttcccctcgcgcaaagtctaaataaccccctgggttctcctccctctctccctccccgacaggtgggcccggcgaccccacctgtcaggccctcctcctaccttcggcttcccaggccgaagccgccatggtcggcggttgccgcccacgtcccgccaaatccggcgccctcccgctcgcgccctcgcacccaaaccaagtgaaaccggttcccctccaactcctccacattttcccccacttttccccaatttttggcgccaaattgagctccacttcgcccacgtcggcatcccacgtcgccgcctcttccgcgcgtgcgtggacgcggtcgtcgcccacgtccgcgccgttttcccccactctccccgcaaaatccggccacgtcgccgcctcccacatctctctctctctcccccacgtcgccggctggtttccacccctctcgggcccgatcccgcctccccgagccctatataaagcaccctcgtgctcccctcttccgtttcccccctccaccccgagctccctgcgcttttccccgctctccccacgctgctccccatcgccacccacctcaggcgagctccggccgccgtttcctgtcgctagggccgccgccaccttcggcatcaccgagccaagccctacctcggcatccactctgtttccccattccattgtcggaattccatctccaccatgaaaccgagccgccgccccttccaccgcctccagctgcccgccaccgccactctagccgctgccgcaccgcgccgatgccgccttcgggttcgccgcatcgtgccacgccccggccgccactccacccgtccattccatcgcccgaggactgcttccaccatcgacccgagctccaccaccgcctgtgtcgcctcaagccaccactcctcaccgcctcagccatcgccacgcaaatccgccgccaccctcggcttcgccgcgctgccccgcacaccggccgccactccaaatccccaaacgatcaccggagccccggttcagccgccaacccgagccaccaccacctctaccgcctccggcggcctctcctcgctgtctccggtcgccgcgcgcggcctaatccctctctctctccttcctcgggccaagacgctccccgaccgccccctcgcttgccgggccggcgccgccatcaccgtggtcgtcgtcgtccttccccgcgccggtcatcgtcatctcggtgagcatctccctcctcctccccttcctttcttttcctctctttgccgcactggccgccgcttgcacgtcgccgccatgcctaggcaccgctcgccgccgcagcccgcgtgtgccacagcttcccgcgccggtggccgcgccgccgctcgccgtcgctcggccggctggcctgagccgcgcccgtgccccagcgcgccaccccgtggccgcccgatcggcttgggtcgatccgggccgtcggttcccgtggaccggcggtggaccgcctcggtggtcccagaccacggtggaccggcgcccttgtgtcgctgaccggtggggcccgcttgcttgcgccgcccctcccccttgatgacgtcagcgcgtcccttttcctttgagaaaataattaataattgcacaataattcgttaataattctagaaattcatttaaatggctcaaaacttctaaaattcatatctaattcattcgaactccaaattgggccattcaacttgctaaattcatctaaaattgagatctacatgtttgtttactttttatgtactgtttccctggtttttattagagtttttcctcgttgtgcatgctagcgtgtagaatccgttgttcggaagttcgcggtcgcaaggatcagagttcagaaggttgaagtgaagaagcaaggcaagtcacacattccccttgagcatattgagcctactttacaattgttttactatttgcaaataaacatgcatattttgctaattacatgggatctgggtattacctatctgcttgcttgtgctatgtttacttgatatctgtcctttgtcaaccttgggtaataaatcaactagctcatgttacttatgtgacctagctggaactatatgcttagccatgcttaattaccactagctcagttgatgggataattacagtattagaccatttcagtaacagaatgagctgcgtgctcgagacatctggccatgcttcatggtcgtaattatccaactaaaatgcgactaaatggtgggctgtaggtgcatggttttgctagtcgcacccatggcaattaaggaccggttcgcgggaaaccttggaagaatttatcgtgcttaccacaagccaacgtgggcaacggctgggcttgtagtgtagctttcctctagccgacgtacccaggcgagggtgggcgtgatagagttgggtcggccggggtgtccggttgatcggcttccggattcaccgcggcacgagagggggctgcccgttgcctgctgggaacgggggcgaaccctgaggtgtggtgcgatcggttagagggggttatgagaagggtcctgtcacggcctctttccggtatgtcgtggtggcatgtcggcgcacggaaacatatcgtggggatttgtcttgtgggtacagttgtacacctctggccagagtaaaactattcgaatagccgtgcccgcgtgcccgcagttatgggcagtcgaccagattcaccgtgattagtctcaccttaataaatcgactcaatgcactgtagttcaggtgggttggttgggcctgttcaacgtggtgcagcgttgatcagtggaaatttaatgttattttaattactcaacagttttactattttactcaataaaatattttacaaccgcctttatacaaatagccacaaaccgtccttgtgttccccttacatgtctgcatcattggtgtggcttgctgagtacggtggttgtactcagccttgctattattcccctttttcagaagtgtagtgcttctgagctagaggcaaagttagaagaccaaggctcagaccccagttgagttttgcctgtggagtggagctgaagccctgctaggatcgcctttttcgctgatgctgcttttgtttcggtgtgagaaataagtgcctcttctgtaagtattttatgctttatttacgtttggaactgtttattacttgtcgttttgtgtaccctggctagtcctggacagggatttaatacacaaaatagtctggaaatttgggctaaatttctgggcgtgacaatccggctggggaaagcaacgaggaatcgcgtggacaccaggtgacgcggttggaaatatctattaatttatcaagttgtttaattatctcgtgactttagtcttgaacggcatcccgtgcgctagctgccctcttttagaaatatgtattacgtaaataataggtttgaaatagtcttggtttgcctcttaatgctgaaggaatctggtgtactatattggcttgtgtacaaatctggtacatgacaacactaatgtggaaaagatgataagtttggagcaagagtagcactttggttgaaggtgcgctgtgaggccggtacgtttggaaacttggaattattttaaaggtcaatataaagtaaagtgacaacactaagggaatgcacggcatcacgccgcgcgcagccatgcacacaaacatcacttaagcaaaaattttattaaacacaaattagctatcattgataagcgttctccatttaacataatatcaaaacgtagtactccctccgtcaaaaaaaaaaaaagctaacctagaaggggatgtgacccctctacagtaaatctggacatagcaaagtatacacaatatatatcaacctcccatgttatctaaccacacacattttgctagctgtaaaggaggatgaacacctgcaaaaaggaaataaatttcctagaaacttgaggaaaagagaataccaaacccccatcagacaactgataatagaagcaatggtacgtagcaagataaaaagcaaggttttaacatcattgcctaaatgtacccaaacatatttatttgaacttgtgtttaagcctttatgctgtaattgttttggacgccctaaaatatccagtgaacaccaggtacctcggcaactcaagcaatagtgaatcagctctgtgcacactccaaatgatgtaaaagctccttcaccaatctcatgcatccgaaatcatttcaaaaattcgaaaagtctgcacgtagaatataatcatttgtgaataataagggaaagataacaataacactaaattgttgggagcatcggagctaatatcatgcatgctagactaaaatcatggtaaagaaataagaacagcggaacaaagcagcagaatggtctctcttaatttggattaccctttcctaataaagtaaagagaaacattttcaagattcactaggcttgaataaactaaatcaactaacatacctgagtaaaccagaaacaatttattaactccatatgaccaatctatatgttgtagcagggggctaacacctcttcctcccattcggtcaaaacactggagtaaaagaggtgttgagaattctaagtgtccgaaagggaaattaccctttcgaatggtaaaacaccttttcaagtggaagaataccttttcaagtaggaaaacacctactcgagtggtgaattaccttttcaatggtaaaatacttttcaaatggttttatgttgctcagttaacttgagcgaactataatctatgtcaggtaagttccaagagcaaagcaagtggtaagaagtgtttgaactttcaagatagaaaaggcactcaacacaagggctcgaggaagaacactacttgagtaagggaagatgctaaaagaagattctgtgaggaccattctcaaccactcttgccagctggcgccaaaagactataatgacctacaagatgtaccaaaatgcacctagggttgacccgcgggggcaaagatgtaatcttgcatgtacgaccatgggctatttaagccggtcaaaatcctgtagcgggacaagagacattttataacacaaaagtaatcaccaaaaggttgtgtgtactgtttgagctctctaagaataggcaggagagttcctttttccgcctatccccaaacttggtcacgacatgatacaaaatcacaaagttcaacaaatggtatgtaaagcaagaacctcatattttaactttatttttggatgattcaatacttacagctgcagagtcggcagagatgcccatgtcttaatttggattaccctttcctaataaagtaaagtgaaacattttcaagattaactaagtttggataactaaatcaactaacatatctgagtaaactagaagcaatttattaactccatatgaccaatcgatacaaaatcacgaagttcacaaatggtatattacgcaagaacctcagattttaactttaatttttggattattcaatacagacagctgcagagtcggcagagatgcctatgtgcagggcttctatacgttgcatatcgagtttaacaaccatgttaggttgacttgatttgaacacaatctttatggcttcagccacctgctcaacacataggctatccatccatccatccaaaagttaagatcaccataggtcaatagcagcagggcgataacagctcaaatgtcaacgatgaaattgaaaagcattactaactgtaggatgaggcaagtacgcaaatactaccccataattcagacaacaaatccactcaattctgtatatatctaatttgcattgcacatacttagtagacctagataaattcctatgagatctccacaaatctgaatttcaactacgatttccaccatacattgcgatctccttccctcccattctctgatttggtcgtaacttgctttacgtcgagtttgataataaaggttcataacttattccatccgcatggaaaacgatgttgctcattagcatatgactaactaaatattagcttaaaacttaaaaatagattattatgattttcaagcaaatttattttttttgcaaaaaaaaacagatatcatttaacagtttgaaaagagtacacatggcaaacgatggagtataagttgggaaaggtgagtgcccaactcagctttatgctgtgttctttttcacacgcatggttcccaaacttctaaacagtgtgcttttatatatatatatatatatatatatatatatatatatatatatatatataagttgcttgaaaaaaatcatattaatacattttctaagaatgtttagctaatacttaattaatctgtatgatcgaatcacaataactaagctaaccagaggggggtgaatggttggtatacccaaaaaccgaaaacttttagcggaaataaaagttaccctcaaattcaacggatcgcagtctgaccgaaattgtcatgttggtctgaccgcctggttgccatcggtctgaccgaggttgaatctccggtctgaccgccgagatcagctcctgtcacctgtcgccgaagccggtctgaccgccgtgtccccgccggtctgaccgccgcgatgcctccggtctgaccgccggtgcgccaccggttagaccaccgaaacctggtgaaacacaaatcgaagaactcttaaagtagatgacaactttattggttctctccgtatttacaaagtgcaccaacaacactccttacaaaaatttcgacaaaactcaaaactctaactcaaaactcaactcaattgctctcaaaagcgataccaggaagcctcacgctccccctctatttatacccgaggtaggcagcctaaagccacgaaccaaactcatactagaagtcctaaacaccttaggaaaccctcaagtacaagaaacaaactttacataaccaatcatatcaaatttggactccttccaaattcgactccgcatcccatacgcacacaatacctccatcgtatgccatatggaatcttcaccaaccacatgcatcaactctagcctaagtatcccgcatgatctctgcccaccacggacgtcgtcttatccccaagccgactcccggtccatcaccgcaaatactctcccgaggcatcgagtcacctacacatgaaataaacaaagaaaccatattccgagaccaaagctatctccaacttgactcatcgttagcaaacaacagtattacatacgcatagtatccatctagaaaccatagtcatgaaataatcacagatatccaaacaaacaacccgaaaccgaaaccaacacagagtcggccggccagaccgcgggctggccggtctgaccgcgcgcataccgccagtctgaccggcaacccttgcctggtctgaccggtcacataaaataataacacctgtgattcacctgtaaatccaatcatctccaaaaccacttcgtaaataaattccaaataacaaaaccaataatctctaatgccaattgttcatcacagaataataatcaaaaacacctttgattttacataatcatgcgctaatccgcgtatccgttttacgtgtcggaggggaaggttcccaattccaaccctccttgccgaactcagccttagtttgcttcttcacaagtaggaatatctccacgaggtggcattcctgttgacatgatctgttcagaaaaatcaaaatatcacacacacactgaccatagcaatcgacataatcagtaagaaacaccaactaaaatcagtatgcaatggcgatcagtaaacaacaccaactgaaattagcacgcaaccacatgatcagtaagaaacaccaactgaaatcagtatgcaaaggcataatcagtaagaaaaccaactgaaaccagtatgcaatgacatgattagaaagcaacagcaaataaaaacccactttgtccacttgtcagtataatgcatagtcatgctgattgcaaacacggtgtccctctcatcctgaaaaggataaggtcatgctacagattgaaggagaaacagaacaggaaagattatatatcccagatttctgttatgtacgattattatctctaatcatcttagttcagtaaaaactctacaggtcacatgcactgaccaaaagtcctgtacaggaaactaaaaaccaagacagtgcacagttcagagttcagaattctactttattggtcaactttgtttagagttagagttgttcatagcaacttgatagtgaattcatagccaagcagataattcacgtccactaaaaaatagatatcttcacaaacaactgaagtggttagagatctgcagagacaagacctcatcatcatgaaagcacaataaaaaatggcatggacagccataaaaaacctctgctagtttggctctttttgaagctcaagaaagttatcgaggatatacatctacttggttcaatgcagatcaagaaaatgaccacggatatacatcaccaagtagactatgtgtataatggacgggagcagaccaaatggatataagtataatccaagctgagagcagtgttaagtgaacagccatataatggaaaacaactttcatgtttgattcagagagcacttttttcgttgggaataagttcttccctttccttttgtgtgaacagctttgtttcctgaatagtcaatgccactgttgtttcctgccagcaaatcttttgaaaaaatcttctgaataaacaacaagcacatgtttagaaaaataaaattaccaacaaaactttaaataagatgtccacgtatatgtgcggggctctcgtcctacttatattaaagtgcctagaaaagtcattttaaatggtattgtcgaccttttgcaaattatctgagcacaattttcttcgtaagttgctgcttgaaaaatgaacttgtcagcctttacctaagaataaaatctgtagattaagtccaataaaaatgtgggtcactctgtatgttacccctcagtgatttaactacacgctaaacaaccgatcatcaacgagggtttttcttcagcgatttaacagcacgctaacaactgtgacgggccgctggcctccgtcacatagaaaagccgttcacgacgagtcgatggctgtgccaagatcgttcccaacgcctcccattcccatgcctgccttcctagttgggactcgggagcaaatggaaagcttaaccagatgagcagctatggacgtctgattattgagcagcacagcacgcatatagttgctggggacatctcttattgttagctgatctgtgctaatgctagtgtagttgtgtacattgcagcggcgtgcctttgttcctctggtactcttttggacgtcaaaggtgaaggtaatgcccttttcctttattttgtagagaaagtagatatatactccctccgtttcacaatataagtcattttagcattttccacattaatagtgatgttaatgaatctagacatatacatctatgtaaattcattaacatcaatatgaatgtggaaaatgctacaataacttacgatgtgaaacggaggaagtagaacttatgtaagctcgtgtcctccttacgaaaggtcttgtttatagaggaataaatgcatccatcaacccgagcagatgaatatataagtagagtttaatatcgttgtaacatggaacacctgtggcaatatccttccagcagatcaatacaattcagccgcatccagtacatctgtactactccctccatcttgaccgtattactttctcatcaagaccaagaagagcactaacttctttctgattcatttaatttgatcacttttgttcctaatccttatttttcgtgagaccttctaagttgctctttattggtaatattttaccactgcttcctccgttcaacaatgtaagactttctagcattatccaaatttatataaacgttaatgaatctagacgtatatataaaatatatacattgatcaatgaatgaatctaggtaagataaaaatgttttacaatatgaaacggatggagtagcaacggttcgagctatcggtttataaggatgcattggtacttttcatgcttaaagaacctttaataataaaacaacaaaataaataaatacttaattcctcatttcacaatgtaagttgtcggtgacatgggaccgggagtatcatgactagaggcttgggcagccgcgatcacccacgtggcccgacccccccgagggggtcgggtccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgtttatccggtccgtgaccgggcgcagcgtgtgaccggtcacagaccggtcagatcgcgggttaggtggtggcaggtggcctgttacacgcctcgccccgtcccgttggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcaggtaaaagtgcgagccaaatcttgctcaaagtaggatgggtccccacccaaaagaagggtaggtagaaatggtatatgtggtatccccttgagatataaaaggaggaccatgcctaccaagaaaagggaagaaaaaaaaaagaaggaagaaggagagaggggagctcatagaaaggacggggaaaaagagtagggagagggtctctagagttgaaaggctcttgctcttcagctctttgtaactccttcagagacagatccgccagaacacaggagtagggtattacgcttctcagcggcccgaacctatctacatcgcccgtgtcttgcgcgtttgctctctcgcgaaccattccacagatcaagggcttagaacctcacttagcgcccccggccgaaccggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagctcgtactccgccgcccccctctcgccgaagtcttaggcgggaggaggcgctcgagggggtcgaaagatccgcgacttcaccgcccacgagcgatggagaaggacggcgagacggggagcgtcgtctcctcgtctacggtgatggcagcacgccccagggcgtgctccaggctgcgggcgcgctcctgcgtcacccgcccgtcgtccctgatccagagactccaactcgacgttggctagatgacgtggccaacttggtcatgacggcgcagcagcgtttaggcgccggcgggcggtcctccgccaccaaggccactggtgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgtcgtgctgcccacgcatcggagggcgcttcctcgtccggagcgccacttcggtccggacacggaggccagccccccgtgtccccggttggcggtgccggctgtcgagcctttgtggcgagccttcgaaacgtccgttggcccccaaggttccggcccaccatcaccgaaaaatacgacggaagcgtcaaccccgccgagtttctccagatctacacgactgggatcaaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaagggacgatgagtctcttcgctcgtacattcagcggttttgtcaagtccgcaacaccataccatgtatccctgcacacgcggtgatctacgcgttcaggggggacgtgcggcacaaccgcatgctcgagaagatcgcctccaaggagccccagaccactgcggagctttttcagctcgcggaccgtgtggctcgcaaggaggaggcatggacctggaactccaccggttccggtgtggcagcttcagccgcccccggatccgccgctcggtcagggcggcgggacaggaggaggaagaagaggtcggcccattccgacgacgagggtcacgtcctcgccgtcgagggcgcttcgcgggccacccgaaaggggaggcctgcgagtgacaaagagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaagtccccagcggctccctctggcaaccggcgaagtgaggccaagcagaaggcccccgccgaggacattgacgatggcgacgatgacctagggttccaggagcctggggccaccatcgccaccgtcgatgggggagcatgcgctcacgtttctcgccggagcctcaaggccatgaagcgagagcttctggccgcggcccctacccatgaggcgatgcggcgggcgcggtggtcggaggttgccctcaccttcgaccagaccgaccacccgccgtgcgttgcccggggaggacagatcgcgatggtggtttcccccaccgtttgcaacgtgaagttggggcgtgtcctcatagacgggggagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcttacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgagcaaacgctgacgtcttcgcatggagaccggcggacatgcccggggtccccagggaggtgattgagcaccgtctcgccgtacggccgggcgcaaggccggtccgtcagaaagtgcggcggcaggccccggaacgtcaagccttcatccgtgaggaggtggcgcgacttctggaggccggattcatccgagaggttatccatccggagtggttggcgaacccggtcgtcgttcccaaggcgaacggcaagcttcggatgtgcatcgactacaccgaccttaacaaggcatgtcctaaggatccttaccccctaccacgcatagatcagattgtcgactccaccgcagggtgcgaccttttgtgttttctagatgcatactctggttatcatcagattcgcatggctagggaggatgaggaaaaaactgcattcattacccccataggaacttattgttatatgacaatgcctttcgggttaaagaatgcaggtcctacttttcaacgtactactcgaatttctttgggtagccaaataggacgtaacgttgaggcctatgttgatgacttggttgtgaaaacacgcaaccaagagaccttactctcggatctagcggaaactttcgaaagtctccgcaccgcccgcataaagctgaaccccgacaagtgcgtgttcggcgtgcctgcgggcaagcttctcgggttcttggtctctgctcgaggcattgaggccaaccccgagaaggtacgagctatagagcggatgcgccccccagcaagcttagggatgtgcaatgtgtcactggctgtatggccgccctaagtcgattcatatcgaggctgggagagaaggcgctacccctatttaagctcctcaaacgctccgggccgtttatctggacggacgaggctgaacgggccctcactcagttgaaggcgtacctcagttctcccccagtcctggtcgccccggagccagatgagccgttgctactttacctggcggcaaccccgcaggtggtcagtgcggcgttggtcgtggagcgcgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccacggggccactgcgggaaggccgcgcctgtcgccctccgaccccgaggtcgtcggcacagaagccgagtgcgccccgcgaggcctctcggacgaagagcgccctggagatgtggcccctagtgaagaagatcggccccgccgaaaggtgcagcggcccgtctacttcgttagcgaggccctccgggacgctaagacccgataccctcaggcccagaagatgctttacgctattctgatggcttcgaggaagttacgccattattttcaggcgcatcgggtcacggtagttacgtcttaccccctcggccaaatcttgcataaccgagagggtactggacgggtggtgaaatgggcaatcgaactctctgagttcgatttgcgctttgaaccacgccacgcagtcaagagccaggccctcgccgactttgtggcagagtggaccccggcccctgagcccatctccgtccccgaggccagctcgggcccctcgcagctgcctcacaccgcctattgggtgatgcagttcgacggctccctgtctcttcagggagccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgattctcagttggtcgttaaccaggtctccaaggagtaccagtgctttgacccgcagatggatgcttacgtgcgccatgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtactggtgggagggaccctctatcggcgcgcggctaacggagtcctcctgaagtgcattcctcgggaacaaggcgtcgagcttcttgccgatatccatgaaggcgagtgcggagcccactctgcctcacgcaccttggttggcaaggcctttcgccagggtttctattggtcgacggctctcaacgatgcggtcgacctggtccggcggtgcagggcgtgccagttccacgccaagcaaacccatcagccggcccaggccctgcagacaatacctctttcatggccgtttgctgtctgggggctcgatatcctgggtccgtttagacgggccccgggcaggtttgagtatctgtatgtcgctatcgacaagttcactaagtggcccgaggcttatccggtcatcaaaatcgataagcactccacacttaaattcatcaagggcatcacagcccggtttggggtgcctaaccgtattattacggataacggcacccaattcactagtgaactcttcggtgactactgcgaagacatgggcatcaagctctgcttcgcctcccccgcccaccccagaagcaatggccaagtggagcgcgccaacacggaaatcctcaagggcctcaaaaccaagaccttcaacatcctcaagaagcacggcgactcgtggatcgaggagttgccagcggtgctctgggcgaaccgaaccacgccaagccgagcaaccagggaaacgcctttcttcctcgtctacggcgcggaggcggttctcccatccgagctcaccctgaggtcccctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtggcccgggccggcggaaatcgccaaacggggcccagaaccgagccgtgccccggggcgtggtgaactccggaggggaatcggcaaaggcccacaatcgggtcatccataaccctcggtcaccacgttcccggcctggccagtctcgacacgtggatctccccaggcactagccccgacccgcgccatttgaggctaggacctgggcacgagccctcgttcaaaccaagacacagaaggaccacggcacaggccatcctcgtctcatacacacgacaaacagagctgacacaaaaatttcctctttatttgattgcagattaaattagtttgtacaagaagggggcccgaaggcctcagaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtggtcggcggcgtcccggacctgcgcgcgcgcgtcgtcctcggttccaggagggaactcgtccagcgccgcccacggggagaagtccgggtccctggcctggtagcttgccagtacaagctctactgccccccgggcgaggtctctcgaggatgacttgatcgtctcctcgagctcctcggggagccgctggagagtcccggccatctctgagaggcgctgggcgaggcccccctggttggcggcatatttcgcgatccgcccgccccagaggcccgcctgccgcccgacgcggtctagacgggagacggcgtcccgaagcatgccgggccctacctcgcctgccaagcggagggcctcgacctccccggcggacgagtccagcgcgccctgcagctcggcgatagtgtgttcggcagctgcgaggcgggcggctagatcgccgtcgcccgtggccgccccgccgctacgcgccctcgcatccagctcccttgcccgtgcctcgagctcagcggcccgctgatccagtgcggccctctcggcgcgggcaccttccagattgcgacgcgtttgtttctcctgcgctgcctcacgaagggacaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtctgccaggtccctctccttcacgcaggcgcgctcttccagcgccgtggcacgggcctcaagggcttcttcgcgacgtcgggacgccgcctcggtctccgccgcccgccgttcccgggcagcagcggcatcaaggaccccccgggcggcgtcgagcttttttcctagctccgccgcccagctcccgtattgaaggcggaggtcgtcctgcgcctcgttcatcactgcggtggcgatgagggcagcctcccgctcctcctccacctccctggcgatctccgccagctccttccgacggacctcgagctccgaggtgtgccggcggtgtgccttgcggcccgcctccaccatggcctccaccgagcgtcgcccctcttcgacacgcgcccatgcagcgtcgagctccgcccgctctgcctgcaggacctccatctgggcacttaacccgtccaacaccgtggtgttcgcggcggccaaggcctgcagaaggggctctacgctcagtggggcagcggaaggcatgggggagagccgcctcggtggggatgccgcacggctcggcccgccgatcgacgtaccggactcagggacgtcccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgtgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgcctccgggcctccgcggtcgccgtatcctcggcctcagaccggccggacttggaatggcgggaggggcgcgacgggatctcgctgaagcagaagaaaaaccagaagacaaacaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgttgctcgcgcccacgtctccactaattccgctcgcccgtttgcggcgcacgaggcggatgtgcggctgtggcagttgagatgggacatatcgtgcgcgcgttaactatgctcgccaacctaagcgccatcatcatatctccaggcaaaacgaaccggctcgtcccgattcgcgtgctactcgagtaatgtagcggtcttaaagagaccgctcattatagacagtcggttttccgttgccgatgtgcgcgatttgcgaccgctgggtttctgcccgcctgtagagaccggccccacctgtcaccaggcctaaggagtggcgtcacgcccgagcgcttccttcggggggggcgatcgccctggcataacgccgggggctactgtcggtgacatgggaccgggagtatcatgactagaggcttgggcagccgcgatcacccacgtggcccgaccccctcaggggggtcgggcccaagggtgatgtggccgcccctccctttgtctccccgaggggtcggactgctcccgtttcgaccccgagggccggggcgccccgaccccctgtgggtttggcgccacgtatatgggttaggtgagcatagcggggctcacctaaccgcatttattgcgggttgaacgagcgcgtcacgccgcatgtaatgcagcgcagcgcgctcgtttatccggtccgtgaccgggtgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccagtgtcaggtaaaagtgcgagccaaatcttgctcaaagtaggatgggtccccacccaaaagaagggtaggtagaaatggtatatgtggtatccccttgagatataaaaggaggaccatgcctaccaagaaaagggaagaaaaaaaaaagaaggaagaaggagagaggggagctcatagaaaggacggggaaaaagagtagggagagggtctctagagttgaaaggctcttgctcttcagctctttgtaactccttcagagacagatccgccagaacacaggagtagggtattacgcttctcagcggcccgaacctgtctacatcgcctgtgtcttgcgcgtttgctctctcgcgaaccattccacagatcaagggcttagaacctcacttagcgcccccggctgaaccggcaaaggggagcccgcgcggtctcccggtgaggagccccacgctccgtcataagtcattctaccatttcctacatttatagtgatgttaatggatttagatatatataaatacgacaaatggtcatgttaaaaagggataaacagaagcgtacatttaaaatggatgtggtagtttcttagttggtagtgtttttataggaatgtatataatttcaaagttatacaaaacaaaaaaagatgaggaaaaaatatgtttcacaatgtgcatagcttcctcatctctctacttctataaagaggaagttgtcctcctccacctccgcgtaaaaacctttcttaaaagaaaaggtccatcctaaaaaatactttctaaaaaaacaaccattgaaaaaaaaaaggaacaacccactggactaatatcctcccactaaactgaataaaaaatcgttctgaagcacaagctaacatgcatgtgttcagatcacgtgagcacagctcgtgcgtagggagggatgcaagtgggtagtctcgttacccgcttgctagtttatttctggtatggtagtacaaaatttagaagaaaaaataagctagaagttggataagcggaataaaaaagcccgcttgtccgcccccgcttgcatccctactcgtgcgctgcatcaagccaagcccctacgagtagagatcactcaagaagaacggctgaacgaggccatcgccggagggctgtgagcatgtgaccggcatgctttgaatccgtgccttctttctctgcactgcttgatgccattgcaactttgcaaggcaaccaagtgctccagcccccctggtctcattcccagactttggtagctgaggctactggaactatgttcggtgctgcaaccgttgttggcattccgtgtgcctcccgttccagtgatatcggtcaccttgaaattcagtatatgtgtgtgttcccttctgcttcctatatattttttatcccaatccatggagttgaaagaaaatagtgtaaagaatagatcagtatgtatttaatacaaatgaaggtaaggcagatcgtgttaaggctaaatgtaaggttatatctatatgtgagcatccctacaaaaactaacccaatggaagagatgtcccaaaggcatttgcgctaaaggtcaagaaaaggcgccccaaggtcggctcttacctatatgaggacccgaagaccggttcttaactcgcgcttttggggaacacacagcaagggaccttttttttttttgtgagagccagggttgagccctggcctgtagcctcacaaatgaggacttcaccgccatgctatgagcacgttctcagcatatctgaaataagaaacaacataagatacaaatccagaacaatccttaaggatacatgtagggtgctatttatattctgcaaagaaacctagccagtaactttttatcttttgttgaacaatttacagagtcatcaaatagtaactgccatatatactgtcaagataatcagaaccatcctaaaaagataataaagcaaattatcccatattaaatcatatctcagtacctcacaaacaagtaccccatcacatgttaaatggaaaattagacacaactttgtattacaactcatgaataacaccttttttttattaaaaagaagtgcatagctaagaaaagcaccctgatggaaagataatgacaacgacagaattccaaaataatttgtcctgacagctaaaatggtgcttgcaataacatactaaaaactgatttggcatcagtatttggtaatttgggacaggattttctaaatatagcaggaaaatacaaaagtttattttctcagaataatgatcaacgaatctacatgtaatatgccagttgttgaaagagaagcaaaaaaaagagagagagagaaagaaatgcaatgtgcaaatagcaaagatgcatgtttggtgtttccgctacaaaagtcatggaccaagcgaaaacattgctctaaattcctataaagattaaagaagagggggagagagagaataagatggcaagacaaggtaatactaattgggctcaattatcttcccttaaagtaataatatagtactatgtttcattcagcaaaagtatcataaacactaaatatatatattccatatggtaattcaattggctaatggaacactattaggacaatttcaacaaacatgttatggatgaaaagatgacaccaacctgaggtggtcagtgaattatcaattatgcagtgtcatctttatatttgcctgcttgtctccccctcgtcctagggatccttcttaagcttcttgcttgggatcacacgagggatgctttttctcctccttatcaccaacttttagcaatcacacccagctagagagaagcatgctgtggaacggcagtagccagtaggcaagtgaccatgccagcttgaacaggttagtggatggaggagagtacaggaccataattccaactctgagtagattcagtggtgccatcttaaaatgttttctctcttttcgttccattgaagggttctatttattagatcaccagacacggaccattatgaaccttaagtacctgacgtgcttgaataccaataaaaagccactttcctgaatggtacccttctccattaaccagaggatggtcctcaccaaatcaatgtatctggaacggatgtcacattttattgtgccaaaccatatcctcaaaccatattggctgcaagtgtgtaattctagtaatgcacgttgaacttgagactgcaagatgaattaattcttcaaccttaaggcttcacttgagaatgatatctgttcaataaactcatgagacatgacccctcttttttcccccagagacgtgactactcttaggattggaaaattatgtgaatcaagtgctctaaacatcaagaataattagccactcagctcaatacaactccatccaggttccttcattaatccttgcttgcttagttgcctcctataacttgtggccttcttccatttccctaaacaactgagcatattagacatcagaacacagtgatcagaatcttgagtctccaaattcagaagttcctctggtatgaaatctatggatgaatcagcacaacgagcactgtatgaactaattataggagctaaaaccttattttgcacctcacttggcatctgcttgaagaactttagggcgctcccaaaatgaccagctttacaaagcaaatcaaccatgcacatatgatgttcaatagatggctcgataccatattccattgtcatgctgtgaaagcactcaagaccttcatctactaaaccagaatagttgcatgcggtaagaacatgagtaaacgcaatcccatctggttgaaaacctttgtttttcatctccttgaaaaggacaagagcctcacttccttctccattgcaagcatacccattaatcatggcactccaaacagctatatctctattggtaacaccctcaaatattttcctagccagattgatgctaccaaacttgctatacatgtcgattaatccagtagctactcgcggctctgaatgcagtccagtggcaattgcctgctcctcaacctttttccccagattagcagaccccaatttggcacaagctgaaagaactgatgacagagttgcttcattcggctcaatgtttgcgcacaccatgctatcgaacatcaccaacgcttcattcagatgaccaccttcaacatacccacttatcattgaagtccacacaaccacattcgccatgtgaactgcatcaaagacttctcgagcggattcaagatctccacactttgcatacaagtttatcaatgatgccgcaaggtcttcctcacattcaaagccaagcttaataatgagagcatgcacacccttggccaccgacaagttcccaaacagaacagcagctgatatgagattcacgagcactaccgagtcaacatttttcccaactccccgcatgcggttgaacagatcaaacacctccagataatcccctctaagtaaataaccagatgccaatgcagtccaagtaactacagacttgttgcatattccatcaaacaacaaccgcgcagcatccagatggctaccacggacaagcatggtgagaaccgagttcaacacaggcaaaccggcatcaagcccagatttcacgctaaacccgtagacgcacatgccaggattgcttgcggaaacggagtccacacacccggagagcacgccgacgagtgtgccctcgctgggtctgacccccgcacgccgcatcgcgttgaacaccgcaacagactcctccacctgggagctcctgccgtacgcagcgaccatgcagttccaggagaccagggtcgggcgcggcatttcgtcgaacaggcggcgcgcgtcggggaggcgcccgcacttggcgtacatgtcgagcagggaggtccggacgaacacggcggaggcggcgccggcgaggagggcgtgggcgtggacggcggcgccgaggcgggggaggcggagcgcggcgcatgacttggcgagggacgggaaggtggatgcgccgccgccgccgaggcccgcggcgaggagggaggcgtagtggcggaggcagcgggagtaggagcccgacgcggcggcgtgctggatcaggcggttccactcgcgcagggcggtggtggtggccgtcgtcgtcggcggcgtgggttggctcatgcgtttcgaggttttcgggggcctttcggttgttactatgtaaatttcgacaaaattgcatacctacgatcgcaaagtttggacacactagaatgccagcacttaaacgggcttcgctagaataccacgttgaaatgccattatgtaccaatctacccttgggcttcatcttcctcactccaactcctcatcttcctcgtcaccggtggctacggtggcagcaaggagagccggcggccagcggtggtcgtttgcatacggtcgatgggagtagtgggggcagaggcatccttggggcaaggaggtgcagctagcggtcgacggcagccgcgcggagggctaggggtagagtagggcggagcgcggtagggttggcgaggacagtggcggcagacgtgctctcgtcggccgcacacgatgaccaccgccgggagccgtcccggggcgacgacctccgcccacgcgctcccgccgccgcacctgcactcctgccaccgcccacatgttcccgccaccgcgtgcaacgaccgctgccgcccacacgctcccaccaccagtcaccgagctcgctccctcggttcccctcgccgtagccggccaccaaactcgctcccttggttctcctttggtgattaatatgcagattctatgtttttcgttaacatattttttaaactactatgcagcatagtagaaaaaatcagaccggacaccgaaccgcttgaactcatggtccacccgggtcatcgattggacccactgggtcgatcggtatttatacaaaccaagctatatgatgagtgaaagccatgacacctcagaccgcttggcactaagatgttatagctcagcgccatcaaagatgttatagctcagcgccatcaaggttggcgctgagaaaacgaccttttttaaaattagtttttggcacggttcaatctcagaataagttttttaaaagtgtcaagttgtcaaaaatatggctaatttattttagttccgtcactagttttcctgttgcaatgttcggcgtaggtcatctttttatactagatgatgccccgcattttgctgcagtatatatgttagataatagagaaatgataaaattatttggactgaaatattatgaaaattatttaagagtaataatttagcatgtgtatgtttagttttagaatgaaataaattgtagatattattactatatgcttgcataataagctttgtgtgctcaatgggttgatgtggcatacttgcatgtaggttttaaaagtgctaataaatattatgcttgcatgttgagctttattaggtgtttagttgacattatgtttatagaaaaaagagattaaaaaaataacaaaacaagcctcactaaacaatcaatctactccctcggtcccaaaatataagggattttggtggatgtgactcttactgagacaatgaatttggacagactaggaaatgtcacatccacggtgtgtttggttcacggtcatgcatggatgggatatggccatccatattttgttggatatggcgatccaatttcttgttttggttgaagggatatagcatggatgggaaatgccaaaagttagtgggacccatttgtcatatatatttttttatcaaaatataatcattcgagatcttgttttaaagattcaattgtaacaaatataatgtaatggtgtaatcaaattataaattagataaatggtttaggtgaaaaaaatcatttggagcttgcttaacataaaatcaaaccaatcgcagccaatcagaataggcaaaatttgctacaaaacactcaaagattgtggtctttgctgtgagacatccgaagattgtgtatttgctcgtggacactataaaaaaatggtaattagctgctggacactcctcctattattttattattagaaactttggttaaagacaagtttgcccatgggcctacttgtcaatctctctttctctgttcttcttcctctctttctctgttcttcttctttaatagcaacgcgacacttttcatcgccctcggtgcgcccaacagcagcaacacggcggccggcttctcgttcacaccgatgcgccgcatcccctcggtgccgacgttctacgtcgtgacgctcaccagcatcagctgctgcagcacgcatcgccggtctccgacacgtcgagttgtttcatggcgacggcgcgcccgccgctgaggtcggcacggtacacggtcccgaagctccccctgccgatgcagtacgcgtcgttaaagtgctccgtcgccgccaagatgtcgccgaaggagaacgtcgtgtccttgctccataacgaggcctgcaccgccgttgtcgtcgccgccgccgagctcccgccgctcgccgccgtctccgcgttctctatgacgacgtcggcggctcgcctcgccttgcgtgacaccgtgcaaaccaccacgaccatggacaccagcagcgcggtggcgagggagagcgtgacggcgagcaccagcctcgtcttaccggagtggccgtcgccggtggtggtgttcgagctgcaatgttgttgccgcacaggccagggttgccactaagatccagcgtcgtcagcgacctcatcttgccgagcaggggcgtcaccttgcgggagaggttgttgctgctcaggttgagataccacatctcggccagcttcgtcatcttcccgccgccgccccgccgtggccgagccgtctcgggttgggccagccgccgtcgcgcctctgctctgctgcaaggaagaagaaggggaaaaaaagatagagagaggaagaacagtgttaggggcattttggtacttacacaactctttctctccatctcgatcagaaataataaaataatgggaggagtgtccagcagctaattaccacttttttacagtattcacgaacaaatacacgatcttcgggtgtctcacagcaaagaccacaatctttgagtgtcctgtagcaaattttgccatcagaatatgacacatcaccgagactaaaactggatggctttatccagccaaatcagtcggatgcactcatctaacatattgagggaatattctctattatgggccgccccatccgccctgccctccaaccaaacaccacaaaaaatcgggcggccatctcccatctaggctccgagggagtactttttttttttttacctgcttcctcctctaacctctatgggcccattggcccaagggcccaattccccgctcccctcctcctttcctctctctctctcccagcccgcactccctttctctccccctcccctaacccctagctgagcggcggcggcggccggcggccggcgagcggtgagggcgcgaggcggcgcggcgtgcggcgcaggatcgagggagggctcggactgccggcggggggcaggcggacagcggcgcgacgtcgtcacggcgagtcggcgacggcgcggggcggggcagcggccagcggcggcgccggcacagggactctgggagggagccgggcaggcgggcagccggcagccgaccagccggggagaggagggattgaagattcgaatttcgaagtattgaaccattgactcattgaggttagggaactaaagttcactgatttcatgatttgttctacacttctacttaagtacttatctagtgaagtatctactagactactacttgcttagtttttacaactgtacttgtgagtagttcatacttgatacttcatagttcctactccctccgtttcacaatgtaagtcattttagcattttccacattcatattaatgctaatgaatttagatatatatatatatatatatatatatatatatatatatatatatgtctagattcattagcatcaatatgaatataggaaatgctagaatgacttacattgtgaaacggaggaagtagttactatcttgcaaacttgattagctagtaaggcagttagcgaggactaggagccttcaaccttggctactaggatttgttcataggaattcagagatcttagtaattagtatttctatcctttatgtatttcatatgctggcactttcatatgtttaccaattagtatttctgtatgttaaacaatttcaagtgattgtcaattctatcaatgtgtgaacttatgctcaattttatgttatacatgctatatattatataattattagtgtgtgatactatacaagctaatattaggcttttaggtgtatgaacaaaaaaaaaattaccccttcccatttcgaatacggtttgaaatcctgggcttgcccctggcttgttcgtagatttgcaatttgcaaaaaaatagagacgaaaacatcgcacgtggtatttcactgataacgctaatgctatcactctacagattggtatttgcatatttatagtcattttcactttccatcagtaaagtacaagtagtacagctattatatttcgtaatttttctcccttttttatgtttttatgtgtgaatttggacaccattataccgataaatgcattgtttgtataaactgatgagtactccctgtatttatctcttgtctttgccagtagcagctgcacagttaaaaggcttgtttctaggaatgtaccattgtttgcttctatagttttcagtatgacctgttgtggttgaagccgtagttgtctggtgtgctcattaacataaatattatgtgttatttgttgcattgaaggagcaccatggatggaactctttgaatgcttttcattcatttggaatatctagatatggttatggtgcatcaattaatttattcacataggtggtcaagggcatacttagagggtctcctctaagggttcatatgttaaatcaatgcctgtccaattcattggcctcccagtttagtttccatactccttggctgtattagtttcctgatctcgcacttcaccgtggtgcttactgaaaataagcaaactgtttgtcttgcagttgtctgttctgattgactgaaatttttcgtttttcagggctgaacctttttcttaagtaatagcaaactttatttgatctgaaatacatgtacatgctttttagccctagagatcctagaaaactttttattgttagcatggatccctgattttatttactgagagcattctaattactaaaacactgagaatcacctcactactctaaatactttatgcttagatgatatgttggtgttcttctcacacagccttgtagtgttacaatatacagtttctaaatcctggctccaccatttttttattattattaacttcgattgggaatgcttcactaaatgttgggctggaaacactgtttttgtgtgtgtgacatttgccagcaggattattccctctccctcatcctaattacatttgtgccgtccctgctgttgggttgttgggtcccccttggacctccaacagcagtatgaacacaggtacacaacatgtcaagcttaatttgcaggcaaagtggacatgagcgagggctttctgtcaatgtgttcacaaatgtgcctactccctccggttcccgtttagttgatgtttgaggcttggactattttggatggaaaatcttgacgttttagccatgtgatcaatttagactgatttgcccctgcttggctgcatgcatgcaaatcacatttaacttggtgcatctgagtccttcacagcaccataaaaatcatgaggataaaatcaatttgccgaatcatctcctacagcatagtaaaaatcgtgtggaaaagtagggtgccaagattcaaacttagcacatgaagctttgggactagcagtcataaccaccaggttaagaggatttgcttgttggatgtgctattctaatgtgaacttattaatcattccttggtatgtgagctcctgtccaaaacgtcaataactttgaaaccggagcgagtactgcctaggggcacaaagccaattattataaccacctccatcaattagggtttttatccagggcaagacttccatccctatgttggatgccctttgctgaaaagctatttgttgtattactacttagctcattactttcctcttttgtatctgtactagatagtaaatgtgatagcatctcttgttttctcttgagggaaaatgatagcatctcttgtagcttatagttcttaaagatagtctttatattcgtaactgattacctggatgttacctctatttgggtgatacagtttttcccatccattcatatctacaggtattaaaggcagcatctttaccaaggtgctaatcagtcacatgcataaccatgacttctgaagacggagacatttcagctctgctctctgaaccaagtattcctgaagagcagcctgaggcatctgaattcgatgacgtcgtccctgcaattttggaatcaattaaatcaagtgagaaggcattcaaaccttcaccggaggaggctgcttgggctgattcttgttttgtgcagacatctgagctttcggatagtgactggggagcaatgaagcatgccctgcttaatgctcttgaaaagccaacagaaatacccaacaatacttctgaaattgtgcacgaagaaggttcccatgcaattttagaggtcaaacctcactctctccctgctgaaattgtttctcagcatgatgacatgcaaatggagcaaaaagaaaataatgattatgacactggtactactgaagcttcggaagttgctaatgtaattaggggcacaaatgaacatggtaagcaaatggatggatacacagccagacctgaagatggcgatgagttgtcttcgtctgaagttcttgagcagacagagtcaagagagactatctttaaggtgtgggatctggacgttccgttttctgatgaggatgagcttgaactcatcaaggatctgaagaaactcctcaaggacaatcctcaggagtctgaatttcgacctcccagtggaacagccaagacattgagccagatagccgtcgatgatctagtggcagacttgagcgacttgtcattgcagcaaacagacgagtagcaacattcccccaagatatttctgtggcaaaattttttaccatccccgatgaactattcttcgttctctagctaacagtgcagatggcttaagtggaggctgtgcgtttgtaagaattagattgactgtttcgctgttcttttgaatctctacctttcttaataggtagttgtagtaaaaaagttgttcttttttatctgcgtgtattaaactataggtcctcaaacttgcacgcttggtttgtgcacgtccctgtactgattacgcatccacataatttgggtccttctggctatagacatgccacttgtaagttgacttgtgctgcgaacggcgtttaatcgtcctccgtgttttgcgctctcgtcctcaatctgccgctcccgggcgggctgtcagtttagaggagcttatggcagttgccaaaacatcttcaaacagtctacatttctacttaaatattaaaaagatgtagttgtataatccaaaaaaataaactagaagccagaagttgtatttccctgcttctctatattcttaccaactaggttctcagaattaaacttctcaaatagggcctaagattctaaagcagatggtagcttttgagaatatgaaaaagttaggtttttcaacttctaaattttagtttattttctgaattttacaactacaacttctcataatctaaacgaaaaactgagttgtttaggtgagattctaattctggaagaagttatagcggccagaaacttccctaaataggtcctaggtgagtttctcttagacaagttttggcactgtcagagactatattgattttggtaaaaattggctatcatttgtactaagatttggcattaaaccaaatcagcctatcaattctatatttaggtcttacctacaagatcacatatttagacataatcaagatcttcgataagaatcctataaggccgactctctcacacattgagatgcttgatatgatcattgagttgaattataccgggcaactctcgcatatattaagacaccatctctaaataaaatcttacaagaccaactatctcacacattaaggtatgatcttacaattctacaaaactgactccatgcaaagctagctagacacatcgacagctgtcgactaaaggttttagtgacgcaagaaaagaacgacaaatgcacttgcgtgctattgatgacatgtcaccaatgttttaaatagctgactaaggcatttagcggttagcttctcaaacagctatagcgggctaaatggagctatagcggctaaattgtacatgaaagcaaatagctagaacccttctcaaacagctatagcgggagatagcggcagctatagcgggagatttaaaaccctgcatgtcactccccatgggtatgtaaattatcatttatttatatactaagctaaactttgatcatgcttgaaaatatctaatgatcatatagtttgaacctaaatttgatataacataagtaaatatcataaaaccccatgtattatggtccaacttcataaactacgtggcttttggcacgtgatacattacccccaagtattatggtccaaaaattttacaaaatcatatggttaataatttgggttaattggatcatgccattataaaattgctagttttgataaatactattactatttatcttttttaagcataccactacatctgtctcaaaattggatacatgccatcatctacacttaatatacgttttgaatcattttacatgtgttgtattttagtatggaccaaaatacctccgcttactacatcgcaagcattgtggttccccatcctggatcagctcacgctagacctgctagcacaactccggtctgacttaacttcggctacacaagcacatgcccttgctttcaaaggcgagctaggacggggtcttgctatcaagccgattgccagagaggtggagcgactggagatggcccagccggccgaggaactccaagttctagtcgaagcaggagttgccagagagcttgagctagttgaggaattagcagttggctaatagcacagcgtggcgggattgggtccttgagcgcgttgccatcacctcacttgatgccactgacacctgcctgtttcaccgtcgctcatcatttccgtcagcttgccgttgagcttgtcatcgccgctggggccacgtgtggacccgccgtagaccaccgcgacacaaccctgccaccgtcgccgctttctttgccgttagcgccgccgctggaccatgtgtcaccgtcagacccgccgtccctgacgttgcaccttgtcatcggcgctctgccatactcgtcgtggggtagctgtgattgggggattgtgggtttttgaagctaggttgccggaattcggggttaaggttgaaagatgattggcatgtgtatttttgtccatacataaatacagagcacaaaatatgattcaaaaacacgtgttaagtgtaaaggatggtatgtatccaattttgaaagaattatagtggcatacttataaatagatgaatattaatggtatttttcaaatctagcaaattggagttgcattctagctaaaataaaaaatgcttaagttaaatggcgaaagctttttatacaatggatcaaacaatatgaaatttcacttttaattagagggagctcatagagaaagtatcgtcgtaaacaagcgtcttggtctatacgaagtttttttcgtgctctaaattgggatagaccgagtaataataagaaatttgggccaacaaaatagcaagttggcaactcgaaaagaataaacaccattgtttctgattttgccgtagccaaaaattgctggtatgatcgccaccacacatatcggaccgtccactttccatcggaaggcccagacttgcccacgcatgatcccaaggaacctaccctagtccaagcggcgacgatgaacttcaccacgggacaatcagtcgctactcgctggagcgaaccaagagcgccgacctgcaaatctccaaaaccccggtgtacggtcgcctcaaaccccgatctccccctccggccgccgtccgccgccgcggcactccggccggcgggatgagcccctccgggcggctccccgcccccttcgtcttccccctcgtcctgctgctgctcgctctggtaagctgatccccctccgaacctcgatctccggttagatctggtcatttcggcttctcgacggttttcgcccttcgattgactcccccttcgctgcaggtgccgtcaccggaggcggccgagtccacgccggggacgcggacgcgcaagatcggcggcgccgcctcggtgttctcgctcttcaacctcaagccccagaacaagttctggtcggagtccgtcatccgcacgggttcggttccgcgcttcgcagtggtttcgttgtttgcatgttgcatccctttttttggttggtggtatgctgacgggttatgtaatttttggtagaattcgatgacttggagggctcaacatcgcgggactccagcaagaaggcgctgctcaacttcactagagctggtagatttttgcgttgctcgtaaatttattgggcttttgaccatattgcaaacaaaccagattagcttacaattctcccctaaagttgtggtgttgcgtggccctttactagctgctgcagtgataaattttcttttggacgtgttcaagttgcaggacaatgtaaaactgctgattgaggctgatatgattttgtttataggcttctcattattgattcctgaagagtctggcataattaaattatgttagactactatatcattgctttgttgtactttctgacctgaccttgtatgtcatataatacttgagattactgtaactcttttgttttagccatgagggtgctgatgctatatttcaagaacctcgagttctttagtaagtataaatggaattattgatggaaggttaagagtggagagagaagtggttgttcctaaatagtcataatgcaacagaactaagaactaccttagaaaatgattttttttattgtgatatatccgataatcattgagcaggaatgtataaccaatgcaacttcaatatctgcaaacaaatcataccgatatcgttcagaaatggctatgttagagaggcaatatgcccgttattgaagcattactttgtggtaaggactgtatttttgcatgattagtttagtcaagaaacgactacttatttatgtactccctccgtcccaaaataactgaacctaggagtacatttgagacaattagttgcatgcgaaatgtgcatagtgttgaaaattttatggtgtactcatgaattacataagacgactgttcactactaaatctgtcatttttttttgccatctgttgttcttaggtaatattgccaactatatgagccttgcagaggttgattctatatatctttcagtacctgtaaacttcatctttataggatttgatggaaaaggaggtcacggtaagccgacaaactatccttatgcaatacttatgtcattctctatttcttatttgttcatacgaagtactaacaatatctttactttatttagagtttaaactgggacctgaagaactggaacgctggtttacaaaaatagatcacatatttgagcaaacaagaatacccccagttggcgaagttcttactccgttctacaagaccagtgttaagaaactaaagcaatatgaccttcctttaatcagccacataaatcacaagtacgttcctttacttctctgacaattgttcttacttggcccaatgttttcatctattttgtataaatatgccacacataattaaattttgcctttaatttacctcactttctgtgtggtgcagtttttccgtacatgcagtacacatgggtgaagatgtcatgtctgtttttcaacatgctataaaagttctatcccgtagagaagatatcacagattcaaggtcagatgctcttgagacacacatattgcttcaaacttaacaattattctcatccagcagtttgataaaatttggcaagtgcttcatcacataaaaaaactaagtgcaagtgtagcacaaaacagatatggtctttgcattcttttcctattacttggcaatgatgtttacaaaaaaatagatggttctgtttttagttttcacagatttctgcttgtttattactatctgttggaatccatacaagaggaacttgttaccatgcttgtaattgtttgtaaatttgtttgctttattgtaaaccagctaattaactatgaacagctactaggaggaccctttgtggtggcacttgttacttctataatgttaacttatgtttctcatcaatgtctgctgttggtaacagattcattttttgattatgttgtacagagaaggggcagaagcactttggcaggtggacagtgaccaaatggaacatttattttcaacacttgttgatcaccttcaaatacaagaggcatacaacatcttcatacttaatcccaaaaccattggcaagagtacccagtatggttatcggtgagtttgtcggcactgttaatacaatgcatataattaatgcaacaggagttagaaaaatgcacatttattatatttagcatggcaggatcatggactcgtaatataacaaaaacactacaggtcatttatggtagcttttgatagtaccaacatggctatgtttcattgcagtgctaccctgcatctgaatttcttcaagatattaatctagaacctattttgcactgctttttctaaaaaaagcccatctcattttgaatttagaatttgattttagaacaatttatgtgttttttttttttgcttttaaaaaaagcagtgccaagcggggcaataaattgaatggcaccaatgtagctagtcttaaatttatccattatcaatgttaaatcctttgctcaatataaatattgactaaggctccactaggtgctgaggtggattatgataatcctataacccaaatgaagatactgttgcattccacagaaatattgtgagaaacaacagctaaataacatattttgtctaatctaatctgatttctcaaaaataccacaacgattttctgatcagctcaagaaacaaacacatcatagtgcagtgcaccaattccaaacggtgtcatttacattcatggtctgttctctgttgattgttttatcacatggagatataatatgttctcaaattagacatgcgttttgatgggaacacctctgaggcacgtcacacaaacaaataaaaggagactcgtttttcttggctgaactgcctagaaatttagtttaatattagaacaaaaatggtgtcagttcttataaatatattttgtcgtgttgttgtatcatgcaaacgttacctctttctattcgatcctattttctgagtgtgagcttggagcaatttccataagtttaaatagcccgcaaatggagttctacaactagtcttatgaataattgtacagttttatttcttctgagaggaaataattcaaataattgtactgtaacactgttacttgataagtgatgttatggaattcatcaggtcaaatatccttggcctctattacatgtgaaattgtcaacaatggctgcatgaatatcagaaggacctctgtggtgttatatttgtatattccatatatattttacaatgtctacattactataaaacgagaacagtcaaatttgacctttgatattgttaaaattaccgaacattgcttattggaggatgaagttcctaagcacctatggtagctttcagctgaaaatgggtacatgtgcatcaaaataaagttatgtggtaacatgctaggcacatgcagaattatcctgtatacatagtaactcaaacattgcttaaaatggtggcatattgttactcttaggtgattttaataaccatctgtgtttacgtagtaagcaatcactttgttgttcatcagctaactgaattaattatttttcttccattttttttgatttgttcaatacagagtctgttggtaagatgagaaaaatctttgctgtagaaataaccactagtttgtacactgggttctggattgtttcatgcattttctcctgtgatgtttgattatttaagtgtaatttcaaagaaatcacctaactgtttttgtgttaattttttcatcttattttgtctatgttttcataggaaaggcttctctgagtctgagatcaacttactcagggaggtaagatgtggcatgctttatccattctgctatatatttaagaataccactgcttatatcttcttggtagcatagatgatagatctatttattgttgttgcaatttctggtaatatatctttggttggaagctggtggacctgctgataacaagagggcgccctcatatttttctttatacttatgcattttaaggagttattttcagttataactgtaattcactttatatttactgtcttcctttctgctctttccatttcgaagttgacatgaatacatgatgcttgactccagtttatcaggccttaaatatatgctgtgcagattatgttcttctgaatggatatgctgtgcagatttatgtttacctttctgtatatttccttagtaacattggatttgtttgttgagaaacactgtacttttgtggacaatgacatgttagtttttttttttcagaataagaccctgcaagctcggattcttcaatctaaaagtgacaagagactctatctgggtaattataatctttcctatgtatattattttggtttctaatttctattgcagtgaagatgaaaatacacatggagatagtctacttagttcatccagatattgccgtctgaagtttgtttatgtgtttgttaaaatgaaaagttattacttaagaatcaagaggtgcccctccataatattgtatacattatgaatattttggaaattttgacactgggtaaagtaggcccacataattaacagaactaatgatgtttacttaaaggttgttatggtattggttaagacgttcctttgcaatttccctagtttattgcttatttcggaaagtttaaactcgttactaatatatgtcactactatatttatctcccgcttagttccaggacttggcctaaatttccagaattgcaattagaagtgagcaattcacctgtttggatgtaataccagggactgcatgatgaagataaattttctgttgaaataaaataaccatgtgatataactatggtgatatttacaagaggaatttttagatttacatagtttaatattatggcaattggctgcagtttcaatagcagggggcagcggatgatgtatttttgtgggtgtatgccagagccgctaaagcaattagatcaaccgagtaactgacattggttattagtgatacattcctgccccctttaattattatatgctttatgcaaaggaagtgagagcacccatgggagcggataggttttggtgaaacatgggatctcttgaagctttctaagtttccattatcaattctcagtgaagcacacctgaacagccactgggattggcatagagttggatacgggaagaggtgttgcttgtgatccaaacatctgaattgtgttagatctatatgttgccgtatgtgtccacttcgagtagggtgttttctgcatattttcatgtagtgtgtgcagtgtgtgtatgctttgtgtattcacccattaggattcaagatctaattcctcaacgtgttgtcatgagcacatggtgggggttagtgtttccatcactttctccagccatcagtggcctctaccattggaaacctcaccgactggccagtctctgcaccttacatcagattgtagcgaggcgcagagccgtggcctggataacaaccggaattggtgaagaggtggcagctgatgaggggaaacactaaccccaatccatggctcatgatattgtgttgatgaattgaaccttgtattccaacgggtcatgggccaaagtataatacaacagggttgcaagcacatatgcacaaaacatgctgtactagaatataaatgcacagctatagatatagatatagatatagatatagcaaaaggggaaaaagattgcagccatctgtcatttgtccaatcatttacagtgcgcattagtgcatgtttagtgaatatatgtcgttattccacattacaaaacattctttggaagccctaggatgaactatttagggggcttaatcgatgtgcagtctgatttttgtgaactgtgcttccagttgagaaataatatgctgttattgaaatgtgtgtcgcgtgaacacaaggtagatccttttgcagtcacaacctccaacaaggacactgtttcaattcagttttttctctcactgtagctgtatgcacagttttgatatatttaactgcaagctcctttagttattttcctttcggtacttatctccatctctatgaatcagatattgaaaagggagtcaacagaagacccttgtatgagagtcatcctttatcatcattttcgtggacaacatctgacaatatggatatggtatttttaatgttacatttctgtattctttacaaaatcatttgggcctgcatcaacgtgttagtttttggtcattgtgttggccaatccaaacatttcatctgtgttcaaccttggccataactgacttagtggatgaagcttgaggctgcataacagtcaaccacaaagctaatcaaatattgacttgcttgctacttactccctccgtcccaaaataaatcaacttctagctacgaacctggatataggttatgtccagatttgtagccagaagttgatttattgtgaggcggagggagtagctaattagttcattagacggttacattgtttttccgtacatgcatgtattcagagttcttagacttttgatctagtgaattcaagaaagtgatatatactgcaactggtttatacaacttgccatgtattataaattgcacttgaattttagagttcaattttttggtttgaaggtctaaaaacaaatactttgttgccagtatagtatggaatagcaccaattttgacattgaactgcttggaattaggaactgcagtactgcacacatctttcttgacttcaaatactgacttttgttgacacttggaattaatgaatcaaaaaggatactgtattcccattggaattggttagaatgcatgatacgaagttatgaaggcaaacattcgtaaaaaaaattctaatgtataaaccaaacagaatgcatatattcaaattctttaacagggggattggtcaaagaagtgcaaggaagccttaagcaattttgagctgttgaaggaaggaaagagcaaagatgatattatttatgacaaagctgtccaggtgtcacattttccttggtacactaaatacactaaatgaaatatctctatatttgcatgtctaacatcatagtatcacacgctcttgtaggtattacatggcaaaaaggatgagttgcatgatatatttgagagtgcactcaagtccagtgatttgaagggtctgcatgctgaatgccttacagatatgtggattggcagagacaggtttgctgttgtttcatttcattaatagttaaaatcttagagttaggctagttcctgttcttctaaccaaactttattttcaggtttgctttcattgatctgagtgcagggccatttgcctggggccctgctgttggtggggacggtgttcgtactgaacttagtctacccaatgttgcaaagactgttggggctgttgcaggtcacttcatttttcttatcaggccttctctacctattcaaattcagttactgcctaatgttatacaatttggatggtgatgaactagggtgtatagtttgctgtgtcagtatatcttttgtttaaaaagtctcattagttttccttagtggcttgaacgaaactaattcatctctagaatcataagaagttttttagtagcccaggtcaaaagtgaagtttttgtaaatccttttttgactaaaatggttgtttcttgtgatggtttatgtcttctccctcattattcatgatgggacgctaccttagacaactcagtgtatgcatattggttttggaattagttttttgtagtagcaccaggcacttcaatctttcacctgtataattttatttattggcctaatttgcattttttttacttcttcaaatttaatactcattccatatgcacttggaatgcaaattcctagaacaaaaaagagaggacaatttagcattgatacaaagctagcatttttaatgggtcctgtgttgtgtcaatagattattcatggtaaccaaacatgggtagtcatgttattatattgactcattatactcaagcccgtttacattaatctaaattctatgctgatcgcacacaaaaagaaattgtatactcattatgtcattcaattatattatattaaggcattcttgctctacttgtttcaaacgtcataatttgttgattcaacaaacttgcagttatttttcttaaaatgttatgctcagttgcttcatagttcttaattgttaacgttgccatgaattaatgggatatggcaatcacattaaatgagcccatgccaatcttcttatgtttattgtaaacgaaaacctcataagttgtattcattacatcatgtttcaaattctgatagtcttatagaagtattgtcatcctgattattaatataagtgaaggacaatacctcaagaagacaacctatcaattgtgtggcagaatcatagttgttaaacctggactggtgatctaactgttgagtccatcagttcacctggtcagaccactggttcaccggttcggccactggttcaaaaggagataataaatatattttccttagagatttgctcaaaagggttaagtttaatctattttaccttccataccaaccaactgccttgcctggctgttttggtcctcgtgtatgcaacgagaggtccctagtttgatcccctccgcgcacctgtgggcaaattgtttagaaaatttgttctacccggtccaaagggcaaaaccgcctggtttaacccctttttccaggtcacatgctggtctttcaatcagaccagactggactaggctctggttccccttttttactgtcgaaccccggtccagtctggtttaataactaggggaagaatacatattcagactctgtaattattcagctaggaccaggccatctggtcatgttgtttgccctgttgttgctctgattataatcacaaggatccggtccttaattgaccggaacaagtcttgtatctttatcattacaaagcttttttattacaatttgaaatacttatacaaagatggtagtaaatgataaaaatcactgtaacttatccatcgcagatcttgttttattcataaaaacatcagtaacctacagatggattccactcacaaattggatttgtataagtcaaaagttacaggatcaaaaaagaaaagaaatattgaatacaccctgttaggttcctcagccatggctgtaaatacgactgttgatttatggtttgaacaatgcacatttacagcatgggatggtgggagggcagagggtttctcgagcatcggtaatgaggccaaattgctgtttaagctaaacaatgccctggactggttataggctcagtttggcattcagtgaattatcatattcttgtttggtgcaactactttagaagttttgttgtttggcaagcttgcttttcttttgatttaagttgcaaaagataatagtagtattactttccgaaaatgtggaacaaatgaagtgaacatgattgttgaataacatatgttctagccttatctagatcgccagaacaaactataatgattctaattttttattttccattgtatctggaggaataatcgcaacggagcacagcacaacaaccacaaactgggccttctgtatttctatgtgtactaacatatcaacgaatacttgattcatgtttttactacaatattttgggacttgctattttccttactgattcccaggcttccagcaaaccagtagggctagaaaccaaatgacctaattatctggaccagtatctggatgctgggctggcaaatcattgttttttcctttcaataattttctacatgcatacctgatacatatataacaccgaaacagtgctggttaaatgttaatatgtcaaagtaaacggtgacaagtagtattcatgaatgtatagagtagcatctgatactttagggtccaaacataacgttgtgtgggctgtgttgaccccttttggagaagcatggacaaaagctctggggatgcttcatgtgcatgagcatatcctacatgaggattagacacaagtgaatttgggtggtactagactgtctgtgtggggacatgtggatgtgggcctatgtggagcatgtagtgtggatttttgccatcacttatcttggtatgcagctttgacttttggggtggaacagggtgagtgtgactccatagtcaaattgctgggcggccagtggtggcttatatgacaccaagttagttccataatccatttatagtctggaatatggaacagttcataatgctggacagtccaaatgttgcaactgcatgttagcccttttggcagaggtggctgtccaagcatgttgctagctttttatgggctatgtgtgtaggctcatttctggaatatggaataattcataatggttgacagtccaaatattgcaactgcacgttagcccttttggcgaaagtggttgtccaagcatgttgctagtagctttttatgggatatgtgtgtaggctcattgctggtggggctaggctatatcagggctggcaagtgttgcaatttgacaatttatttctgtaacacttaacatgtatacaatgtgtttgctctgtactgagattctctttgcggcactaatttatgatagtcattcttatgcagaagttatagaagaagaggctgaagctaaattacaagatacaatcagagagagattctcatcttttggcgaggtatgctggatttctcttagaatgcactggatattattattttattcatttataaattattttttactactcaatctcataggctaaatgatggtacttattcttgtaatctccatgttaggcaccatagattttcaaggtgcacatgttgcttatgcaaattccttttctttctcttgcccctagctcttatttttgagggttgttgtaaagttcaattgagatcagtagagtgagagctttgagatcagaactgtagagaagagagggtgtagaaatattttggcagcttggaaatattttgctctgcattgtactcaatacatttttttgctagacctgttgacgattcaatatacaagtggtccataagtcattataactagcacgtcactggcaacgatattccacaacatagtggcatcccaagaccccactgatgttaatcactatagacaacaagtttcctcttgcaatcttgtttgctgtgtaactttcccttttgtttctgtatattgttatgacatcttgaactagctcttgacttgtttatctgatgccatttttggggttcagaattaccatgcagtagatatcctattggcagagattgatgtatacgaactttttgccttcaagcattgtgttggaagaagggtacagcttgccctttgcaaaggtacttttgatggccataaatttgggtgttccttttaattattcacattactacatagtggtagactttacttgtagttgatatttctaagttatatgcacttgagctactgtttgtaccatacatgaaagacattccttatgtttctctccaatcattacagcattcttcgctctttttttattgttttgtcctttgcccatgttttctcacaagttgtggatgccaataagctaataagtgttcttttctttgctgagatcttcagtttatggtagctgctggacagccttgtactgttcacgaatttgctttgctttatcagaaagaccttccctttaactagaaccttattttttcttcaaatgtagaacttgatgagagaatgcatgatctgaaaagtgaactggagggttacaatactggagattcggatgatattaataagaagaaagctcttgatgcattgaataggatggaaaagtggaacttatttaaagatgttccagaggttagctttgtccagcagcttctactacacaacataaaaggaacattgtaaaatcagtttctatagcaaaacattttccctaataagcaggataactaaaaacacatattcactgcgcatgcaattgctgaagtctaatatttatttgttaagttaacagaattttaatcatacttctaatgacgaagtccaatcacttgtgccaggaacatcatagttacactgtggctcgcgattcattcctcgcacaccttggttccgtgttatggggttctatgagtcatgtaattgctccttctgtttctcatagggctcaccattactatgataagttgtcgtttcaactgtactttgtgacacaagaggtaagttcaaggggcaacttttctgttgcttatattcgaatgcaatacagttatctcaacatgttttttaacgtaatgcagaaagtcaggaacatgaagcagtttcctgttaatgtaaaatcagtaacagagggccttagttctgtgttactacaattccagaagccaatgttcagtcaacgcatgtatgtaaccttcatcctgtaaattttggtttgtagtcctgcttaacttaccaggggtttaatattcatattggaagttatatgtgaaagtcatctgcacctggctagttttttattgtagcagtctgacttcctaattcctatcgtatgtctgcatgtccaatataatactggatcaaacttgtttagagcacaatattgatcataaaagtattagaaagattggaccacgccaatgatttgtatccatttagtgtttgattttttgatacttatgctgtgcactgagccactgaccctgtgggtaaatgacctaaagtctgtatggtggtggtcaatatggctatgattcacgaaggcagaaggaacagataatcacagtgcaggggatgggtgcatctgaaatcaggagagattagaactgagggagttcagatatcacttgaaagctgtaccctttataggccctaataaacaatatctaatacatggaaatcaactggcaagtcttatgtctaagtggctcaagtccaaagcaaggagctaacacgaaactcgaaactcactgttgctgagctgttgccttcgacaccctggccacatgagcgaccgcagacaactcagttctctacccaaacaagccaatgggcggtggattgggattgtaattctttggtttcgtttggaagatgaaaacagttacttagtatgctttctattagtgactggtctaatcatgtaaagtgctctatcttccatgattataattcttgtagaattttaggagtgacctaagcaaaattacttgcatattcaataaacatgtgtgcgtgagtagtttgtattcaataagccctagtctatcttgaataatttcataaaggcttatagatgtaagctaaggacaattctatctattggatgaatgatactttatttctgttcgacatatacaagttactcatatacacactacaagttattttgtataagttgtctgatggatttgttctatcagtcttttaccaacattactagtaattcttacattgcaaagttgcaagttgttatggatacccttacaggttgctaactaatttattaatcatatgtacttagttcagttagttacaaatcaatcatctgcagtggcggagccaggatttagacttgggattgggatgggcctatgagtcttggacggggcctaatacactattacttaagttaattacctaattagttaggtgattatgtgtgaaaagaaatcgttgtagggggccaggccactggccgtcccccctgtctctgacatggatcttctgtgcatagaatttagttgcgtcatttaatttagtagaaccttgtaagcttattatagagtgcaatacctagaagggagttaaatgtacttacaagatatattatatcctctataaactaaatatgtaattattttttccagtctaatttgttatggttgttgatatataggttgtcattatcagaggatcctgccttgatgatggcattttcaatggcacgtcgtgcagctgcagtcccacttctgttggttaatggtacctataagtcaactgtccatacatatcttgattctgccattctccaacatcagctacagaggttaagcgagcacaactcgctcaaaggtatgcacattttagtcgcctgggagaggctcaattagcgagtcatcttagttgcctgggagatttggaaacatagaaatgattgtgttttccatggagctacccctagtgtgtctgtggtaaatccaagctgtagttaacgagggtgcactttggtgctgggcaggagattcaaagctccaagagctgtttgctaaagcaatagctcctgtaccttaagcatgtgtttggtttggggaccaagtgggatgggttagacctatcctagtttttttgggatgggatggttccagttgtttgttttgtttatggtatgggatggttctagtattttgtttggtagaagggattgaggtgggatgggatggacaactttgcattgaccgttagtgccgtctggctcccagcggctggggtgcagtgagcggcgagcgtgggggcggaggagctcatcgccgcgagtggcacacaggcaaaagagtggtggctagaggcaagggagtcgacggcgttcgtggaggtggcggcctgtcacagcggaggagaggccgcggtgtcttggagaagcgctggcgctcacggagttggcgactggcgcagacgagcgccagcggatgaagaggcgagctgatgtcgtgtgcttcgtccaggttggacgagctcgtccggccgattttgcttgatggcttggtcccggatctgagaggaatattcctctccagggagtccctaaaccaacccaactcactcatccctaaaccaaacactcctaaaaatggcaccatcccatcccatccttgcaaccaaacacatcctaggaagtcgaagttcgtgtttggtgttgtgtgtgcgtgcgtacatgtgtgtgtgtgtgtgtgtgtgtgttttttgtgttttgtaagaccttggtgggtgggtgctggggttggctaattccttcacctctcgcctcttttttttcctgcttaattaaacgatacgcaaatctcattcgtattcgtaaaaaaaggtgtacacattttctttgcttttcatgatataggaacagaagacatcaagttctgcatagtagaagatgctaaatcatatgacattacaatttatggaccaatgaacataaaatgctaaatattttgtattgaacataattttaatgctataaaaattccaataagaatcatgatttttgtacactcaacattatacagactggcaaaaatctgatatcagatttatcctatttgtcaggatctatacaacacaaattgtgcatctattccatgatgaatagttttgattgtttttttttattgagaatggaaatttgatggtttgtacctttatatgtactatgatcatgatttgtttttgaacgttcgaatcacttaaaacgtggtgaatttgactgaagacacaggtaccctaggacagaaaaactgcattctttatgagcaactagtgacatgcccgtgccttcaacgggatgttaaggaacaaggacgaatgcctgtgcttagcaacgggatgatggttttacggggttaagtttttcctatccagttcttttagttggtcgtaaaaacacaggattttggtggggtggttttttgaggtagggtggttttcttacgtggaggaagaggtggtttttgggtggagtgtttttttgaggcagggtggtctttttacatggggggagccagagaggacaactctttttttacagtagagagattatgaacaaaaaatatgtgcaaggaggccaagattttacagtagagggttgaatgatattgatcgaggctaaaatggcagtggggaagttcatgggtcatggctgagctgtttaatctattattgctaaatattacctatattgtgtatttgttatttgttgatatcagtaggcctgcaaacacaaacctttgacagctactttctagtgcaaaagtgttaacaatataatcagttgaaatttgatggcatgttactaatgccatttctgtgtgacagtataacattacatttacttaggtacgttagtggttaatatcgtgagcaagtttgtaagctagatttctcttctatatgcaggaggacactcaaatcacaggtcaacattggagattccaatattctggttcatacatagtgaacccctattattggataaacattatcaagccaaatctctttcaaacatggttgtagtagttcaatcagaagttgattcttgggaaagccacttgcagtgcaatgggaggtcaatcttatgggatttgaggtaggattgccatatcatacacatgatttatttggtttccagttggttaccttcgcaatctattatacagtcttgtctttcatgtaccaaattgtaaccattcttgattttagaaaaaaagaaacactgggctcgatcacaggccaactttaaattgaaatttaatgttttgaaaatttatgttcatccgtttgaaaatggaccagaatctgacatgttcaactgaagcggtgaccatatttagggttcattcagtttatgcacacatgtggacccctcatagttagttgcgataacctgactttggcccagtccttttcaaatttactggattgttgaaacagattattggctctactcttcgaaaaatacattttctcagaaaacttttttctactatattgcttagaccacttattttaagttcctttttaagtttatttatcaaaatattttatttatctctataatcaagtagataatctgcagcaacaatctgctcaataatctgattcaaactgagccttgagcattgtcgagcagtgagaataaggctacataatttaatgaacacaagttaagaaaaaaatggtggctagaccagtttaacttgggcattccaaacctgaagaagagaacgcttagaccacttgtttggtactttgtttcattagcatcggtcaaccttttgacatcaacaccacaccagtttaatcacaagattgtacagagccaacttgctgcagaatgtggccatgccaatatttgggctttggcaggtcttaatatccatcctcaaaaactaccttttttcctcctgattttgagtttgattgaactgcattaatgctattaataaactgacttgcaggagaccagtaaaagctgccattgctgcaactgccgagtatgtatctggtttacttccttcacatctggcttatagcccagctcatgaaactgcaacagaggtttgtcatacgactatacctattagtcttcctatttgttaactgatgggcaggatatgtttcttttctggaaccagataaaattatcaatatttttacattttttcatttgcccttcgcaaaagaaagcatgcagtcaaatttctatattttttttaccagtatatatgaaagactttaacacttatcatgtggtatacttagatatgctgtactgtagattttcttcaacatgttcatataaaacttagtgatcaaagttatattttggagattctgccgatgtacagaaaactgcagtcttaaacagattgagtgatagtttagtctgctactcattacattttctgttttctaataattctaggactggacttggtctgtgggctgtaatcccttatctattacttcaaaaggctggcaactttcggagtttcaacgtgatgttattgctcgtaactacatcattactgcagtggaggaatctatacaaatcatcaattcagcaattcaacaattgattacagaaaggacaagtatcctaataattttgctttttttaatctaatacgctcgagagctgcatatcatttcattaaagaagagaaccgtatgagtctggaaaccttacaaaaaaatagcaacaaacaattgcgccacggactattttgctggacaaaactaagaacaaaattttgctgtttcattattcaaattccggacaatttaatgtttgttgggaatcatgttgttttttttgaaaaagataacagagatggatcaactttatgtatgtgtcatgtttccatgtgaactagctgaatctttgaagagcatgacttttacactagttgatttttacattccaaaatttttactatgtaaagacatcagctagtagataattaaaatgacccctatgtcgatagtcctccgactggtatttatagtgtaggttgtgggttgaacctcaaccaagaacaggttaatgtcttctgtaaaaagttgggttttaccattaagtagatgaaagccacaagcctattagttcatttgtattgcttgctctcaaaacttttcttgaagggccttaacaatatttaggtgaacgaggctttaaacttttcaaggctcaggagagagtgctggttgaaaagtataattctgttgttagcttgtggagaagggtaagtcgcttcttgatgtgcctttttttttcctttgttttacataaaaatattatggcacttatgtttggtttgtatttaggtttctgctatgtccaaaggattacgatatggtgatgctgtaaagcttacttcaatgctcgaggaggcttctcatgggtcagtggttcttatgctgcgtacaggaaccttttttttttcttgcaatccattttatttcttgaccttgagattttttttaaagcgccgaataaaaatatgaagggattatagcttaatgttctacttctgtttatttattattcatttgatgaatgggccaatatcctcaactacaataccagcctcattagttgtctggtattctggattctcatgttgctttctctttccagatttgctaatgctgttaactcaaccatttcaagtctacaccctgtgcaatgtactcgtgaaagaaaagtcgacgtgcagctagacttgacaacgattcctgctttcttggctgtttttctgctgctctggtttcttctacgaccaaggcggccaaagcccaagatcaactaaaccagctaattttcagtgtggctgttgtatgctaataccgaggacgtgaatattgtgaatatgcacacatgtcatgggggacagctgctgctggagcgcagtaagtcctagattcaaaggggaaatgacaaggccgtaaacgacttgtgccaaacggtgtcactgtttagagaaaatagaactgaaattttgtttccgaaactggtgcaaggtttgaagttgccacatcctgagcagacttgtgtagtgcattgttggacttgttctggatggacgttgatatgaatctagttgagtaagcactgtagagttgtagactgagccgcttactgtgtagagaactcaatactgtttttgttttccagagaacagcgggagaacatccctaccaatcttgtcaattgactcaattctattttggtttggttcttgagacggaacatttcggatgtgggtccaatcgctgacacattaacctggactcgcatatcagcgtcagccactaaggctgagttcggatgggggagatgggaacccaacttctgtgtacgaaaaacggagcagtccattaacgcgtgattaattaaatattagctattttttttaaaaaaagggattaatttgatttttttaagtaacttttgtatagaaacttttttaaaaaaatgcaccgtttaacagtttgaaaagcgtgcacgtggaaaacgaggggaaggggatgggaaaaggtgcatgcgaacacagcctaaaccagcagtactgcatacctgtcgagcattaacaaacaatccgtgggttaatagaataatatgaatctattagagcaaggtcaatagtaggtcaatagtatagctgtatagccagttaatggctccaaaaaatttcatgtcacctagagccatagctagacacatgatacaataaaaagctgcagtgatttctgaatattactttccattttatttattgcattgcatgttcttcatttgcatatagcaaggccaactgctcatctatttgctagctagggctgtttggatcagggactaaaattttagtccctgtcacatcggatatttgacactaattagaagtattaaatatagactaatgacaaaaccaatttcacaaacctggactaattcgcgagatgaatctattaagtctaattaatccataattagtttatgtgatactacagtaaacatgtgctaattatgtattaattaggcttaaaaaatttgtctcgtggttagctctcatttatgcaattagttttattattagtttacgtttaatacttctaattagtgtccaaacatctgatgtgacagggatttagtccctatatccaaacaccacctagtcgctagctgaatctctctctctctcttcaacttttgctttcaacttagttttttaagccacggaggacagctatcgccggcttgaagcatctattgcacctgctcttgttatatagaattccctccagttattaatatatacatttttacactaaaattagtgttaaaaggtaatatattaatgaccaaatggagtaccttattgaatttcatttgtaatcatgtttaaaaaatataagaattcataacagatatagtttaaggcttttaaaagtccacatatagcttaatatacaaaagggataaatctacttgacccctaactactgtgtttagaaacaaccctcaactctaaaattgggtattgaacatgtctcaactcttaaaattgattaatttgcccccttgttgttggagcccaccctctcagcgaatgttatcttcccccttgttgattaattgagcagtactgccactctacactcttttctcttctcctcctaataccactaggcatcgggctagatgtggtggcaatggttgtcatcattgcgccatcagatgtcagctcgatgaggcgccacaacccttggcgctaagacgttagacctcaacgccaagattcgtggctgaagttaaggtccatttctctttagtgtttttatggtctatttgtgaaacaagttttataaaagggctaaagtgttaaatttcacaagtgaagtaatgagcacaacttcggccttgtttaaagctaagacaaatcaagattaagtgcgggtacgcaaaataagacaagtcgttagtgcatgattaattgagttttaattattttaaacttgaaaaatggatttatcctattttttaaagcaatttatgtaaagaaagtttccgcatgaaacacctttcatcaataaaccaaagatagaatctgcatagtaataaaaaaaaacaatttggttcttgggggcaagttcaggtgacccacaggtctcttttccatcccatcccgaagccctagaaattgtcaagccccaagggacataagagcaagtttaatagtatagtcaactactggctccaaatcatacaatagctacctataaatatatactacacaattaatacctggtcccacctagcatacacacatgcatcttggagtccgtgctccagcttctctctcctcttttatcatctcaaaatgtgtttatagttggcttatagcctgctattgtacctgttctaagagcttacatagtgtggggatgtggggaatggtattgcctcaccatgttggatccacgtctccacattagtcaaggttgtgcacctgcagagccacgcgtgtcttctgtgggggcacgagcaccttatcaggcagaggctgctagcgcatggaggcacgaaacaagccatgttgagtgaggccgcgcctcacggcacggtgcttcatccttcccccaccaccccacccctagcacagagcacccaacaaatagctgatgtagttggaaaaggaggggaaaatgagcacaacgtgggggtagaagcgaacttaccgcaacagtgcgtgaagctgatcaacacgaacccgttaacgacgaccaaattcgcgtcaacagaaccgtccccgacccaccactctgccgccggggttgccgctatcaggtcctcgcaccaagcagatccgtcatgtcgccatcaccacaagcggatccaccactgggcattggcatcaaataggaagggcttcacccatttcttaaggggtgatagcctcaaagctcgttgactgtgctgccttgatatgtgccaccttgtaggttaggtgcatgatatgaaataaaatagggtaattagacatgtaccgtgtattctaggaataaaaaaaagtaaattacatattaattgagtaataataagaattgtgacttgaacactcctctaaacccgaggaagatagtggcgttgtggcaatgcccaaagttttcatgtcccgtgatgaccaaacaattgtccaattgattggcacgctctgaccctgatcaattgatcgatgccataacctatgttgtgaatatattctctctgggcaaatgcagttcggtgaacaacgaatactgtagcccacccatgggcgcgggtctcctaggaaagtgggctgtctcgctgctgtagcaggcaggcaaacctggccgtggagagcaacatgatccccatgacccttttacagcttgcaggttggtgaggttacaacttgcggagctgctcgttggatggtgcattgatcgaatgcctgccattcttgttgtggcctcaattagaatttggcatgtgtgactcatgagagctatgtgcacatgtttagtaccgccttgctggtttagcaagggtggaaccaacttaaaaggcctcacatccctccaatcaaaccactcctgggttaacccttttacacgaaacgagaacataagtgtaagtgggatggtatgtgtaaatgggcccgctagttggatggcctagttacgcggttttggagggagggttgttacagggcacctcccctgcgtgatcccgaaccccatggccacctccgtgatgcttggcaccaggttaggtgatcaaatcaaaatggagccatgcattgataaatagcccagtgtcatagcattgccatctcggcgaccaaatgtggataaatcagcgaaacgaacgggtggcgccacgcgcggctgagtctcttgaggaggttagaacgttcgtcccttcatatttgtcggagggcggactcctcgagcgggggaccgtgggaccccctttccggttcggaccggggacacgggtgaaggatcgagatccaatgagggaatgagagggggtcaggcccctcgggagcgatgggagatgcagagggtttagacaggtttgggccgctatgggagcgtaacaccctacttctgtgtatagttgatttcgttgggagaatacaagtgctttatgcttattttgggatttgtcctctctccactggggcatggacctctttttatatcttaaggggttactacaaaggtccaagccctagcttcaacggcaaggaaaacattctttacaggcaattaatacttatcctgtcttccgacgtgcggagccacgcgcgccttaccatagcatggacccttcccatcacgccgagtgacacgggcgcacacccgtgtcattccttcttaattaacgacgacttccgcccgtcagttcccaccggtcggcggtgatctcttcgaagggatcagtataaggggatttggtctgggttcaaatgagaggcaaaaagcccctcattaatggcgattagacggagcgtggcgcagaccacgctacctaacagcagcaggcgcacgcgcagggcgccttacccgccgtcacatcaatcattccggcttcaattggtagtgcgcctgcacgtcacatttaatgcaacgtgccgcgcttactattgacggtcgttatcgatcagttttgaccgtcaatattaccaaaatagaggagaactagtgatgcttgcaatgcataaatatgttagaataataatattccactagtagtaggtatactaatattttgcagagaatgacactaaagtggaggagaatcgacatcaacatagaagataaatcaatcggacgatgtcgagaatcagagttatgaatgaatgggccaagaacgcagaattgacacgatgaattatgccaaaattcacaagtctacgaagtgaagcagcggaggaggccaccagccaaaatgtgggctggttgggccgactcttg

SEQ ID NO: 74617 - DNA, 8448 bp, Oryza sativa
atctcataatgatattaatgtccttcaaaggtcaccatggtttgcaaagctagctgaagggcaggctcctaaagttaatttcagtatcaatgggcatgactacactatggggtactatcttgcatatggtatttatccttcatgggcaacacttgtgaagagcattaagctgccacaaggcaataagagaaaatattttaccaaagcacaagaagccaataggaaggacgttgaacaagtgtttggagtgcttcaagctcgctttgctattgtccgtggaccagctcgtttttggaaagcaattactctgaattagataatgagagcttgtataatcatgaataacatgattgtggaggatgagcacgatggtgattttgatttagtttatgatgagatgggagaacaggtgggtggttcccaagaacatacgcccaactttaatgattttattagtcagtacgaaaaaattcaagacaaggaagttcacaaccaactaagagaagacctcatcgaacatttgtggaatcatcatgcagatcaatattaagtttagattttatattattgaataatgtcagagattgtaataattagatattcaccgtgtgttttgtaattagtacaatacattgaggccatgaattttctgcatatttcttttgttttcaaatattcacaggcatatttcagaatcattacgcactgatgtttttgtttatttatttgcaaaagacagcagcatcaagcttaattatgtggaatgtgaatagcacttgttgtaattttttagcacctgtaatcaggagcagcatcagagaaagcagagacagacaaagaaggtcccatggtctgaaactctgaactttaatctgaaacactcattaagaggctacctagcatccattttattaaggaagtctgataatgtatatgttttttaaggttagaggagtttattagcacagtgatgttaacatcttattttaattgcagaaaatttattagtgagaataggtgtggagattatgggtaccccatacccacacggcatggttatccgactagtcaaaggggatagcttatatatatggaatatgtaacagattatgacttgggtattacgtttccttgtatattacggaacggcctaaagtcctggtttgataagattataaagtagagttagaaaaccgataccgtattggataaggtttctatcttgtaatcctgccccccatcctatataaggtgggcaggaggccctctagggggcatgagacaacctgatcgtcagatcaatacacaccccggcggattcaaatccccaaacaggagtagggtattacctctcatcgagagggcctgaacctgtctaaatcctttgcctccgcatccatccacttttaggtctcgtgcgctacccccttttcatattgtcgaattcatgtttcgacagttggcgcaccaggtaggggttgcgttgagttacctgtcgacaagtgcgatggaatcaacttcatgagtcaccggcttcatcttcgcttcgggagttttttcgccgaccacttcaacatgctcttgctcttcgactcggatccaatctagccgggaagatcagtctcgacatgttcgatggattcaatttccaccgccgtcaatacctccatggaagacctcagttcaagatcaaataccatatatacatgccctgccgctgtcggaatccgatcattgccaggacgagtcccacgccaattatccgttcggcctgatttcaactcagctgcgattagccagacgcagaacgacggaaggcagtcatctatccaataggaatagtaatcatgtgcgatttcgccatgtatacaatatacatgcatatagcagaatccactgacaacagattgatctggaattataattagcagactttgcagcacgtgtctccaattactgaagcaccagcatatatactatcgttattcccaggcagatttgtttgttttgggagcttggactttgccgccatgcataggcaacgttgtctaatatggagtaattaagattcatgcaactactacatgatttaatcaccggatggcatcgatcaatccacctctgtccgagctgtacacgagtgcctgatctaaatgcacagaggcacgtcgccaggaggacgagtcggcagagtcaaaccaacgagctgggcagacgtcgcatgctaccacatggatagaccggcaggagtgcgaagctgtttctccgttccctgacttcatcgttgccggcttgcctccgccatcatcaccgccggcctgcctccgtcgccgccgaccggtgtcctcgcctatacggttggttggtcacaccaccgttcatgggcgtccacatcttcactgaccggccgcctcgtccgctgccgactggtgtttccgcctgcacggctggcctattatatgctgccgttgttgggcgtccgtcgactggtgtcctcgcctatacggttggttggtcacaccaccgtacatgggcgtctacgtcttcaccgaccggctggccttcgtcgccgccgactggtgtttccgcctgcacggctggcctattatgccgccgctgttgggcgtctacgacttcaccgccggcctgcctctgccgccactgactggtgttttcgcctatacggttggcggacttcgccgccgttaatgggcttcatcatctacaccactggcttggttccactggcgccgactgttgtttttgtcaccactgatggactgcttcattcccacatcggctacttctgttgtcaccgagggaatacgacaaagcttagtcatcatttattttattctttatatgatattttaccttttcctttgcctcactacatcaactggttcgctgttgactagtgagtcgggggctacaaatgttatatcatattttttaaacaattttcataatatttatcttgattgcttgcgacttattctgagtacaaaagtgcctatcgagttatggagttccatcttcctatgctttccgtttggtttgccaatggatagttgcctttgggccgattcctagcacccgggggcttgttggatggaccgaataacgcaaggtgctaagcattattcggaataaatcaaaagcatagagataagataatttattttctgctcttaataattgcaaaagtacccgagtagtaaactccgacccgtgaaactttattccattaatgacgaactcatgtcactcatatgcatgtttgggaagtgcttaggccgactcccggtgcttggtagctatgactagtcgggcagagtgtttaaacgtaatgagtcatctgtttggggaaatcaaaattgacaagagaagaaatacatatttataaatattttaaaatacttgcatttttctcgagtattatatttacatcagatactactcatcctatctgtttgttctgtaggatccagatccagatatgcataaaagggattcacggctttaagcttatctcctacgcttcaggaatggatcagtcagaacatcaccatcggcttgcgttcgtctgccgccggctggtgtctccgcctgcacggctggccaattatgccgccgttgttgggcgtctacgtcttcaccgaccggccgcctcgtctgccgccgactggtgtctccccctgcacggctggcctattatgccgccgttgttgggcgtctacgtcttcaccgaccggccacctcgtctgccaccgactggtgtctccgcctgcacggctggcctattatgccgccgtctgttgggcgtctacgtcttcaccgaccggccgcctcgtctgccgccgactggtgtctccgcctgcacggctggcctattatgctgccgtctgttgggcgtctacgtcttcacctaccggccgcctcgtctgccgccgactggtgtctccgcctgcacggctggcctattatgccgccgttgttgggcgtctacgtcttcaccgaccggtcacctcgtctgccgccgactggtgtctccgcctgcacggctggcccattatgccgccgtctgttgggcgtctacgtcttcaccgaccggccgcctcgtctgccgccgactggtgtctccgcctgcacggctggcctattatgccgccgtctattgggcgtctacgtcttcaccaaccggccgcctcgtctgccgccgactggtgtcttcgcctgcacggctggcctattatgccgccgtctgttgggcgtctacgtcttcactgaccggcttgccttcgccgccgccggtgtctccgcctacacggctggcctattatgccgccgtctgttgggcgtctacgtcttcaccgaccgaccgcctcgtcgtctccgactgattatttcgtcaccaaggctacaaaactctgtcgctattgctgggtgcattcatcttcactgttagttgatctgactgccgccgactggtttcttcgcttccatgccgattgcatcagctatcaccgatggataatttcaactactccaaaaggacaagctatatactcaggggcttactacctcaaacaccagtatcataccttcaatttggacttgttccggatacatgcaacatgaatttaatgatcatgggtctattttctatgctcaaagactggactatttattattccccataagagttatcaaccgaatacttgcgccggtcgggattcaattattatatctattttggagtatcccataagggataatcattcagatcagaagaacaacacttcatgtttacctatgcaaactaacaatttctcacactttattttaggggtccaccaaaaaaaaggctgaagaaagcatcttccagtaacatagtgactagcattgttgtggccactcctggatcaggcatggtattcccacacaatgaggtggcggccagtgctacacagaagccaaagagagtgaaaaaagccgccaaaaagaaggggccaccaacatcaagaagtactgacaattcgatgacgagcaggtatgatctttcacttttcctaatcttgtcatttccaacctcactgatctctttttcttgctttcacacaaggtctataactggatccaataacccctttgctctccaaattgagcaccctccagttgttcatgatgacattgcatcctatgaagtctctccacagacagtggacacaccaaggaagaagcaagccgtcaagaagtgtacaccaaggagggctcctattgaagtggctaacccatccagcccagcttctaatactagaagcaagaagaaactccagcttgaataaattatgtggaggaactactacttttgatgtaatttaagacatgtatggtttggtgtgatgaaaactagtgaactactactttttatgtgtggacttagtgtgatgaaaactagtgaacttgttgctgtgaacttggtgctatgaacttgttgctatgaacttgttgctatggatgcaatggtcatgtatggtttgatatgaacttgtatggtttgatatgaacttgttactatgggtgcaatggtcatgcccttgttttgtccatgtgatatgttgttatttgtcggtatgtaatggtcatgcacctgttttttcctttttaaaaaaattatttccgatttttccttatattttccaccattttataatttttcccacattttcctaaattttcccggatttttaaacattttcaaaatttattctcactttttctgatttttacctttttttaaaaaatattttccatttttttgattttaacgccttttctaaattatttttcacttttctgattttttttaaacccattattgtacacaagggcaaaactgtctttacacagcccctaacacctctgttatgtctccatccatccaaaatagtacacgggtcaataaaaattgggctcacggcgtataagtaacttcaattttttttatggtgcacacttaagcagcaactttgaacaggagtaaaaactccgggacgagcgcgtcttgagaaaatgagaaagaaacggaggaaaaaaaaaaggaaggatcggcgcatggcatttctctcccaggcgctgccacaaacgtctccgtgcccttccgccgccgatcccgagagaaggccccgaccagagcgcctcccccgcgccccaaggccgaaaccctagccgcgccacctcccaggtccccacgatcgccccggaaggcggtggtggcgacggtgggtgggggaggaggacggaaggcacacaggccggtggtgccacggcgaccaccatgtccgctgtagtgtgcggcaagcgggcttcctcttccttcttcgaggatctcacccacccgaccggcggctcccctcccgctgccaagcgtacccgctgcgggggcgcctttttcccgccgccgccgccgcccacctggccacgcggcgtcaccaagaacgaccttgtcgcccgactctctacgcaattccctgccatgagcctcgaggtgagcctcctcccaccctcctccttccccctctttggggtgcaaattcggatgcggatatgcaggagaaccttgtagtgggagaggtaattttttgttgagggatttttttggatgtagaaaaatgcagtcttgttgagattggtagctgctgtacccatccgcgatggaagaagcggtcttctcattgggcctcaattgtccgttgaatttgatgaagtttacttactttgattttgtatcttcatttaccttgttatcttattctctaccttgcacttttcgtttctgcactgaactaggaaataccatagatagatggaatgatagttcaatcctgaactggtttaggtctcatgtgttaggagaggaaaggcctttttgattcttgcaggactttgggtttggtgtgaccatgacactgaatgatttgacacaggtgaagtctagacagctgcaaatttaatcactagaagtgcaagccaaccacataaacatttgtgctttgcctggaaggatgttcattgacaatccaacttgatgactcgtgagaggattttgattaccaaactgcttaggaagttttgagcactgtaatggagatgatatctatatctcattccacttctttagatttagattagcataatgtaaaataccataagcttatatccaattagattgtgctaaattctacattgattgattggtaattttggttaggaaagagtttgtattgatggatgcatgacttccttggattattcttctaatttgctattttgcaaaagattttttcttgtattttcatgagaagctctggtgcatgtgaatgtggaagttttgcgaaaatcctgatacaagtcattgttgctctcagatgattgaaaaggctctggacaaatctggaaataatgtggattcagcaataaggagtttgcttaatctacatttggaatctgtgcaaaataacagtggcgttgcatttgaacccatacaagaaaccactgaggttcaggtgtctgctgaaggtaattttcaactgggtactttaatcatctgtggcatattgaatatcaactatcttctttatggttctgtttggcattgaggtgtattatgataatcttgtttggtgcaactacttctaggcatttttgttgtttggcaactgattttcttttaaattaagttaccgcaataatatcattgcattctgaaaatatggaacaattgatagttacaacagttaaataatgtatttttctaaccttaatttgatctgtaaaacaaattacaacaattataaattatgtttctacagaaacttaataataagcacatcacaagtaaacaactgcaaactgagcctgttgctcctttgtttgtgctttgaattctattttatggcatagaagcagctgaaggtcatgagaatctaaaagcgagaaaatcctgtttaccaacctaatttttggttgtgctggacctaaagaattttttagtaaatcatctttaataccccttcccccgcctacacacacacatgcacacccacgaacacgcatacactcaaatgacagtttctactcatcgagaaggtttgtatttgtaacatcaaactttctataaggaaacatgtaatgttggctaaatttgtttgtacattagtagtacattggtttataaaaggagcacagtatcaaatctgtggagagttgcaatatgtagacatgaacacatgttttacattaatacaatgaacactggccaatctggagacatgagcacttgaatatcaaagtaacatgaaaacacaagaatacatgaacaatcacggtaaatcatgatattcatgaacagaagaaaataccaacagatctagagtcttgaacaat

SEQ ID NO: 74618 - DNA, 16105 bp, Oryza sativa
  unsure (1)..(16105): unsure at all n locations
tgtctgactgtattttagtatggcattaagaaagtgatttactttgcttgctgtttgtgctatctgcctgtgtgatactgtcatgctcaggtctgttagatccgaattttgtttggtgctgtataccatggtaggtgtggcttgtagactgacatgtgcactatgttatatctgtatgttcacatgtttgctactttcattcatcatttgcctctagtgacctttttagtcgcccatcaccattgaatttcatgactattttgttggcagttgtttcagatggtaacgagattggtgcaccttcagaaagtgccccttgtcctgagaactttccgtcaaatggctcagaatgggtcgagctacttgtgaatgagatgacaactgcttctaacatggatgatgcaaagtctcgtgccaccagagtgctggaggcttttgagaaggctgtggtgtctcatgtcaatgctcaaggacctcatgattttcaaaaggttgttggaatatcctcctgttaactttacatgattctatcaattgttgttcaaaatcatagctatagtagatgtgttgcaacaaatctataagatcagtttacagccgtaagttgcatttggtgcatgcagtctatttgactatttatttaaattacttgaggaattttcctttatcaccataatttcctgaggtaacatggcagtcaaacaggaaaatgcagtgcttaaggggcaaatggaatcgcttacaagagaaaacaccattctgaagagagcatttgcgatacagcatgagcggcaggactatgatgcgaagaatcaagaactacaggatgagaaacagcgcattgctgagttccaagaacaagttagaaaccttgaggtatgtcagatttaattaccttctccatccactgatcgacccattactttcaatttcagtcccctctatatttcttggaattctttatttcattgagggattccgtggtagaattaagtagagtttctagatgactgctgcaagtcatagttttgtgacgttactgataatagcactgtcataaatttgtagttttcttaatattatgccatacccaaattattggcatggtagaatatgctgccacaccacatgggttagaaacggtgggatagcaaggattagggacactggttgctgttctaaaaataagttattggttggtatgttaagaaggttaaaaaaaaaatcctgcccgtattgtgaaaattagggaaacagataataaacattgtcattaagaaataataggctgccttttctcattgaatccgtggaaaatcctctcaaaagaatccatgggaaattaaagagaagctaacctttttttttcccttttttttttttgcagcttaataactacagattgagcatgctccttaggcaagctcagcagggcagctcaattccagggcgctttaatccggatgttttctaagaggaagtgcaaattccacctttcctttgcatacgagttcggaggcttaagatgttactatagcatgcaaatcttaagcttaaatttttgttgtggacgtgtaagtttatgttccgctgtagtatgggcagcggaatattatgttttataaatgatgggcaattcatggtcaatagataaattctaggacttattttatcgaatgacttatttttcttaccgatcacatttcaaccactaatagttcagtatccagcaacttttaggctgaacggttcccaactcacaccgaatttttttaatataataattaataaccccataattaaatatctggtaaatcaaagttgagatttttaataataggatggacgctgaagaatacagcgtccagatgtggacgctgtttgtaaaatcgtccagagctggacgctctggctaactacgtctagcatatgaccggtcgcctaggtcggtccggtggtcccagtacgaacagaagcaaaatgaaaaagagaaaaaaaaaagaaaaacgggaagaggaaccgttttggcgacgccactgcccggaaagtcctccacgcgcggaacagcgtcgcccatccatcagccaccgctgcgcgtccaatcgcatgaaggggccggccgtcgcagccctcgttctcggcagcgccgcccatccgccgccactgctctcctccacacgcgagggcgacgcccgcccgtccaccaacgccgcctgcctcatacgcttgtgggggttcgccggcactgccacttgcccacacatcccattcccaggtggtctcctccgccgtacacctccacgtgtagtgtaagtgccgtttgtttgcatgcatagtcagttctttccgtaatacatgtgtgattataccatcctatatatgtccatcttgttagtatgcttgattgttgtgataatgtggattaaagaaatacataattagttatattagatttgtcatgggagttgtttccaaaatactgaattgctcattacatttttacattcaccatatctttgcattggtaatataaattctcagcaattcacattgattacagcttataaaaaaatgctgatagcgtgatcagttcagtgatttattatggtgcctcatggccagcactaaatatctaccattgaagaaaatctgagtattttttcagtttgccgtacctgttgaaatctgtttttttttctcatctattcatgttaatctccttaagtaattgttctatgttttcatgcatacagcctagcggttccatgaatatatggcgtcatcaccatggaattctttaccacccactttaccaatcagctctagaaaatattggatttctttcaattgcaaagatgaaggctaggtagtggagttccattatcccaatagggtaatgagacaatttgaaataaaacaaatgattccactacctcatccacatggagaggccgatctccgtaggctgcgaaaagtcaagcacgtaggagggaaaacttgtgattggagaaatttaatgccaaatatatgttcaacaatatgatcaatggagatgaaagtgaatacgtactcgcgtgatgaatctctagtgtgtgctagctgccggcgccacagccggtcagccgcacaggcaaaggcgtggnnnnnnnnnnnnnnnnnnnnaaggcgtgtcgtcagctagccgcgtgcgattggtgacgcatactgcgccgcctttgctgcccgccggtggcgatgagggattgccgaggaggccaggatgcggtcgctagagaacggcagttatttcggcgctgattggttttaggtggatacgttcgggccggtttggcacggttcgactgcacccgtatggtggacgctgttcacaataacgttcagacctgcacgctctagagaatagcgtccacatctggacgctaacaaaaacaacgtccatcctactttgctaattacttgcacgcaattaccagatgtttaattacggggttattaattattatatataaaaaaaatcggcaactcacattccttcgcgcgcatggtttccaaactgccaaacagtgttgaaagttatctgaaaatttgacaaattgatcctattgaaaaacttatttcaaaactaaatcgtgtaaaaaaaaacttaaaaaaaatactccttgagcttagcaccatataccttggtgtggagtgattcaatgatttagcagaagaatcccacactgacttgggatcagcgccaataaaagatgtatcatttctatcagttacttctttcatttcattaagtaagtttttctagcattacccacatatatatatatatatatatatatatatatatatatatatatatatatatatatgtgttaatgaatcaaaagtcttacattatgaagtggagggagtagttacaaagatgtatgtggtaagaaggttactatgctataaccactaattaattaaataaagatagaaatatacgtgctactgctaaccactaataaataaagaggagaaaaaaaaactaatacttccgtttcaggttataagactttctagtattgtccatattcatatggatattagtgaatctaaatacggatatctaaatgaatgtggacaatgctagaaagtcttataacctgaaacggagggagtaattaattaaaagaagatagaaatataggtgctactgctaaccactaataaaataagaggagaaaaagaaaaggaaaaaaaaaaggcaaggaccaaaccaccagactactgctacaggacatcgtgatttcgtggttttagctccaggacaccgcacgaagtcacttttgggggaaaacactctcaaaacatagttatttgccagcggacaccgcgcccattaaaataataatttccggttgaatacgagagagaaatcacgtgaaatgtcaaaaataccttgggccgacatgtcagctctcttatctctatctgcgaggtgaggcggggcgcggcgccaccgacggccggagcggcgtctgcgaggcgaggcagggcgcagaggccggagccatgttttcattgctgctcccggcggcagccgacgcgacgtcgtcagcgctgctggacctcctcttgctgctctgccccatccttgacttccacgcctgcaccggctcgctgtcctcgtcaacgcctacccttatttcgcctacgctgaggaccccaccagcgtcgagctcgagtacacgctgcttgagctgacctacgccggcgttgccgcaccgtcctccgccctgcactaccccaacttgctcgtggcgcaggtggacgccgtgtaccatgccatcgcagcggccaacacagcagcggcgagggcggtggaactgcgtggcaaggtggggtgcggaggcccggcgcgggcgcggtggctgtgcgtgtggcgtggtgaggcgaggcggcgagcggaggcccagcgcgggtgcggcggccgtgtgggcggcgcggcggcggctcgcggtgacgccgtgcggggtccgtctggctggggctcacggcggccgtgcgggcggtgtagcaaggcacaaaagctgtgcgggcgcggtggtggcggcttgcggtgactccgtccagcagctcacgccagctcagctttggtgcccattggccgccgtaggagctcgcgcaccagtagcgccacgcttcagtgccgttgtcgaacctcaaggtgaccgcattgttgtcgtcggggtccagccacacactcgagctccacctcacacgcttcgctgccgagcttggcatcccgttcgagttcaccgccctcgtgttcgaccccctcagcagcgtgtccccgcccttcggactctcggccgcgcccgacgaagcggtggccgtccatctcacgactggctcgatccatgaccttctcaccggcgcccgcacacctccttgtcgtcaaggagctccgtcctgctattgtgtaaggaggaagagagatagggagatagagagagaacagaagagagataggagagctgacatgtgtgtccaatggtatagttgacatttcacgtgatttctctctcctcttcaaatggaaattattattttaatgagcgcggtgtccactagcgaatatccaatatttgagagtgtcttccctaaaagtcacttcgtgcagtgtcctacactaaaactacgaagtcatgatgttctgtagcaaaatttgccttagttcatttactagtgctctactgcgctccatttgtttgttagaaaataaaatctctcagcaccaaagcatacggtgtttatacgttcgacctccgcgacaggaaggttagcattgagctcgagaaacttgcgggaatatatgtagtgcaaacctataccaacatgcaaacttggaaaccagattgttgaccattggaatgaagatggacggtccagattgagcgcctcacccctattgcacattttgcaaaaaaaaaaaaaaaaaaaaaacgcatgcctctcattgtcctttttctgttttggtccttggacttattgtatttcctctctatccatgcatgcattcactttttccatgttcaaaatgattttctcctaaattacttatccaatctacaatccgatcataccgttgtatttgttgcaattaaatctttacaacaagatgacacatgactatgttttagcaaaagaaaaacgtatgtttcaatccgttaacactcgttgtttcgtacatgatagtgatatgtttcaacgtgtatattcactatgtttcacatttgaccatcatgcagattttgaagtcaatccggcactgtttcatcaagtagatcgaaaatgtttctatcttttaaaatacaatcaaatcacccatgaaacattttgctacaacgtatgtgtaacatactcgaatttaggattaaggaattcttgtcaaaactagttgaaaggaaagttctccaattttgtgaaccaaaaatttccattttaaaactaggtgaagttgatctaacttgtactgaagtaaaatttgagagcaaattaaaaccttttcatctttaacctataccaagcatgcatactcgcttacatcgtgttttgacttgagtccttgtgtgcatttggattttcgatttgcatttcataataggtgtcatgaataataactaagatctagataaacaactaaaccattagggcctagtgttagctagaggaagttaaaataggaaccatacaccttaaaatatatcaacatggctaatgtcaagcctcactaaactaatttggctactcatctgaaagcatgtcataaatatgtgttgatgtaaaaacacgaggcctgggagatctgcttaactccagtgcaggtccaaaacttgcctttgggtgtgtgagcatgccagttgatttgatcctgccatcaacaagaaacaaagacaaagaaaccacggttaaatccataaacgatagccaatcggctagttgccgatgatatatcatttatctttgggccgatgtcatatgtagatcgatcggcagtcatgaataagtaagaaagaactaaatttactcgattggttgcagatattaacgatatgtaatccctatgtccatatatacttaaatcaagtgattgggatagatcggtcgccatgccgagacagtataaatcacttagatcgaaatatatattaacagcaagactatatatgttcatagcacagccgatcagatagtctagcgtgaatcggctaatactccaataccactctatattaagatatcaaaacaagtaaaatataccaaacaaaagcctaatatacttaaatgtaacaagatcttaatataaagggcagatttaacatgtcaatcaagcatataagataaatgtagttaaatcaggtaagatcagctgaaaccccgatgctaccctaatcggcaaccaaaggcaggctagagattgagattctaatcacgactcataagatcaaactcaaccaatgcagcaataagtatgaaaagaaggacaatatctagacaatcaagccgctggaagtttcatagagtgatggatatcctatataatctaagtcaacatcgatgtctaacctaatcggctgccctctaccgacagatgttagccgattgtaggttagatagcgatattgccagagattatgtaagatatatgataactcgacgaattacataaacaagattagagtatcataaagatggaagcactagtcccgagaacgcaagctgtcataacaagttttacctcttgttgaagatcgaaaccgatgcagctcaacccgaaagcaagaactcgtcgaaataaaactaaagcaaaaagggtggcgatgcgccaagattgtattgaacgtatgtatccactgattacatggggttcggggtctatttatacccgaaaattacagactatgtccatatcggacacgactcttatctctaacaaactccacgataccataagtctttacggcagacttttgcccaaacatatctctaagaaaattacataaaatatcctaattaatagatacaattgccttctcaggactctatccatacgtggcaatcatcttgaagcatatcgactcaacccgatgtcgtacaccaagtcgcattgtcggaatcggctgtattacttaacccagtctgactcggacttagccgatcccaatcatagccgatccggactccagctgattcttactctgtttccgcgatgatcctcatctttgattccgctttgattcaatcttcttctccgatactaatattaccaaatttggtcgttaacacatgccccccatgtccggaatatttggtaatgtttcggatttgccatatatcgactccgagcaaaagtcgcactttgccatttcccgaccgttacttcagtgctttaaatactaaccattgtccccgagaaatctcacaccgtttcctccgttttcaccgctgaagcaaactccatctcctctctctccggcgatcccctcggtgcatgaagcgattcccaagcgattcctcctccggctagatctccgcccgtggcgatttcgtcctccgctagcccgtctaccgcgccgtcagccgagtatgctgaggtgagttctcatcggctagatccccttttctctcatcagattgatttcccctttcctcatcttgctttcttcttctcggttcttttggatccgcagcacctctccaacctagttgcaattcccatcttatcgcatgaaaatcattactttcttggtccaatcggcaaccttgatcctaccgagttcatcattggtgaaacaaataggattcctttcagattagccaacccagatctaggtcactggaaaaacaccttcaaatcttggccatctctcgagaaaactccacccgagaaaagttggattacatggtacaagtgcgtatcggctagcaagaaagttcactgggacgagatcggaatcagccaagtgcttgcccttaccatagccaattaagctaaagatgaacctctgatggctgccgctacttatttctggtccaataccattaatgcttttttgttcaaccaagggccgatgaccccaactctgatcgacatcaccatgatcactggattagatgtaacctcatcggctaaccctatgagtatgaacaccaagaaccaatttgattttaggaccaaaagcatagggggttggtcggggtatgtagcggcatatatgggcaaagggcctgtcacccctcgggagcatgtagctttcttgcttatgtggctagagaagttcctcttctgtggatctagctgtggtcctacaaccaattggcaatttgtagccgaagccctagaatcaaagaagcaatttcccttaggcaaaatcctcctcggctatctatatcatatgttaaataacgcatcagccaaaatagccgtcggcttagtggttggagcaggtggaccatggtggctgctacaatcttggctcaacctaatggtcatgaaagtagtcaatcggccatctgtgacagaagctgaattcccaaggttggagccgattgtagaagatgatggagaagaacgcactcatcgtagatgcaagtcatatggagaatatgcatccacaccagccgatgccagggcaaaattatcagctgaactgctcaaggattggttctgtagtttttatgaaggctttcagaaagatgcccgggtctggtttccttagaagactcagcagaccttgaactcccatcagacttcagatttgaagacattaatcatgaaagataccaaaaattcagggaagttttctcaactgcaatcagcccatgcatccttcctgtcggcattcatcagggaagaaacattcaagtctcttatgaattttatcacccgatgagctcagctagacaacttggagtgggccaactcccaatcggcttattcttcgccgataagatccaatgccgatgggaaatttcatcaaccttgatgatgcatcggctgctcaatctccaaggacctcctctaggcagtattgaaaatatcgagctggcaggattcaaaagcaaaaactttgacagatggtggggcgagtggaaactgcatctattccaccaatcggcttctatgtatatgatggatctctttcccgatgttatacctcaggtaaactctgatctcattaattctgtttgaacaattatcagccaattcataatttgactaaccctctcttctattttgcagacaacataatcttcccctccacatcaaagcaatagtggtagagatatcaaatatgccccaggtctaattcctaatggaggtgggccatctcctcctgtcatcggctatcatgcccccaagacttcgactcttctccaaggcttaatcagagaactagccgatgcaagcaagaagagaagaaccaggtcatcggctgcagacacgttagctctagccccaaagaagaaggccaaactcaagaagcctaaaccaaccgatgacctgcctgtcctagatccatatattgaacaagctctagatgaagaagatattgaagacgatgttgaccaatccgcagccgaagtgagcgatacagaaagaacaccatcggcttcacccaagcagacccctccaactccttctgccccaactcatttttcaagagtaagcagctctctttgatcctttttgtaatcacttcattttttcggccgattactcacagactttatagttgcagaagaagaaaattgctgtgaaaaagaaaccagcagcaacaattctcaaaccggctccaccagtaagttattttaattcttttattagttgattccagccgattttgtctaacacttgtctcttttacaacctcctccttcttctcctcctgtgcaacaatcatcaagtgaccgaactccatcggctgtggggagtcaccatgttgagaaagaaatacaaccagctgctcctgcaatcctggtaagttttgtcttataaaaattttgaatcgaccacataactcatgtcgagtctcaatttttagaattctttcttgcaggccttagccgatctattttccttcgacattaaagactatcttgatgaagaaacagaagaatataccaccagcaaatctttagttcccttgtccgatgatgtaaagaaaacccttgaagacatctctcatcggctagaagcatcatcactggacaacttggtggtaaactgtgggcctattaggactcggctacatgagatccatcctctaatcccagatgagctagccgatatccttactccagctatctatcttgagcagcatcaattcaagctagagaaagccaagctaagattagccgaacgtcgggagcgtaaagatatcgaagcaacaatccaagccaatcgtcagcttgtgcacgaagagaagtccaagcttgatcagctacctgagggcccgatcaaatccaacattgatcggcttgaggcttgcaagattgagctcttggtacaacttgaagaatgcaacgccgagctggacatagaacataaaaagctggctgatctcccaagatccattgaagaacagaaggcaagattaaaatcgactatcaagaatgttgccgatctcaccaagtctttaaaagtcattcctggaaccgacacccaagatgcccaagccattgaagaagtggaacaaatcaggcaaagggctatttcggctatccagcaatacttgtcttggtgactttccgtgtaatagaccttagaaatttttgtaatcggctaagatactatagtactttactgtcttagcaatcctttgtgccgattaatataacttctaaattcgcccaaaaatttacattttttgtatatatgtgcccccctaattttacaatgtcaaaagcattgataaaattattaaaacaactaagggcgatatatcggccatagtacatcggcaaaccacaaccgatttcaatatgaaaaacaactaagggcgatataacaatatcggccattgtacatcggcaaaccacaaccgatttcaatatgaaaaacaactaagggcgatataatcatatcggccatctcaaggcgatgtaaacacatcggctatcatgtatcggcaacatcagccgatcatgcattaacccaaacatttgggtaatatttcttcaaatacttgccatttagtgctcatccataaacttctccatctagtacttgcaacatgtaagctcccttagatacaactttgtggatttggaacggtccttcccaattcggcgaccacttgccgaatttgctatcccgagtcccaatcggcaaaatcaacttccatacaagctcaccctccgaaaaagtcttgggcactactttcttattataatgccgagcaactcattctttatccttggtaaccttcacaagggctcttaatctggattggaccaagtcctccctttcatcagccatgagattataatactcatcagctgtcaaattattttgcaattccgttctccttgagccgattcgaacctcccatggcaaaacagcttcatgtccataaacaagcttataaggagggacttggatcgatccatgacaagccatccgataagaccacaatgcttcggtcaatcgagtatgccactgccgaggataatcagaaatctttctcttaatcaatttgatcaagctcttgttagatgcctcggcctgcccattagcttgtgcataatatggtgaagaattcaacaatttgatacccatgctatcggcaaactgaacaaactcatcggacacgaaaattgaaccttgatcggttgtaatggtttgagggataccaaatcgatagattatatgttcttgaacaaattgtatagcatccaaagaatcaatattcttcaaaggaatcgcctctacccacttggtaaaataatcggtcgccaccaatataaacttatgtcctttactcgatggtggattaattatgccgatcatatcaattccccaacctctaaatggccatggtttaatgataggattcatagccgacgccggtgccctttgaatcgctccaaatttctgacaatcttgataccctttgtaatacctgaaacaatcttctagcattgtcggccaaaaataccctgcacgccaaagcaaccacttcatcttatgagccgattgatgggtaccacaaatcccttcatgaacttcgccaattgcaaccttaacctgattggcactcaaaaacttcagcaacaccccatcaatcatcctataatagagttcatcatccaataaagtgtacttcaacgctttataccttaatttccgagaagccgattgagacggattctgcagatattgatgcacatcatatctccaatcatcggctgttattacaacaacctcaaccttaacatctttgatcatcggctaataccccgatgccccttgggacaaatcattagctttaatgttttgttctcgagatacatgcttcaaagtaactagccgaaactccttcattaattctcggcacctttcattataaaccatcaatgtatcatttttgcactcatactctcctaccaattgactgattactagcaaagaatcccccatgatttcaatagcatcggcttcaacctccttgagtaactgcaaccctttgagaactgcctcatactcagcctgattattggttgcataaggtttgatagtataagcaaactcaaaactttccccccgaggggaaataataaccaagccgatgccacaaccatgagtgcacactgacccatcaaagaataaagtccatggtacaatctcaactgagccgattgaatcatcacgatgttctacaataaaatcggctatagcttgtcctttgaccgccttcggtgacttataccgaagatcaaactcagttaaggaaaatatccactttccaatccttcctttcaaaattggagccgataacatgtacttgacaacatcggccttgcatatgacagttgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaaaatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataagaagaggggaagaacgaccatagggtcgtgctccaaccctaggacgcgcccctaatgggcccaacttggatacacagcccattgggccaaaagaggtgacgcagcaccattgacagaaaatagtcgggagtaaaatgacaattgcggccgctcgagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcaacagtgcattcattggacaataggtaatgccttaaccttgtacatgaaaaatataagcacaagcacaacttctcaataggggaatatctagtttctgcatccaagagccaacgacttagataaaatacaactctttctttcccttcaagctcctgaatcaagactgagccgattgattgacttctcaccggccgacagatataaccgaaaaggtatccccttctgtggaggaatcaaaactggaggagagctaagatattccttaatattgtccaatgctttctgttgctctacccccccaagtaaactgctgatcggctttcaatcttagcaatggtgtaaaaggctctaaccggctagacaaattagaaataaacctcctaacaaaatttatcttgccgatcaactcttgcaattctgtcttgttctccggaggttgaatcttcttaatcgcattaacactcctttgaatcacatcgatccccctctcatgaacaagaaatcccaaaaactagccagccgatacgccaaaagcacattttgtcgggttcatctttaggccatatttcctggtactctcaaaaaccttcctcaaatcggctatgcggttctggtatttgcatagtatggggatcgtcggtgctaggatatacacgagactgaggtaaaagagacggagacgaggatttttatacaggttcgggcccctgaattgtcaggtaatagccctacatcctgttggccgaagccggtcgttgctctttattcaccataatcacacaagtacaatatatgggtagcctatctaactgttgtcgacatggcgttctgaaggtctgactcgtagtcgacaacagggtagtcttccttctcgaatccgtgcccgacgagatcagtgatagcgctttcgtctctcctgatagtatccggagacactgtaggggactagccgggcctatccctgaagtcgatatccggcgtcttatcttggcatatgttggcttgtatgtcatggcttctgttgttccgtatattgtggtgggtgtcgactgtctggtctcctcctaggggaccttgtatttatacccataagtgtccccttgtccaagtagaacta

SEQ ID NO: 74619 - DNA, 6981 bp, Oryza sativa
gtatcctgccaaacctaagaaactgcgaatttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaacttccccaacaccagacggagatggtgctgatggtcttcctctgattgtgagtataccagaatgtcatcaatgaaaaccacaacaaacttatccaagtattccatgaacatttgttcattaagttcatgaagaaagcaggagcattggttaaaccgaatgacatcatggtgaattcatacagtccgtatcgcgtggtgaatgcagtcttcggaatatctttttcacggatgcgcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatatggtagggtcgcttgtacagaggagtggttcctggagcaagatctatccggaactcaatctctcgtttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacagcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgattgacatccttaccaccgttgttggggcggggaggcgcttggccttgctggcgcctcggctttgggcatttatccgcaaagtgcccaggctcgaagtagttgaagcacagacgctgcggacctggagcgtccctgcggccttgaccaggctgcacagctggcgtaggaggacggggcgcacgagtcccttgctgactctgctgttgctgcggctgtgggacgcgcaccacgaattgaggtcggggcgcggagcggggttgctgctgctgttgctgctgctgtgaggaggatccccctggatagggattggtgtagcggaccctttggttagccccctgttggttgcggaaactcgccaagcgacgcttgtgcgactctagttccttgtgcttggcttccaagcggatgctcttgtccaccagacgttggaaatcctgatagtccccggagactagacgcacggacagctcagggtccatacctgccaagaacttctcttgcttctcctcatcttcacgaacatcctccggggcgtactgggccaagttgttaaactcatgcaaatactccatcacgaagcggttgccttgcttcaactctcggaattcccttttcttaagggccatgactccggcgggcacatgggtcctccggaaggcggcggtgaagcgggcccaagtaataggctgcccctctggctgcgtagcctggaaatggtcccaccatagagatgcgggcccctgcagttggtgggcggcgaagacgactttctcctcatcgctgcactgcacggtgtctagctttttccccacggcatgcaaccaatccaacgcatccacggggttgttggagctagagaaggtaagtggacggatgcggaggaactcggcgagtttagagtgttgtgggggtggtggtggagcattctgttgtggcggattttggaggtggtggaggaaagcagtcatcatgttggcctgctgggcgaggatttgggtgagaatggcgttggtgtctggttgtggtggaggcggaggaggaggtggaggtgggctgccatcgttgttgtggttgctgcctttgggttggttgccatcaccggtggcagcacttctcctggtcgtcaccatctgaaaaccccacacagaaccagcaaacagagagagctgacaattaaagctaaccacccacgactaccataattcttgaatttattactgctattaaattggttcattaaagttcaagttgcttaagcaaataaaataaagacaggctccgacacagttacaccacagaccggcataaccgtgccccacacaacccaacaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacacggcggcgcttggggcggcagacctctccctgggcgatcttgagctgatgcagctgcgcctccaccacgtctaggtccttcttcagctgcagattctcctgacgcagctccaggatcttcatgttgttcttgaccatcccacggcgcaccatctgatggaagtcgatacgggccgcgtcgtacgcctccaccatgcgcgccaggtgcatgatggtagcgtcatcctccgagctagcatcccggaagatggcgtaatcgcgggctcctccgcggcgagggtggtagcggtagggcgagtgctgcaactcgtccgggtagcgctggtgaagtgtgccgatggcgaggagtgcggcgttctggcaagcggcggagaaagaatctccacctgcggtgactgccaacgaagtcctctcgggtgagccagtgaggatcactgcagtaacctcccaagcagcgtggcgctctgcatcgtcaccctcctgctccgggagctgcctgccctggtagtccactccatgcggataccccaggacaacgcacatgccccgcagctccaaaacgaagccagtcaggtccagaccacggcggttgatgctgccggccatctacaaacaaaaacaaaaagaaaagcaacattttaaaggtcagattttgacgataaatgaagcagcaggacagagagagactagaggattttcacaaataacaaaagatttttatttcgaaaatattgctaaggcttgggatctaaggctcgtcctagggtcaagggggctctgataccaacttgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcgacgaaggcccagcacacacaaagacaaacgggaaacagcggaagactagggcgacgaccacaggcgcttgacggcaggcacgagctagacaccaaaaccttcatcttccagaggctcctcttctgggtttgggaaaaattgagcaagactgagtacaaccaccgtactcaacaagacacacccacaagtgcagaataaatgcaagggagtacaagggaattataatataaaggattagggtttgcagtaaacagcattaaaagacattttgttgctcaaagctgttttgtaaacacgattctagaactatacattattatttatcaaggccgtgaacccacacgaacctgccttaacccaaggcctacgatgattcagaccgaactggcactccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggataggtaggcaggactgagcccctagcagcaggacaccggccctgtgccatgacatctcgactaccgggctgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgtaaaatcgcctaaggttacctaattaaaagcgaagcatccacctaaaatcatactagtgataccatgagtagagtgtccactagttggggttttgtttattctagggtgaacaaggtaataacaacaataacaataataaggtcataacaaaggtaaataggcatggctaaataaaacagtgataacgcgggaatttaaataaagcgataatgcaataagttaaatcaatataattttacaaactgggattcaatatgttcaaagatgatgtgacttgcctttctcgctttcccaaacgccggcttcaacttccacgaagagcggatcttccgaagctgcagcgtctacacgaccaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgaagcttatatgctctttaaatggatatttacgaatttcttcatttaaattttgatttaaaatcggatttattgcgttagccgaggggaggggcgcgcggaccgggtccacgggagtggggcccacgcggcagcctcacggtccacggtggaccgggtgcacgcggcttacgccgggcggcgccgtgggtcccacgtgtcagccgtacccgcgggcgcgggcggctgacggccgggccccacatggcagccgcggggcgcgcccgaaggcggcctcgccggcacagccgacgggaggcgacgcgcccgcgccccgatggtcgccgccggcgaccaccggcgcggcggagcggcgcccgagagaggggagggaagggggaagcgaaacggcggtccacggctcaccccgggtcgacggcgacaacggaaacggcgaccgaagcggagagaggcggcggcgcggctcgggtcgacggggacggcggcgttccggcggtcggcgggcgaaacggaggggtggacgaggtcggcgaggtcgcggcggagccgaaggaggcgacgccgaggcgggagaaagtccgaggcgacgacggcggcggaccggagctcggcggcgacggcggagagagggaacgacggcgcgagctcgattccgacggggagaaagagcggcgagtggcggaaacggtggagggaggcacggggagcgtttatatagtgttgggagggggagagaacggccggatgagggggaatcggccgcggaagatccggccgccattgatgcgccggcgaagtttgcgggagagtttccaaacgaatccgagggagagagagagggaaaagtggggggaaagggagagggaatcacggggagtgatttccccctctttattgcgcgcgggggcggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcgggggaagccggatgggccgcgggggagaggagagagagggagggagctgggccgagccggcccaagaaggagaggggggggaaaaaagactttttagggtttttctttttataaaacctttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcacaattttgaggatgtattttagagtcgttttgggacgcgacagaatccgttaagacatcgttgaaaaatagtttttcaatgaaggacttaggggaagcagtacatattctgggcataaggatctatagagatagatcaaagaggctaattggattaagctgagtacatacattgacaaggtgttgaagaggttcaacatgcaagattctaagaaagg

SEQ ID NO: 74620 - DNA, 9633 bp, Oryza sativa
ccaggacacctaaaagttgtcttatggatatcttcttcggccataaagatttgattataacctgcattaccgtccataaaactcaaaatcttgtgtcctgaggcagcatcaaccagctgatcggctactggcattgaatattcatcttttggggtagccttattcaagttttcggaaatcaatgcacaccttgacttagccatttttcttgataacttgaactatactagaaacccactcggcatatcggcaaggacgaataaaaccagcatcatataatcgtttaatctcagccttgacaggttcaagcatatcggctttgcatcttctcggaggtagttggtgtggtctaacccccggtttaataggtagccgatgttcaacaatcgatcggctgagtccaggcatttcataatactcccaagcgaagcaatctctgaattctttcaacagctctatcaactttgttctgaattccgaagataaattcttactaataaatgtcggccttggttgatcacctggacctatgtcaatttcttccaaatcatcggctgacatgaaaccctgtccttgtttgtcatcgagatcatctactgtgtccttagtgtagacatttgaacgctccacgacgccctcaaaataatagcttgggttctccatcttcaattggttgtatatcagaatcagacacttttagaaaatctccatcccaaacttttccagataaacaatcaagaccatccatctcccaaagagctaaatcggcactggcaacattgactgacctgtcggctggcacaatttcaatcttgtcgccttgccactaaatcaagcattgatgcatagttgaaggaatacaacaattggcgtggatccaatcccttccaagcaacaatgtagacccccgattttggaaatcggaaatcttctgtgtttatccgtaccaatccctggatcagtagttggtacacacatacatagttggatcacaacatatcacgaatgaatttaggctaaaagagttaaatatttacattagggccaggtaggccaacaactatcagagaacaacagtggaagacaaaataatataagggcccggttaacatgccacaggcagtcgactgtggaacgagacctagaacaagaccgcactccgatcatcttgttggatacgcaagcgtaccgacaagggcttctcttcaacactctcctaaaagatatatgaatagcaagggtgagtaccaaccgtactcagcaagccacccaacaacaatgcgtatgatagagggtatttcaaggaatgtcttcatgttcttttgcataaagctaattttacaattcttttcacaagcctaaaacctagcatagactgatcaaattttagtaccagtgttcactttaaacaacgacggttctgtccaccatccattgtgatcccaaggatagcttcccgccattgagtcgttatggttttctgaggacgtccacattcccgcctctcaggaagtggctccatcagcataaaaatcatcatgcaatatcccatcccacacaagttaaagaatttagagtctagccaagtctaatacatgtcctggtgctcaataaccgcgagcacggctattcgaatagatttggtttactcacactgcagtggatgtacactttaccccgcactccgcgattatccaacacatgagcctcgtcccaatacatgagacacgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcatgcttctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgactggggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcattcctaagcaattgtcatagttgactagggactcatacgtaaacatggttacaaagatttaagggtaaacaataatcaaggcatggcataatcacaagtaggatgttcatcattgcatgcaattttatttgcaaacaaaacaatttcgcaattgggatcaacatgttcaaggaatagtgatgacttgccttgctcaggataatccttattattgatataatcttgatcaaccttcacctcctcgaagttgcagacgttgcctcacgactaaccgatacacaaggtctataatacgcgagaaaaaccaatattcaaacaacaatcaaatatgcgcaacaaaatgtactattcgtgttttctaatggatcccaatcatgctaaggctaaagtttcttaatctttctattgtcatcgtggcctatttaggagttaaccaacatagcatttatgggatacatatatatttggctaatcggtggtttagtctatcaaatggctatggaaggattatggctatgtatgcatctatctaaataggacggttatatactagaggttcttttgttagatggatttaggatcaatcaaacaattacagtgaattatttgtattattattttattgatggaagctttactttaattatgaacatattttacttgccattataaattataaaagggctaataattatccatgctctatatgttaaattcgggaagtttataatattatagttacagattatctcttaatgaacaatccggagttacaattgaactatgaacatatgaggtcaagatttataattagtacttatctactattcatgtttgttatatactccccagtttaatatatgaaaaagataaattaattgtgtaactataatgggatgtacaatatatgtgtgcaacaacgtataaggttttggtcgcctactgtacatgagcttatttagaaagtgtactacccaatgctccaagtgattcctaaatatattgtagtttaattatacattagctagtttctatgagtgatattgtatatgtgatgcgacaagtttaagcattggttctattgggttactaataagtggtaatcaatttaggcatatatatgctattctatatggtattgcatcgattaatttacttagtgattcctccacatctagctctgttatgattctcctaaacaggttaaagattcatctatgtgtgtttagattttagttacataatcataaggctatacttgatttaaataacctataagccatggatttaattatatggccatcgaatattaaataagtactagtattttcctatacatccattaatttgaaggattgattataactaatttatttagttgctacagtgacaagacatgttaaagataattatgctactgtacaatatccatttttattcattggcacactatttaggttaactattatctaatcatttgatattaattaatttataattataagtatattttgttaaatagtgaattatatatcattggagggcttatgaatttagatgaatttaggttcaagtttcactcaaatccgagttaaaatgaataagttatgctagtgtaaagattcaaatttgaattaatccgagaaattgcgaaaagctgctgttcataaacgatttatttttaatccaagacatatccacagccttgtaccaactgacaagtgggaccccgggtttatttctttttcctaccgaattattttctaaagggaaataggaagagctaatgacaagtggggcccacatgtcatagactcgagaccataaaacttctataattagattctaattattttaaattttctaaacttccctaatctccctctaatttactttttatttccttttcctttttctccctttccctttttttttctttcctttctttttcttttctttctctccttttctcttcttttctttctctcctcccggctcctttctatctctctctctcggctctttgcttccccgggccgcgacggcagtgggcgcgaggtggagggggggggaagacggctcaccggcggcggcggtggcggcgacgacggcgacggcggcgcaaggcggcgacgcacggcgcggcggcttcgaaggtggcggcgcggcggcacgacaacggcagcgcggcggcgcgacgacggcggcgcgtggagaaggggaagagggagaagaggagggaatggagtggggtggagaaggggggattgggccggggtctttataggggagaggggaagaaagagaggggaaggagggggaagggtgaaacgacggcggcgcggcggcgcggggcgcgaggtggcgggctcgcggcgcgaggcgacgagacggcgcgcggcgcggcagcggcgatgggacgcgcgcggcgacgggacgtcgatggcgacggcgacagcggtagcgcgcggctcggggcgggatgcgatgggcggcgacacgacggcacggcgcgacagcgacgataggacggcgcggcgcggcgcggcgcgggcttgacggcgacggcggcgacgtgacggcgcgaggcgcgcgggcggagatgacgacggtgcggcgcggctcagggcgcaaggcggcgtggcacgtggcagcggcgcggggcgcgaggcagcgggcgcgcggcgcgaggcgacgggatggcgacggcgacggcgcggcagcggtggttcgcggcgcgaggcggcgatgggacgcacgcgcggcgcgagggggaacgcgacggtgacgacgcggccgtggcgatgagatggcgacggcggcgcggcggcaggcgacgatggcgacggtgcgcggcggctggcgacggagagagggggaaagaggaggagctgggttaggggaccccgtcgaacaccttaggtgcaatgaactgtgccgttttctaattaacccgattttagagtaatttccatataaatttgattccacaattcctaattttgcatatatgcattttactcaatatttgtgttatcttatctaatgaattcaccctagattaatattactcatattttatttatataatttatttgaatttttaattagggttaattcttattattgttatatatttttcaaagttttcctatttttcttcttttagggttttggttgatttataaattgagaaaagttgcaaattaaatttgtatttactcccaaacatttaggtgaccgtattaagtgttcaaatgtgaatttgcccaaaatttaatattgtccaatatttaaggtttattaaagattctataattttctaatgagaccgttattaacacaatagcacattagctcaatttatctatatgttagtttattttatatggaggggtttaatatatcaaatttcaatccctaaatgcaagtaggaacttggtgcaaaatcgatgtacatatcgaattaaatactcccgtaaatctattatatatacagagaactcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaattatatctattgcttaaatgtagttcttttctttactttcttggtgatcatttacggtttggcaagcaatagcaatcataacaaccagcatgatgcaaaagttttgaaaagttcgaaattttcgtgattttcattgtcttgaattttcaggatgttacaaacaagctgtaagaacccttcccatcgatgacaaagaacgttgtagggatggttttgttgccgactgtcagctccacattcaaaactcctttggtctttgatggattgccaccaaaatccttaagtaccatatttgtcttgatgagatcctcagtatttctgcccaactttctgaacgtagcataaggcatcaaatttactatagccccaccatcgaccatcatcttggacatcggcttcccattgacataaccatttatatacaacggtttgagatgccaattctctgtaccctctggcttctcgaagactgcttgctctggtgacaaaatcaatttagccgattcctcttcaacctcatcgacatcggcttgcttgatcccaaactctgcaggcaacgtaaaaaccatgttaaccgatgcggttacaatacttttccctttggccaatctctttgcttcatcggttgcgccctcatcggctacaggagcttgtttcttaacgcgccactcctgctttggctttgttttctttagccgatgattgatttcttgttcgacctcctgaaaacgctccctgttcctcaatctttgaacccttcttttctgattctttgtaaatataccagaaggacaccattgagtcttcctatcttcattgtcttcttggttacaaccttggttcaccgggcccaacctttgatgaacaggaactcttgcttgccctagccgattgcctctgttatacgatcggcttgaactttctgcaacattgctgcacccaggacagtcttcaatagacagcagcctcataccctcattccaacaaaatctaaagaactcacaaccccaatgaggatcaaagccatcatcatcttcttcgtaacgcttttcctgctgcctgtcatatttcttctgatacttattgataatctaagctgaattcacctgaaaaccttttgcacgtcctccattggctgttcggccagctgtatgcaccgtattgacaggaaaaggattaccatcaaccttcatcggcctcttagaatcatcaaacttgattttgcccccatcaatagctgcttggatctgctgcctgaagattttgcaatcattagtagtatgagacctagaattatgccacttgcaatacctcttcttgcccaattcttcagccgatggaattgtatgaccagcaggaagttgaatctgcttctctcagagtagtaaatccaaaatcttgtcagccttggtaatatcaaagtcatacctctcctcttttccagaattcttcacccattggcacggtataacctttttgcttcttacccattcggccgccgctatttcggagtcatcatcgtcatcatcatccgatccatatatgtaaggacaaacatgattaacctttctagagttcttcctagcctttgcaaacctctgttcatgcagggttactttctacgtaagatgcgacaagctatcaaactcttcagatgagaatttctccctgatcggagcaatcataccctgaaaagccaaatcgctaactgagcatcagtcaaactcaagctatagcacttattcctcatctctctgaatctctgaatatactcatgcacaggctcatcatgtctttgcttgattgttgttaaatcagacaatttcatctcatgtaccccactgtagaaagagctgtgaaaatgcttctccaaatcggcccaactgttaatcgacccatatggcaaagaagaaaaccaagtgaaagctgatccagacaaagacaaccggaacaacctaaccctcgaggcatccacagccgatgcttcaccacactaagctaaaaatcggctaatgtgttcataagttgatgtgctatcctgtcctgagaatttggaaaagtctggaactttaaaccgattaggtagaggaactctctcaaaccattcagggtaaggctgtcggtacaaatttccagcgtcttttggcctaagcccaaactgctccttcataacatctgcaatcatatcggcccatggtcgttgctgaggtgctccttgaggttgctgaggcatgggctcgaattgattgtattgaggaacaaactaaggttgagccaatcctccctgttggtattgaacttgcggtgatggaggctgatactgataattcaaattgcccccctggtaattctgaaaatccggctaaatattgcacaccaaatgcttgggaacaacttgaggtatcactgtttgatatggttgcacattatgaactaagtgctctggaaccacttgattcgcagcatgctgtccaggctgattaccaggcgttgcaaacccagccgatgcattcatcaggccttgctgctgaatcggctgaatgacctgttgccttaatggcgtctgctgaatcggttgcaaaacctgccgttttggtggcgtttgctgaactggttgcacaaactgttggattaggtttgtttgttgaatcggctgcacaacctgctgccttggtggtgtttgttaagtcggctgctgctgggctggatcaacagtatgttgaggaggtaagaacatagatgcaacctattcttgtgttagccgattcacattctgtccactatgttgtggttgttctctcaccagcaaccggggattaactaattggcctggagccaatggtggtgcagcaagtgtaggaaccaatacttgtgccgtcggttgagccgatggtgcattaagagagattgactggacaactggttgattatcagtgattaatggccgataatttgggaacattcctcctggtagataaactggtcctgtagcttgatactcggccattgaaccatcaaccattgttttcacgatgtttgacaaagtattgactaatattccagactgattgatcaaagcatggtgcacggcatagtcaacctgatgttggaagttgttaaactgtaactgtgccgtattgccatcttgattagggccttcaccttgaactccgtgagcaccatcaccttgaacaccctgtactccttgagagctatcaccctgatttccttgagaaccatctgcagcacctttattacttggttgagccgaaccatctggagcttgtttcccttctccatccttagaagaaccggtcccaggaacatcagcaactaccttcacgatatacttctgcaccactgtccccttgcgggtctgcatgaatgagtttaagaactggttccgtgcttgctgcatcattgcgtcaaaatctttttgttgatcaggtgtcaacttgtctggagtgatggtcacgatgttgccttcattaacctcagataagctcagctgctggatttttttctttaacagaacctggactagccaaggacggcgatggcggcagtttctcggtcatggggaaaactgctgttgacttctaat

SEQ ID NO: 74621 - DNA, 15571 bp, Oryza sativa
ccgaacctatgccagcgccgatggatgcagggttttgagggaatggtggagattcactccctatggcgattggagggtattaccgacctttccaaccgccataaccgtcattacctgcctatttaaggagttcactctcttcacttcaacacacacctcaagcaatagctctctcatttctctcaagtttagtttagtagtatctagctggtggaataggaatagagtagaaatcaggagtccggaagtcttcggaagagttcgggtatggctctagtagctttcctttcctcttttgtaagctttgtacttttatgttcttctaaatacatttatggtattgaaatactttctgagtatatgagtatctactttacattatgttcatgttatactaaatatacggctagcttatctgggagatactttggtgtgggtataatgtttgcttatgcaattactctatgtcatgatgatgatattagagtagtatctggtagtttaggcgcggtgtctagattacgggatatcattatttgttatatattgcagatgagaggtgggccgctgatggtgacagctcagtacgggtattcctccgcgccggtatataatcctaagttaatttcctggggagggtattcctccgtatttagccctggttgtatggttatgacgggctgtcgtaaggaactcggcagtcaggggtggcttctcgaagtaccaggagggcatcggatagagggtattagctagtatagcagttaactagaatgtatgtatactatgcatattagaagtataggaatagattttctttctcttttctttccacctagctaagataatatattatgagaatgagtagtaatgcttgtgtgtcattctaccattggattatcttaacccctacttagaatatgattatcacaagtaatatataaattattagtcaagctctctctacatgattttcccacgggataaaataaatacgatatccttggaatactctcgggtgaaatgctacaatggtataaccgtgtgcttgcggatgaactctgtaaccataatataccaggagtatttctgcgccattgctgggaattatatttctagtaatgtcgttaaaaaataccaacacttactgttctcaataaacgtagtgggtgggcgctgggagtgtccgcccaaaccacacacgtgtggcggtgcgtggagggggttgaggcggcctgacccctttcgtgagggatagccagcataccagccccggtgcgacccccccccccaaaacccccgggtcgaaaagcgccatgtgggcttgaggcagacttttccctttgtatgtagtacctcaggcccatatcaccgataatattgatctgccgatttgtctcgtgcatatcaaagtaatatatgttggttgctaaaaggcctcgcacatgagaatgagaatgtaagttaaaaatcctcgcgcatgagaatataagtttaaggaataaagatcaagtgcagaaatagactgtgtcgcatcgcatggcggaagcaagatgaactggaaccgaacacgaagaggggagcgtgcacacggacagaccaacgacgtggggttggaagcagatgagcactgagtcgcacgcgtcgctttcggacgatggatgatcacgatgtgatggacggaaaattatcaattttttaagtagtttagattagattaaaaaaggaaaagaaattagagaaaaactctaatcaataatgcttaattcttcttaagttcttaaaaaaagagagaaactctttccagttttgaaaatagaaaaaaaatagggcaactgcaaattaaccactgttttaaatcattattgcaagactaccactagaaaattacaaaataacactagaactgtcattaagtggcatccttgcaaaattaaaaaaaccggtagtaaatttgcaaatgccaaaaaaaaaatacgatcaacgtatcacttgctgccttcttggaattgccttctgcgaaacaaaagcgaaaaaaaaaatcaataggtacatgttaaagttatatgtgggattgtgggtgccagtggtgcggccagggctgttgtattcgcgagcgaacatatgtttgacctgaacgtagagtcggctccacggcggcgcatgaagcaccaacaacggtccaacggatggatgaaaaactaaatgtgacgatttaaaaaatctttttttaaagtaggttagatagatgtactaagagcagttttatattggatgtgaagacacctctaattttatccacatcatcaactaattaattaagagatagtatatacaataaattacctctaacatacttactccaatacaccatattaattttactatatttatttcctatcaatttattgacctcttgctcttatctctcctgaagtttatatagaggctgccaattgtatgagatgtggttccttctctctttatttctctcatccacctcatcatatgaatttatatgatactcctagagtagtaactaggacttaattaatgagtttttatttcgtgtgcactggaaatttctttgtaagatgactgaatggatgcggccttattaacgattaaaatgcaatttatgaataaaagttttatatacatattcttaatgatttggaagtaaatgttaaaaaagcaaactatgatgagaaagtcctaaaatttacttaaatttaagtctaaaactaaaattttggttatgcttgaaggctgtacaacggggatagctaatcctctatcctcttcggaaaaaaaaaagaaagtatatgtgactttttatagtacaataaatttggacatacagtgtggccccaccaccaccttcctatccactcttccatcgtggggtagcgtagtactactactccctgcgtccccaaaatattactctctctatctatcattttgatagctatatttttaaattaagaaaattatttaataggcatatttcaatctaaccgtctatcatcttaataactttctcggatttaatgagaaagtaatctcatagcttctaatttctcatatactttatagcaacaaaattataaccatttgaaagtaaatttaattctcaatctaatgatatattttttaacaaataaaattcatttcatattataagtattggccagatgttttaaagattgaatcttaaaatacaagcacgtcttatattatgggatcgagggagtagtaacctagtagagctagatggaaatcacctaatcctaacctagtagagctagattaaacatcacctaatcctatgtgcatactctctcagtaaaagaaaaactctatctgtaaaaaaaagatgggacaatgaatttggactatcctttcattgttctgggagatctcctcctaggttgagttttttttatagagagagagtataaatctagatattggattatcttcatcctaaaatataataaattttagctataaatataaataaagagagtaatacccatctacttttagattattgtattcttgtcatagactgaggaagtactccctccgtcccagtgtataagccagatccatctaaaatctcttactccctccgccatataatataaaagattttggatggatgtgacatattctaggataataaatatgtcgtactagatgtttatattatctaaacttatactccctccatcccataatagaagggattttgagtttttgcttgcactgtttgaccacttgtcttatttaaaaaatttatgcaaatataaaaaccggtaagttgtgtttaaggtactttggataatagagtaagtaaaaaaaaataaataataattctaatttttttttaataagatgagtggtcaaacactacaaacaaaaacttaaaatcctttatattacaagacgaagggagtagtatattttaggacggacagagtagcagtaagagcaaggtaaatagtgtagcccactactagctctaaatcgtctatagccaatataatagccaattcatacaatagttgtttactatactattaatacctgatcccacctgtcatacatacactacgtcttgaagtccgtgctagagctggctacaaatctatagcctgctgctcttctctctcctcatttatctttttaaaatatgtttacagctggtttataacctgctatttcacttgctctaacaatagaggagtagcacacgccagtgcatcgccaccgatgtgacccatcaatgcttacgcctgcccgattcccacgccacgtctcgtccatctgaccaaccctgtagtactccacgtctctatggcgtgtctctagttctataccctcctctgcggctgccacgtgggccccacaccacgagcggcgcgcctaggccgcctagctatactactactcctagtcctactacaaagcagagcactgagcacgccgtcgcggctcaagcttagctagtactactccagtagtaactgccgcttccctttccccgttcgccgcatggcaccggccgccggtgagcccagtgcagccgcgggcggcggggagggagacaccgaggcgcatgcggtgatcgacgtcagcagcagcgaaaccgactccgaccccgaccccggcttcggcggcgccgggaagaggccgcggcgtgtggtggcaacggctggcagtggccgggaggcggagaagagggctaggattctggccgccgccgttccaccgggattcctcgatccgctaccgcggccttctgcccctcctcctcctcctcctcctccgcgcgggaggaggagggtgacgaggcagttctggaatgccggggactacgacggcaagccggacctgctcggcggcgacccttcgctgcgatccggtaccgaacagattctcgaagcttctactattaccctaatactaccttcgccgatgttgctatgcttccaatggatagaaacggagagtattgttgcagcttgcataaatcgactacttgcttcttcaatgttcatgcaaaagtactgcatcaagttacatttaacccattgtcaatcccagccccaatatagcgctgtgctactgctagagagtagagaattagattatggtggtggtaaaagctggaaaaaaacatgcatggatggactagcttttcagggatatattctgctttctgcacaaagttctaatcttggtctatactctctagttcttttcacaacgtaccttgatgctctgtttctgttgcatgttcttctgtgtgggagtcaactttgtttcaagacagtatgctgttacaaccagtgttgtggatgacggaatacggatgtcggacggagagggtaccgtcaacgattaatcggaatacggacgattaatcggaatttggcggaaatttaacgttttgtgcaaatatgtgtacatagctgataaatagcttgttttttgacagataattgcgtataagtacatatattgactatatacatactattttcaaataaaacaagcatagcataaagtgtaggtctgaacattcatagtggtacaccaaatactgataggtttggtttgcaatgcataaaggaaatattaaaagcatgccatacggtatcaacaacactaaattaatcccaagtaacatatcgattactcggaagaatcgtaattacgcctggttagttggctgattagtcggaaacggtcgtttttttagtcgctaatgacggcaattatgcatactggaacgatcaacaaccaccgtttcatcaaaatgtgacggagatgttagcgtcaccgtactaacgtccgtatatacggccgtatcaaccgttatccataacactggttacaacaccggatacattgctttttctgcttatagctgagatacatttgttgttgctcactgagattttccggttgtcagattcgggaatggaccacattcgcgtccatccaagatttctacactcaaatgcaacgagccacaagtgggcactggggggtacggtctatttttcccatttcaattatctactaccgaatatatgcccatgcatgcagccgaccataagttcgctaacgttggcagcaacaactttgttaatgtatgctctttactaacatgtgcagctttcgcggagcttcttgacaactctctggacgaagtacgacttgactgaaaatagaacattgtttttgtttactgtgtcggttcctcttgcttactcaggcagagcatttctttaaaaggttgcgaatggagctacttatgtgaacattgacatgttggagaataagaaagatggaactcgaatggtgtctgtggaaggtgagaaactatcttgctttgcatgcatgggtgtttagatttatttgacacaaggcatcagttttcgccaaacctctgttgtgaatcaaatccatcttctacattgcttaaaactgtatctatttcatacccccaaggttgaaattgatactccctctcatcccaaatgtaggtcttttttgaacctggacacaataattaagaaaacaatcaaatgactttgttgctcttcatttatattgcattgggaaagttgaatcgctttatttgcgagagatatcatctaggagtatttaccaagggcaaacaaggaggcatagttgaaaagttgagtagtatttagtaaagagttgagaaggctagaacgactagggttgttcatgttccattttccaaacccctggtttaacatgccacatgtgacaatattgagaattgaatgccaaatttcagttcatactaaaccctattgcatgttacattctagaattggttttgctgtccacagttctaatgaaatcgtgttattttagatgcttgtaaatgtgtatatcatacctgaggtttcattctaaattgattcatagatgatggtggtgggatggacccagataaaatgtggcattgtatgtctttgggttattcagcaaagagcaaggtgaaagataccattggacaatgtaagttttggtaggataattatttagccatttagccatttagccatataaataattgatctgaatccacatgcttttgtatctctatcaaatgttgtattttaatttgctcaactcactcatcagatggaaatggtttcaagacaagtacaatgcgactcggtgctgatgtattagtcttatcacgtagttgtggtaatggcggaagaaggttatcttctgttaccttgaatacttcaagatatgtgttattctgattttttttctaccattttccatattatcactcctccattcaaaaccaaagcatgtttctgaatatgtcaactcaagctttcctagcttgacaactaatagaagcaaaagtactttgacaacataaagttttttatggttttaggcagcataataatatactttttttcttgtggcaaatattaatatggatggtatagttctaagctcaggatctaccagagagtgcaaaactttgtttggcaaaatcctgaatgtaaagtcagcaacatttctaactgtcgcgtcttcccattgcatccatctgcgtcttcccattgcatccatcttcaggatgatggtcgcaggttttcacttttcaatgtcaccaaaccaatttttctttaaagtaatgtgtctcaatatttcatcatcatcttggccaagtgatatataattatctgactgtcgaggttagaacatggcaagttctttctattcactgagtacaattccagtaaatatttcctgataatgtgtaaacagtaggttcctgtcccattgtgtgaacacattttaatcttgaccaaattatgtctcgtatattttgttccacatggacaagatgctgatccttttccctcatgacctggttggcataaaaggcgcacacaaagtattggcatgctatcttacacattcctgagagagaccaggaaagatgatattattgttccaatggtaagctcaatttcatcttgtgttgttgtatcaattttaccattttacagactggttcctttgacatcagttaagttagctgattgaatcaaaactctgcaattttagttaatgtcttcctttattcgttttaaccacagcatgcatgatgtttgtataccttgcagattgattatgaaaagggacaacaatattggaaaaggatgatgaggacaacatcgattgactggcagacaagcttagcaacgataatagaatggtccccttattccagtgaagcagaacttcttcaagaggtttatgttatgttatgttgtatttatattatattattttattggttctaaatgcggatatagctgtgttttgaatgtgttcggaatagcttgttcattgtttgcagaataaaggaaagggcacagctttgcaaacaaaaacatacattaccaatgtagtaaaaccaagttactgttagattacgcgacacattgttgaacctggcatatcataaaaataaagtactgatcgttgttgctgatgtctcttcttttcttggcttagttccttaaatgattttttttctctgtactttgttaccgttgtcctcatcttcttttctgtgtgtctaatggctttataatagtacagtttagctcaatcaaggaacaagggactcggattattatatacaatctatgggagaatgaacagggagagttggagcttgattttgatactgatgtaaatgtgagtgccaactaataattaatgaagtcatatagccagcaacagaaaatgtggttaaatatgaaatttagtgatgtttgagatggcaggatattcaaattagaggtggtaaccgagatcagaaaaatatccagctggcaaagcagtttccaaactccagacatttttttacatatagacattcactgcaggtaggttccagatttactttgtctgtttgtgccaaagcaatgctctgaatgcttttttttttcttttttcctgaggaggcctctgcagttaatgtatcaaaagaaaaaggaaattttagtttcaaagagaaaaacaaaaaaatcatggtaaaaagagagagaagaaattacagggaagacaacaaaaaaagagccctctactctgaatcataattgatattaggaataccatttaatgttggatggctacttattttcttagagaacatgcaaaggcactgcatatcattttattaaggcagacttagaaatgataacaaggcttggttgattgtagtgctatttgctaatccactaattctatggtgaattttctgcagtagaaaagacagtagtaagcatatgagccataaatagttcattggaaaatttagcacacttacataaattgtgcagaggatatatgtcaacctgatgttacttcctttctgcagagctatgcatcgattttgtatcttcgagttccatctgtattccaaatgattttacgaggcaaagagattgaacatcataatattattggtgacatgatgatgaagaatcatgttatttacaaaccagtgatgactgatggatttccgagggatatcgatgtaaagattacaagttctgtacccatcgtttcttgtatagtgatgatcccttaacatattttgtgcatggttcctcatctttgcatgctagatgatgactgatgttacaattggttttgttaaagatgcaaaacatcatattcccattcaaggatttaatgtttaccacaagaaccgcttgataaaggtattcatttagttatgccacatatatattcttatgatgatgaaaataaatacatttttatttctagcttctaaaatgactgcacatccatataccaattttacaattaatggaaagtaaatagatttgggatttgcacatttatgttctatgttaaatttctctgtaactcttatgttttaagctgatctatttttggagtaaaatgcaccataggtccatatggtcctgttgtcaattgggcatcgcacttgggttcttcaagttgcgggcatgtcgctttggttcctacttgcaagctgcacatataggtctgtaattttgtaaagcagtgtcaaaaaaggtcaaaaaccttcggtagttaaagatgatatgataacttagctcaatctaaaccacaatgtgaccatgctatcacctttttttagataatggaagatgagggatacatctctggtggtctggcctatgcagaatgcacccagccaatgtttcaccatttgaagtcattgggaaactaatatttttttgtttgaataataaagtttgtttctgcgtgccgttgattttcgatgcttctaattgatggtagttggcaatagcattgtcatattttagcttaaataggattgaggtgccacatttccaattaagctcagtgtcagcttctattggtacacctacacatctaaggatctagatgtgcaatcatcacgttgaggataaatgataacgtgcccacacaagtttatggacttatcgcacaccttatttctcttattacgcttggtaatcaactgaatatttcttgttctaagcatggccatcagcctgtcttaggtgattataacagtcaggatacgagtctcatcagaagtatatatgtttttttagcctttctggagagtgtgggctctacctggaattcaagggcgtggtgttataggtaagaaatccttctataagcccctttggcacaacttcttcatgtgtggaaagctgatactggaagaagctggtgacagacagcttctccttcatagccgtaagttgctgcagaatcagattctgtcaaacagcgacacttcaacttcttagtggagaagctgatgtagaaattgtgcctaaggggtctgtaggtcccttcttcagaccatgtgtaatcattataacttgcaggtgtacttgaagtcaactttgtagaaccagctcatgataagcaggactttgaacgcacaaatagccttgcaagactcgaagcacgattaaatttaatgcagaagaaatactggtttgtcatgtcgttttgcattgtccatttgttgtctgtaggcataccagttctttgaagaattctaattagagtctaattaccatggaaaacacttacttctgtttcaggtctgataattgccatcgaataggttatggtggcaattctgctaacagaaaatctgggagagaatataaaggtaggtagtgacgcagggctccctgcttgctttatttggattacttggtttggttaatagcttaatatttgtatttttttttcaactacatagtacaaaacaagataaaccaaattggtttggaactttagatagccctgaacgcatgcatgcatacctttgaacctagcaaccttagttctttcttttctttgcgttttctttttggcagaggttttcttttacacagtttttctgcataacctgtgctaacaactgagaattttttttttgtttcattctaaggacatactattatatgttgattcaaacaaatacactggcatgcatgtcagttggcaacttcccttgtgtgttcatgtttgtacatccattgccaaacatatgtcaagacataggctaaatatgctaattatatagttgatgcatgagacaattgctttattaagtaccctattattttgttggaatagagacacctgaaaatactccacacacaggaccaacatcagatcaatctcctgaaggctgtagaagttcgaattatttgcaaagaaaaagaagttttggaagtccatattctggatcaagtaataacaatagcaaaactggaataacatccttgaacacaagtaaaataagtcttcctgagagcagattctctttaagaacaacagctcagcagacagttgagaagaccaaaaggaccttaagatatacgagaccactactgcacggtctatcacatacaagtaatgatagtgatgctcagacttcaggcaccccatcaagatcaacttctcatattctaaagacacctgaaaaatcatgccacaatgagaatactttgcctttaattccatctagtgaagcaataagaagtgaagggacaacaagatatcagtcagaggtatttgtgttcctctacatgtaataaactttgtttctgtttccaatatttgtgggtatagtggtagttaaataagctttatcatgatcttacacagtaagttgcattcataatggctgcaacatagcagatagcacaaagcttggattggtttttggtagatcctttactgttgaagtgttcgatttccttttggcctcaggaacaataagatgaatgtactctgcacaacttatctcactatgggaccaaaaaaaagaaaaagaagcaaatgataataccctaccttgttcttttcctccatcttaattacattggatgacctccttcggtcatcccgacaaaaaaaaaaaaacataccttgttctattccagtaattatgtgatggaaaatagttgacatgggatgatctctcatagttttactttcttctagatgactgtttcagtagagatgacctctcaccttaggaagacagtaacattcctcccattaaaagttaacaaagtatgtagtaccagaaaaaggaatgcagatgagtgaagtttaagtacagtgtaaattatagtaagaaaaaactgaagagcaatgagagatggtcattaaagatgtactgaatgtcctaatctatccttctttacattttgcaaattttccttggtttgttctttacatatcaagagcatttttttttccttttgagacaactgatatatatgctttacaggaaagaaatgtaacaaataatggagatggacaaactgttgataaccctgagacagttatcaaattgttgaccgatgaaaattcgtcattaaaagaaaggtagctattaccagtgcttcattcatttcttttttacgttttactggcagttgtatggacaataataggcggtaatcagttgaaatctgaaatcttaagtaatgttgagaggttaaatgttactgtagttgaatttagccaacatatgggtgtttattccaggaactttaacatttgccacatgttcctttttattcctttgttaacatcagtacccttttttgaattattaaaattgtttcctgatgtatgatcagcagaaacttgtttgtttaattcaaaattcatgtaaaatttttattttaaaatcactttatttccaaacagaagtatatgacaccatttaatatcaaacccaagatcatgaaagcttggcttagatatttggtttttcagtgttcaatatatcaaaggtcctaatccaatggattgcttgttaaaggttttccccaaatgacacttagttgttcgcatgaaataagatttggaacttagagtgacttttcctcttcattcttgtttttttccctgtgtgatagtatcatgaagatggaggaatctttgtcaagagaattacatatcgaacgggacaagaataagtctctcattgaaagggtaagcaatactaacttttacctgtggggctgttggtagtatactgtgtgcttgtcctgaaatttttactatttagcccttattcaaaacttgctgcaaaaatgaaccccgccaaaaaagttcaacaaaaaatggcccctgatctctgcaccatcggactgacactgagatcgcgatgttggcattgacccttgccacggtggtgggtggggagactggcgtggcaaagggggtcagcaccagaggtattggcgctaacctcctattggtaaaagggtaataggctattctatacaacgatgcaaaatgtggtgcagtggtgtgatgtctcatgctaccaacacatttattttcttctttatccaaatcatgcctatatatgcctaattctgaccagctaatcgaaagtatgttttatgtttagctaatgtgaactgtatatttttgcaaaagtaattagtacctttttttaaaaaaaaaaacaaagaatttgaacatgtgtgtgtatgcttaataatggtcattcaaagaagagggactcatcctaagaaggccttctttggtaaagcaacaaactactataaggccttctttgtgttgaaggtgtgcctactacatttttaagttataggaggttagtgccaaaggcctcggggctgacccctttgccacatcagtcagcgagctcccctgccaccaccgtggcagggtcggtgccagcatcgatagtgctgagtacctcagcgcgaggtcggagtcaatttgtggttaaagtttttggtggggttcatttttgcaataagttttcaaaaggagcaaaatagtcaaaacttcagcttgccatgcgttaccccaattacaggttaccagaattttattcaactttgcacctactgaggacaatttattctttttcactacagtttggtgtagtgatttatagaaacattttaggcgtcacaaaatatactgacatgacacatgcgatgcgatttactggagccaataatggcttgaagggtttgaaaggtcagactgcattatttcagtctttgtaaccaagtccttccatattttgttttccagttggagaatgttcagaagcaacttggaactgcaaacaaggagcaagaagcattggtagatatctttacagaagaaagagcgcgtcgagaccaagaggtggagaaccagcggacgaaactaaaggttagttagatcttaaaactgtagtggatttattgcgcgaatgcaccgatccaatccgccttgtcgttgaggatggcatcacggcataactaagctcctcagtcggcatagccatttttgatgtcgtctctgctgttccaggaggcgtcgtccaccatacagaacctgctggatcagctgaatgctgccaggagctgccgcaagaactagaaatggaatgaagaagatcaattacctcgttggtccattgtggctatcgccgtaaaataagtttcccttgtacatgttagaataagctatatatgtcccagatggttaattggtgctagaacagctagctgttggtatgttttatgtgcaaggtatgcagtgctgcattttccagtgctaacaaagaagggtgagtcgaccaccactctaaactcgaaaatgtgggagatcgaccatatcggtttcagaccttcagtatcattcgatgcaatactttgtctaaacttgagcagtatgtaaaactgtagttctaaaactcctatcataatgttagtctggttaatcttatatttttacgagttcaccttggtgtgtattatgtttctcggtattataattgtcttccgtgttgatacgcacatatgcttttcctatgaagtccattttttggtagtaaatttattttacaaaacattaatcatgaacttggtatatacatgatcac

SEQ ID NO: 74622 - DNA, 7656 bp, Oryza sativa
cttctaatcggtcccaccgggcatgccaaaagcatgttgatgaaaaacacgaggcctggcagatctgcttaactccagtgcaggtcgaaaactcgccttcgggtatgctagcgtgccagttgatttgatcctgcaatcaacaaggaaaaaagacaaagaaactgcagttaaacctataaacgatagccgatcggctaagtgccgatgacatatcatttatcttggagccgatgtcatatatgtatcgatcggcagtcataaataattatgaaggaactaaatctactcgatcggctgtagatattaacaatatatactcctcatatcgatatatacttaaatcaagtgattggaatagatcggtcgtcatgccgagacagtataaatcacttagatcgaaatatatattaataatgggactatatatgttcatagcatagccgatcaaatagatctagcatgtaccggctaatactccgataccactctatactaagatattaaagcaagtagaatatactaaacaaaggcctaatatatgtaaatgcaacaagatcttagcatagagggcagatctaacatatcaacgaagcatatagaataaatgtagttaaatcaggtaagatcggctgaaaccccgatactaccctaatcggcaaccagaaggcaggctagagactgatattctaagcacgacttaatagatcaaactcaactgatgcagcattaagtatgaaaagaagaccaatatctacacaatcaagccgctggaagtttcatagagtggtggatatcctatataatataaatcaacatcgatgtctaacctaatcggctgccctctaccgacagatgttagccgattgtaggttagatagcgatattgccagagattatgtaagatatatcataactcgacgaattacataaacaagattagagtatcataaagatggaagcactaatcccaagaacgcaagccgtcataacaagttttacctcttgttgaagatcgaaaccgatgcagctcaacccgaaagcaagaactcgtcgaaataaaactaaagcaaaaagggtggcgatgcgccgagattgtattgaacgtgtgtatccactgattacatggggttcggggcctatttatacccgaaaattacagactatgtccatctcggacacgactcttatctctaacaaactctaagataccataagtctttacggcagacttttgcccaaacatatctctaagaaaattacataaaatatcctaattaatagatacaattgccttctcaggactctatccatacgtggcaatcatcttgaagcatatcgactcaacccgatgtcgtacaccaagtcgcattgtcggaatcggctgtatcacttaacccagtctgactcggacttagccgatcccaatcatagcagatccggactccagccgattcttactctatttccgcgatgatcctcatctttgattccgcttcgattcaatctttttctccgatactaatattaccaaatttggtcgttaatagtgccgtgcctctctactgccgccgcccagccatacggcaaccaccacgtgcacgcgccgccgtcgccatccaatcagagaatgaagtcggcgccgtcttttcttctttcacgtcagcgtcgccgtagccgagtcgatgaccgcctctacaaccgccttcggcaactgacctccgcgacctataaatagacgatgaggtcatcccttttcccctccacaccatccgagctcttcgagctctgtctttctctctctcttcctcaagactggctgccgccgccatcggccgatctctctcaccagagcaccactaaccaaatcctctcaccaccaaccttgccttactctggcgaacccatttttccacttttccccttctctttcgtcccatatcaagccccaccggagctctctctctcctgcctgttcacggcttgtgctcgtcgttccggccattcccttaaccccctctgccggccacttccttccctaggtgtgctgtagccgggaactccaccagccgccagcgtcgccgccttccgactaccggagccccgacgcccctctcctcctcctctcttttcgactgaagagaagaaggaagagacgggaagaagaagaagagaaagaaaaagaaaaagaaaagcctggcaggtgggtcccctgcacagtaactttccttattttccctatttaattcaaatcctattctttagaagcccatcttatataccgaattcaaggtaaaaaatcaagcatatgattgggccacgtggctccctaagattttagggtttgctcctttgaaaattagccacgtgtcccgtgagattcagctagagcgtcgattgtgcaatgtctcatctcttctattaatctaaagctagccattcttctagcgttttattggtccatgtggcatgtttcattcgtccagcctctcgattattccggacactggaccgtgaaaatgaaaaagaaaaagaaaagaaaagccattggttcattcactggctgtcatgggctgtacagcccagtcacgcatgactgcactaggcctggtcatctagcgttgttgctacagcatttgcacattgcactttaccttctcgggctaattaattagtaataacacaaacatgaccaaacaaaaataggaaaaaggaaggtagaaaaaagtataaataattttgtaaaaaaaatcttcaaaacataatatattgatatcatgtatttatataaaataaataataatcgggaaaaactaaatatcaaatataaagtgaaagagattggatgagaatttgttcaaatataaactaagaaccgtttcttcaaatacgcactttatcattgatactatatgtacgattttttggttaatgaaatcacaacaatttttaggaaacataactttaaatttttctaatagagtgtaacatacccaaaattttaggacttaaaaatttgttgtcaaaatagttagaggttaacttctccaattttgagagccaaaaatttccgttttaatttaggtgatgaccaacttaaaccattgcatgattaaaatttgagaacaaaacaaaaccttttcattcccagcattagactagaaatgtcatcaagcatttgagcatacatgtgcataatgcatgcctaggcttgaatccattgtgcatttggttttggtatcgcttttcataataggtctcatgagcataaattaaaagggttaaaactactaaacaaaactatagttaatattgggtgataacatgtggacttaatattaaattctaatatcattttctcagcccaaaagaagtttaatgtaaaccctataataatattagattcaattatgaagtaggaacacatattcaaagaaaggttattctaattctttagaataatctatgcaagataaaatcatggaaaaatttatgtaaactatgtttagctcaagcaattcactataatattggtacaggttaatagctaagtttaataccacaaattaatcagtcaaatcagacaactaaaagaaatcaaattaaactttaatcggctaaagccatacttcatccaaaagtacatttaactgcacataagtgaatatagaaaataatttattcaaatactagattatttatcatgcctaaatgtaatttttctagaattttcctcctctgtttaagcctcctaaaaattcaatctagctttctaatagcccatctttgtttaatttctgtgagcaatctacccattatttttgagtgcaaccaaagaaaatgaaatctaggtgtaatcatttacctccagtaaaatcaacactaattaatttggtccacacattaaattatggagttacaaagtcagaggagaaaataattccgaaaattaatctaaaaatcaagtttacccagtcttctacccatatctctctccctagcctagtttccatcgagttggccccacttgtcagtgccttaggctagcttcagccctgtccatcacttcctccactgctccagccgagagagggagagattgagcgagccgacgcgtggccacaacgtgtcgtcgatctcggtttcccttttctcgctctctactcctcccagatgcgtcgccattctccattcaacactcagagccgaagaaaccgagggaggaggttctctgcctctccatcgctccaaaccttgccgccagccgtggagacgacgaccatcgccatctccgtttgagtcaaggtcacctccatctctttcacgttcccatctctccacacaatgccgagcattttgctcttttgacctaaacccctctcgtgcagtgcatcgccgggaacgcaagccacgccgacaacgccctggagcacgcaccggagtgccgccgcttcaaccatcatcgtcgtccggccattctcgaccacctcggagcaagctgctgcgccatcgtcatcgcctcaacctcctcttcaatacgcctcaagaaccccagccggagatgtgaaggactcggagaacgcatcttttcttcactaccgccgatctagaatcgcctccgccgtcatcattgattaccgctgcctcggtgagccattgttcgattcctcacgcatacaccatctccttgacctcacaaacctcgtgcatgcttgcttgtagcagctcatcgtcccgttcgagccgtcgtcgttcacccgaggaggaacgccgtcgccgagccgttccacaagtcaccgctgccgccaagacctcgacaaccctagctcgacccacggtgagcatcctgaaggctagaagaccacatgcatgcatccttttttgttcggaatcgacttccatccacacatgcgctttcaccccaagaaccaccgccgctcacactcgccatcggcgctactccaatgtcccctaaccaagaaaactagaggaatggaatcgcaagaacatgctcttcattttatcttttaaccccaactccaaccgagccaccaatcgccgccggtgaaccctggatcgagctcagccatggctgctctgcctctgtgcgtgtgaaaaaggtgtcagggacttcattttgagaatttaaataactataaggttcattacgtaatgttcccaatcaatgacatatggacctaggactgcgggttgatttcctgaaatcctaggggcctttttgcatattggcctgatactgcctgatgaaccccatgagtttaaaatttgaaaaatgtaaaaagataatactaaaagctttatattttcaacaggaaagcatgtaaacttataaaatccataacaaattgaaaacaactcattttagagtaaatcaaatttctgtgaactcaccaaatcatgaactttagagttattgcataaaactagacattcactgtacaaactttgtctctaaaattggtttaagataaatcatacataaaacatgtacaaacttataaaatacatagaaaattcatctcaactcattttgaaacaaactcaaaaactgcagattcatcatcatgcactctctgattaggtgaaataaaagtaattacttactttgcatcaaatgcctctaaaactattatctctataattattagttttagataagctaaactttagaaattcatgtagaacccaatttagcttcaatttgaataaacttaagttctgtaggatcaccaaaacacgtatttccatgttatgaaataagattatatacttactgtgtagtaaaagtctctaaatattcatataaggatttactaacatagagcaacctttaatttgtaaaacttgtagaaaattcatttttagtccaaatgaaatgaacaaagtttccatagaaccagcaaatagttagcttcaacatagtaaaataaaatattgcaccttttgaacatattatagctctaatctttaaatagataacctaggagttaatcacctagtaatggttaagcaaaatatatgtgtgaggtagttaaaaaaaatgcattctagctatgaataaaccaaaataaaacttgttagaccagagaggccatagttccatccctatccactaaaacttagaagaacttagctcatataacaatttctaggttaatataatatattgctagtttagtttagagcatctctagtttataaaatatgaactatagtagtaaagaccataaacatgtgaactaaaaatgttttagttaactaaattattccttttattcaacttaaataggaagtagcatgttctgaacctataactcaaaagtcatgaacatataaaacactatatgcctaaaacacgttgtaacttgtaaaatctataagaaaatcattataactccaaaaattgtgaaaccaaatgcattagtcttagaaaacacacgtctacacccctgtgaagtctaatctagtaaaaatcactttacaaaagtatttcataacactacctaagactatactactataaaccgataagacttctaaaattcataactccctaatggaataagataaaataaaaattctttcacctaaattcattttagaccagtacctaatcactgtgcataaatcatgcattttagggcattttggatttttagctcttttggtgtttcattgcatatcgtgtcctttatctagataattgcataatcggtgaaggagtggattaggtgctaacatttctctgatcaaggcaagttttctcctcccatcctttgaacacattgaatcccatgatttgaggaatgaaaatgtttgtttgcaaagctgcatgtgaacttagattatatcggtatttaaaaatgggttaaggtagttacgacctatttgctgcataccccaccttgaataattgatcgtcttgctgtttgaacccctagaaatggttagagtacactctttgtgctcaaatgggtttatatatgctctatttgcaactacttgcttagccatgcttagaactatgcaaatgctcattccatctataattaaaatatgattttgatacatgaacctttgctggaataaaatgaatatgatgggtatttgtgaactaaaatgtgtaaaatgtgattttatacttgggcggcaagtggtgtgcatatggtgttagttgcataccgatagggggagtgtttgcccaagtccataaggaccaaacttgtgtcacccatttaaagttattcgtacatccacatgtgctagtatgggatggcctaagctgagtaatctatttaggactagccttgcattctggtaggccggtgtatatgagttcgtataattaagaggagcttcctatttaccccgacgtggtagtttaggtgactaagcgtgtccaatacaacggtattgtgccacgtggtgggttcccgtcgtgttcgccatcacggcgttaagtttaaggcatgggcccaccacttaacggttctaggtatattccaagtatacctaggatggaggaacacgtatcgtgctggtgcaaggctaggctctaagtagtgtaaaggcttcgttatgacctctagatcacattcaacatgaagagtgtggtggagtcttgcaaactcaaaacaa

SEQ ID NO: 74623 - DNA, 771 bp, Oryza sativa
agcggttgccttgcttaaactctcggaattcccttttcttaagggccatgactccggcgggcacatgggtcctccggaaagcggcggtgaagcgggcccaagtaataggctgcccctctggctgcgtagcctggaaatggtcccaccatagagacgcgggcccctgcagttggtgggcggcgaagatgactttctcctcatcgctgcactgcacggtgtctaactttttccccacggcatgcaaccaatccaacgcatccacggggttattggagctagagaaggttggtggacggatgcggaggaactcggcgagtttagagtgttgtgggggtggtggtggagcattatgttgtggcggattttggatgtggtggaggaaagcagccatcatgttggcctgctgggctaggatttgggtgaggatggcgttggtgtctggtggtggtggaggaggcgggggaggaggtggaggtgggctgccatggttgttgtggttgctgcctttgggttgattgccatcaccggtattagcacttctcctggtcgtcaccatctgaaaaccccacacagaaccagcaaacagagagagctgacaattaaagctaaccacccacgaccaccataattcttgaatttattactgctattaaattggttcattaaagttcaagttgcttaggcaaataaaataaagacaggctccgacatagttataccacacactagcataaccatgccccacacgactccaacaagaagacaaacgag

SEQ ID NO: 74624 - DNA, 1745 bp, Oryza sativa
gctgttgatataaccttttgtttgcgggtttagacttagtctttgagtgatgcgggtcccgattgcttcttctaggatgagaacttaatggggtaaacccctagtcggtgtgcttgtgattgggtaatcaagcttccgttgttctctaataagtctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgctgccttcgagtggtttgacgggcacatctcaggctgaagttgactggcaggctaagggctcagcaatgtctctaatattcctctctcgaggcgtcggatgtttcattatgcttgtttgatgacttgaattattcacttcatctcccaaatataatggaagatccggagagcctacgacatagagtctctagctatttgccaaattattgatcatcattaattacaatcttactttggtttttctcataattctaagacaaacataaaattaaattccattaatatgtccatttgaaagaattttttttcagagttaaacttactcatgtaataatatattactctgcatgtttaatattactggtcattctcacatttcaaattattatttttagatcgcggtcttctatcttcaccttttaaatgccatgtataactgttaatcaaagttaatattgcttttgaaaatgattataatgtagttaataagcatagcagtgtaatttgccacatctccttgtttgatgtgaaattttgctagagttaaaaataatataaaatgagaggtaggcaaattttctatatatattacagatgagccatattacaggctaaattaggtggcacgccaacaggcgtgcagatcttctagtatctcctaaatcgaagatccgattccgatgaaacttggacctaaattcatctaaattcaaaatctacattttgataccaaatttgctattttaatattttatttggatttcctgaagttatttaaatgtcatttgcttttcaaatatctccttttatttcaaaatatcctttagccactaaaaagccgtcggttggaactttacgccttccatggggacgttcgcgcggtctacagaccccaacgtcgaaccgttggttgtaaagcttggcataaaccaaacccaaggtcgaagtgcttctcctggcaccctacgcctcgctgcgtacaacggtcggagcttcactatgtcctcgacctccacaccacaccacacagttcactctcaagctctgtgtgattctagccgctccgccgccactcacggttgttggagtaacactttcgccccacttaacctgtataaacctccaatccctctagccgatatgctatctgtcgataccggctagagaaaataccaaacctagtcattatgctctatcatcgactagcacacaaccaaaccctggctaacaccttgctagttaaaacccaactgtcatccaaataccccacctaccaatgttgcctatccactatactcagccacctactctcctagaacctatatagagcctagccgatatgcttccctactccgctgtcggcataa

SEQ ID NO: 74625 - DNA, 18374 bp, Oryza sativa
cgcatggggactagagttcatggaacaggtaccactgatgttagtaactgaaaagctttgccatgacaaggctaatgtgtttggcacgtcatggattgtgggtaaagcgtacatctactgcagtatgaatatcctcaaaactattcgaatagccgtgctcacggttatcgggcattgggactcactatggcatcttggatagaaatctaattcgaaattttattaaatattgttgcatttaaaacattacaggttttctacttctgcattctctgctttctgcaagtaaacctagctttacacagatattatcatttcatacattcattgttgattaaatataatagcttgttgagtacgttgtactcacccttgcttcaatccccttttttagagtccattaggagtttgtgccaaagctgggagtttaatcatataagttagtttcatttcaacctaatcctcaagtctagattagatagatggtttaagtctatagcaaaacagcagagttaggtcattctaaagcttctgctgtaatagttagccacaatcttgtaaataccctattactttatgtaataatctctccttcaaagctatgtctaaatgtatgcaaagacgatccagattattgaacttgtatcaatctactgatccagggcttgatacagtctaaacatgtcggtttccgaatcattagttttgggatccgacaccttttggggtcacccaaaggtgaagtgctacagcggtattccgtgcgcttgcggaattatctgtgatcataagaaataccaacaacctcatgtaataatgcttgaaggcattgagttatgtcttgccttgcgccttaagatttctcgcggcttcagcgtagctatttgggtccacgtcagctccttggattcgatagtcgaacttgctgtacggtctaacgtacgaatacgaaaaagatagcaaataaagcctataagcaaattgctacaaagaaacgataaaaccaaggaataaataaaattggagcaaggagaggggaaaaaaggaatgggttcaaaataattttttgtttgaaaaacaaaagagaggttttggtatctcaaggctgagaatcaaacaaaaacaaagaaaggataaaatgggtaggcagggtttattcggtggatttggttttctagtcggtgctatagagtaaggcaacacgacggctagatatttggatttgttagccgatgctaagatgggcagcatagcggctaaatatttggctcgtctagtcgatgctacagttaagcagcacaatggctagagagttgggaagtttgtacgggtttgaaaagtgttactctacagtcatgagtgacagcagagcggttaggagcgcacatagctcaaggactagtgtgcggcggttgtggaggtcgggagagcagtgaaacttcgaccactttacgcgtcgaggcgtggggtgcaagaagtatcactttgaccttcggattaggttataccgggctttacaaccaacgatttgacgtcggggttcgagaccacgcgaacttcttcacaaaaggcgtaaagttcccacaacggccttttagtggctaaaggatggtaaaagaataattgaaaatttagagataaaaaatggtctttgaataaatcaaaggaatttaaatttaaagaaaggtttttaaattcaaaagtatttaaatgaatttcaaattcagaaattaaataaataaaaggtgttggcggatggcatgaggctcttcgaccagatctgccgaaacccgtggcgaaggctatggagcaagaacggcgtgaggcgaagagtcgcgcgagggccttgccaggccagggacgtctcgggcgaagggtgcaaggcgaagactatctgccgaaggaagacgacttcaccatgtcggcaagtttgcccccacaagggccgaggaagcctttctggcccatcaagcctaagggccggcgatcgctagacggcccatcaggggcccatgagaccctataacattatgtacccctgtaaatgtccctttcatatgggtaatcatgtaaattcccctgtacaacctagatcctagtagtaagagcctgcaacagggctataaatagcggccagttaacgggggatgtaacgggggatcctagggccatgtaacgggggatcccaagtgaaattcaaaatttagtacacttcattttcccaaccactgttgagtaaccacgtccttcgacgtatacagttgtcgtttcgacaacagctggcgccgaccgtggggactccgagcgaaaccactaagagcgaatgccaccgaagagggtcgtgaaggagaaggtcgtcaggcggaaggagagcgacgccggaccggacatggccgccgaggaaggagcagagccttcggcatccgtggccgaagatggagaaggacaagcgccatcacagccgccttcggcccccgcgccatcacaaccgtcttcggcccccgcaacctcagtgcaagtgccgaacacggccgacgtggcgaaggcggctgcgacggcaagggcactccagaccagggcggagaacctttcaacaaaccaactggtggtgcctcaagccgccccatcacagccggcggcgccgactgcgcccgccgttgtacaggcccaaatcagcctggaccccgaagcgcaagccgaagccgacatggaagccatgcggcagaacatgacacggctccaagacatgcttcgccaaatgcaagaacaacaacaagcatacgaggcgacaaggcggaccaaggccacgtcggctgcaatccttcagtattcggcaggctatgccccacctcaagtccggccgcaagtggtgacccagccttctccgccactagccgcacagccgccggtgtacttcgccgggcagcatcaaccacctggccaagcgacacaaacagtggcggaaggggcttcggctctgcaggcgcaactccaagctttccttcagcaactcaaccaaccccactacatttcaagtacaaccccatcggctcacccggtgggggatacaagtcaaggtgcgcctaattggttgccaccgattcagccaggctcgggaccttcgccatggagtcaaggacagcagttcgacttcggcaacactgctcaggtgccaaccgttcggcagcaagttccaaccccaggcttcggaacaaaccaagcaccaaaccaagctgccatgatgtagtcgcagccaatctttgacccatccatggcggcccagcaagtaccaccagttggagccgggcagtcgaatgccgcggcccaactccacgcacaagctgcgatttcgcccttcgccacaccgtacccgcagcaaggtgcggtaaacagggcgggaggcgaaaaggggctgccgctgagtgggggaatcaagactcgtccaatcccgccccagttcaagttcccacctgtcccgcgttactgacccgaaggagttcctctccatctacgagtcagcaatcgaagcggctcatggtgacgaaaataccaaggcgaaggtaatatatctcgctctagacggcatcgcccgttcttggtatttcaatttaccagccaatagcatttactcatgggagcaattgcgcgatgtttttgtccttaactttcgaggcacctataaggagccgaagacgcagcaacaccttcttggcattcgccaaaggccgggggagtcgataagggagtacatgcgtcgcttctcgcaagcccggtgccaagttcaagacataaccgaggcgtcggttataaacgccgcttcggccggtctgcttgagggcgaactaacaagaaaaatcaccaacaaggaaccgcagacgctcgagcacctacttcgcatcattgacgggttcgcaaggggcgaggaggattctaagcgacggtaagctatacaagctaagtacgataaagccttcgtcgccgctgctcaagctcaagcacaagttcaaattgccgatccacctcccctctttgttcgccagtctcagccggcgatccagggacagccgccaaggagaccgaaccgcatgagcggcccaagcacacgccgaagcccacccctcacggcaagataacaaaagtgcagatggatgatgccgaccccacaaagctcgtatcactggggggcgacatgggcgaagaagaagttgagagcatccaagaggtgctcaaaaagaacatcgatatcttcgcctggagccctaacgaggtggggggcgtcccggcggatctcatcatgcatcacttagcagtcaagccgaatattaagccaagaaagcaaaagttgcgcaagatgtctgccgatcgccaagaagcggcgaagaccgaagtacaaaaattactctgggcgggggttattcaagagattgaccaaccggagtggttggcgaatccagtgctggtgcggaagtcaaatggcaaatggcgcatgtgtgtcgatttcacagacctgaacaaggtatgtccgaaagacgatttccccttgccgcgaatcgaccagcttgtggattcaacagctggatgcgagctcatgagtttcctggatgcatattccggtcaccaccagatccacatgaacccgctcgacatccccaaaacatccttcatcactccattcggcacattttgtcacctcaggatgcctttcggcttaaggaacgcaggagcaaccttcgccaggctggtgtacaaggtccttggcaagcagctggggcgaaaagtggaagcttacgtcgacgacatcgtcgtaaaaagccgcaaggctttcgaccatgcgttcgacctgcaagagacgttcgacagcttgcgcgcggcaggcataaagcagaatccggagaagtgcgttttcagcgtccgcgtaggcaagttgttagatttccttgtttccgaaaggggcatcgaggcgaatcccgagaaaatcaatgccatccagcaaatgaagcctccgtcaagcgtacatgaagtacaaaagcttacaggccgaattgcagcactcagtcgattcctctcaaaggcggccgaaagaggtttgcccttcttcaagaccctccggggtgcgggaaagtttaattggacaccagagtgcaaagcagcattcgatgagctaaagcaatacttgcaaagcccgccagctttgataagcccatccccaggaagcgaactgctattatacttggtagcttcgccggtggcagtcagtgctgcactcgtccaagaaacagagtccggacagaaaccggtctacttcgtctccgaagcactgcaaggagcgaagacaaggtacattgaaatgaaaaagcttgcttacgctctagtaatggcttcgcgcaagcttaagcactacttccaggcccacaaagtcatagtcccatcacagtaccccttgggcgaaatactccgagggaaggaagtcactggccggctcagcaagtgggcggcagagctatccccgttcgacttgcattttgttgcacgctctgctatcaagtctcaagtgctagctgacttcgtagctgaatggacactagtacttgcccccgaccccgagcccaacgaccagttctgggtgatgtgctctgacggttcgtggtcgcacaagggggcaggcgttgcggcagtcctcttttcgccgaatggtgtgccgatttggtacgcagcgagattgcagttcgacacaaccaacaatgcagcagaatacgaagccgttctaactgactccaagttggtagtaggccatgttgacaaatccttcgaggcaaaagaagagggaatgaagaggtatctggaggctgttcggtccatggaaaaaagcttcaccggcataacggtcgaacacttgcctagagaccaaaacgtggaagcagacgccttggcgaaatccgctgcttgtggtggcccacattcgcctggcatctttttcgaagtcctacatgctccaagtgtgcccatggacagctcggaagtcatgacaatcgaccaagagaaactgggcgaagacctatatgactggcgaaccccatttgtgaaacaccttgaaactggttggcttctggtagacgaagcagaagcgaagcgtttgcaactcagagccacgaagtataggatggtctcgggtcagctttaccgctccggggtacttcaacccttacttcgttgcatctcttttgccgaaggcgaagaaatggcaaaggaaatacatcaggggctatgtggcgcgcaccaggctgcaagaagagtggcctccaaagtatttagacaaggagtttattggcccactgtgttgaaagtctgtgttgagcaaatcaagaagtgcgaaagttgccagcgtcatggccgaagccatgccgcgccccagtatgatctgcagcccattgcaccaatatggcccttcgccagatggggaccggacattattgggccattcccggtggcacgaaacgggtataaattcacaattgtagctgtggaatatttctctcgatggatcgaagtcgaacccccttggggcaatcacttcggcagcagtacagaagtttgtatggaaaaacattgtttgccgtttcggggtgccaaaagagttcattactgacaacggcaagcagtttgactccgacaagttcagagaaatgtgcgaagggcttaacctagaaatcaggttcgcgtcggtcgcgcacccacagtcaaatggggcggccgaacgtacaaatagcaagatcctagaagcactaaagaaaagacttgagggggcggcgaaaggcaaatggccagaagaattgttatcggttctttgggcccttcggacgacccccacaagaccaaccaagtttagcccatttatgcttctttatggcgatgaggcaatgaccccagcggagctaggggctaactcaccaagggttatgttctccgggggcaaagaggggcgcgaggtatcactcgaactcttggaaggtgtaagggtcgaagcgctcgagcacttgcacaagtacgccacaagcacttcggcaacttacaacaaaaaagtccgacccacggagctaatgcctggtcatctcgtcctaaggaaaaaggcgaacccagtagcggttggcaagcttgaatcaaagtgggaaggaccatatacatcatcaaacacaagtccaggatgggatcttttcgcctagcgacactcgaaggcgaggagttcgaccattcctggaacgccgcctccctcaagcgcttctacatctagaatgggtggcacccaaatcgccaacttgtaaaaatgtacatactgtcatgtaagcctttcggcactatgtaagcctttcggcaagaaaaaaaacgaaaaaagagaagagaaaaagaaaaaaaaaactggatgtagggctattatccaccatggaggcccgaaccagtataaaatctctgtgtcctccgccttctttttatttcttttcgtgtgattgataatttgtggaaaaaccccaaggcaaacgcctgattagtgaaaaaggccaggggggcgaaacgaatcggccgaagcattgctcgccgaacgttgaaaccgcaacagcttgtctcggaaaataaatagcctaacgacgttacgaccgatcagcataaaagcaaaagcgtttctctcgacacagaacgctacagatcgaaaacgaacgacgaaaagctgaaaagtcactacacctatttcgctactatatgcaaaggggctggcatgttccgacctaacaaaagcacaaagtgtgacgatgcgaaaaatagcgaaaaggaaataaagcacgttctttattagcttcgaaaaaataatcgaagaatacaaggtttacaacccgatacaattcattttacaagtaaattacattttcgccccagtaatcattatccctccctaaggaatggtcggacgaactaggttcgtcatcactactaatatcatacacaaccttaagaggagtagggggcgaaacacagactaaactgtaacgacgctgaaagatcgattcctggcgtttagtcttctgatggttttgccaaaagcgagccatatcctccaaacgtcttgaatgaacaagatcgtaatcttctaaggttcgcccggggtgcgcccgcagccaattggcaaccttgaaaactttatagctgcgaccgtttatttccatttcgcgataaacaggccgaaatggacatcgcaccttcggcaaacccttcaatgccacaaatttctcgttttgacttcgccagctcccagaagggggccgaatgcatgattttcggcaaaccccctggtagacagtgcagaaaaggcaaaacacatcttgcatggtaagaataggcgaaagaaggggaaggtatggcataatgcaaaatgagcgaaataataatatgccaaagactttgatcattaaaaagtggttaaaatttcatacagtccaagtatgcaaaaaagccttttttaaggtctagcggcagtttgccgaatatacaatggttcgccacatctagcgaacaccaaaagaaaactatgaaaatctaagagaagggcggagggcctcacacctctgggtgatcctgggcatcgcctccaccccctccggctgccgcgccctcctcttctcaaatgtccgccgcctccgctttcgccagctgctccaaaaggtgcgccttagcggcggagcggccgtccttctgccaaaattgttttcgccacgcacgaagtgcaggcgaaatgtcttgcgcactgatttcccaatcccccttcgcgtacttggggaactcggcgatgtgctcgcagccgaactgttgcaggaggcccatggtaaaggccgctgacacgcgtgcacagcaatcgccgtatgcggtggtggagtctgaaaccgaaccaccagcctgttgggtccattcggagaagtcgaaggctgaggcatcttcggaggggacaccccgcaccttcgcgcccatatcaataagggcaaggcgaagcatttggcacgctgtccgcgcggactcggtggttttcaccatctcctgcgaaaaccgccgcgactcctctgcagcgcttgcttcggccttgcgaacctcctaccgaagagcctccatcttcggctcggtgaggttataataatctatgagcatggcggtgtgggccttctctttctccagttcggcctttaagcgatcaactttggccctagcttccttccctttctctagttccgattggagccgcttgttttcgaccttcgcctccttaagggtgttggcaagggcctccatctccaaatttttgcggcctagttcgtcatccttggcccgaagacggcttttgaacccatcaagtcgagctcgcacgattcgctccgttgagcagtgagccacaaggatctgggcgcagaatacgagcggggaagagaacaagtgtcaattttaaaaacaagatagaggaagagtaaagataaaaagggggggaaaaacgtacccgaacagccaggctttttatagcagagcacccctcgtcgaactcattcagttcggtgaacaagctcggggcgctggcgggcagtacaagattgcttaccccctccacaaatggaaggaggtccactcgcgtctcgaagtcgccaggggcgaagcggggtaccgagagcgaatattccgaagcgaacgtctcagcgaccgctttctttcccttcgcctccatcagcggcgaggcaaccggctgatgcggaggactgccgaatactttcgccgcggccatcacaatcctttccgcagaagccgaagccccagcggcggtactaccgtccactccagcggcgccaagtggaggaatgggggcggccgaaagatccaggctgcgaccagtgggcgaagtcggagtcccgtcggaggactcgtcatcgctaaaaacgcgagcgacatcgacgagtcctttctttttagccacctttttgacaggacctccctttgccgccgcgcccgaagagaacgcaactagggccttcgccccttctaaatccttccgacgaaggggggagctgttcgactccaccccattttcgttgtgaccaggacttggggtaggagtgtacctgggggtgtcggcgcggtcttcgactgcctcacccgcggccttatcagccacagcctccacctcctcctcttcctctccttcctcctcgccgtcacgttctttggcatcatcctcgtcgtcagcgtcggagtcaaacgaagcaggaacccttcgcttcttgggggcaagcttcacttgtccacgcatccactttcgtgaaggccctgcctcgtcgacggccttttggggattcgcccggggaggcagttcgccattgtaaacccggttcgcccgcctagccgcttgacgcgttaacagctgactatactcgacgaccgaaacatcgccgatcatcctgcgggcttcggcttcggcctggtcgagggtcaacactgaaaaattagagcgtgaagctacgtcaaaagtcaaataaggcgaaataacaaagcacagtagtatatagcaaaagaacagtcttactgtttgcccccttagggagtatcaggttcggcaaaccgtcgacttcttcgccttgttcaaccgcgacttgccatgactgggagaggggaaaaatttgaagcatacaaaattcctccaccaagtcacggcagctaaggcgggagcaaaccttccgcagtagaacgaaccgcgcctccatggtgccgtccacagcgatcttgggtctccggttcggcgcaatcgccctacgccggcaccggagggctttcgctgatttagaaccaacctcgaaggggatggtgtggtagaaccacctcgccatccaatggcggtcccacttcgacatagcagcgttcaccggccagagatcggaccgctcggggcgaacgttgaagttcacgctcccgaacacggtttttttcgttccagccggggtgatcaccatcttcgagttcacggtggcgaaaaatatggcgccaaagagctcggcgttgggctcaaacccggaagtccgacacgcccagtcgaagatagcgatccgaacaagcgccgacgggctcagctgcggaagttccacctcaaagaggcgaaggatctccggcaacaacacgttgcagggaaaccgtagccctgcctcaaaaaatacggcgaacaccaccgtccggttgtcgacaggtttcggcaccacggttttccctggggcgaaagcctgcccctcaaccaacgctccggagctgaccaacttcgccagctcgacgtcgtccacaagagagacccccccgaaaggcggtgctgtcgtcatcgactcggccgggatctggccctttcgccgaagtagggtttggcttacgtggagccatggcgaacggtgcgtttgcggtggcgaaaaaagagattcgaagaaacgcctgaggggtcgaaagatgctgtgaaaggaagagacggagaaagagagcgcgcacggtaaaatggcaagtgtggcggtgaaaaggaaagagcaacgggaatatatagcccgcccaagcgaccgttcgcctacccaccagtaataaagcgccacgtgtcgcaagggtaggtgaaacggtaaattcccgtcgaccgagcggcacagtaaaaagcccaagaaaggaaggcccaatactgttccgttcggcctaggaaaaaagaatatatataaccatcaatcgcacgaggcgaagcgcggcaaaataataccagctgcacaagtaacaaacttcatttgcaggaataatgtaggtttcggcaggagcatcggtcgaaagggggcgccacataccataccacatggtttacacggtctcggccgaagctccaatctcacccttgcccgcgaggggcctgttggcgaatggcatgaggctcttcgaccagatctgccgaaacccgtggcgaaggctatggagcaagaacggcgtgaggcgaagagtcgcacgagagccttgccaggccaggggcgtctcgggcgaagggtgcaaggcgaagactatctgccgaaggaagacgacttcgccatgtcggcaagttcgcccccgcaagggccgaggaagcctttccggcccatcaagcctaagggccggcgatcgctagacggcccatcaggggcccatgagaccctataacattatgtacccctgtaaatgtccctttcataagggtaatcatgtaaattcccctgtacaacctagatcctagtagtaagagcctgcaacagggctataaataaccccctagggccatgtaacgggggatcccaagtgaaattcaaaatttagtacacttcattttcccaaccactgttgagtaaccacgtccttcgacgtatgcagttgtcgtttcgacaacaaaaggtatttaaataacttaataaaatttagttcaaaaaggttttaaagaatggaaataaatgaatcaaagaaaagtatttaagaaaatttaaataaatttttttaaaaaatagaaaatttggtgtcaaaatgaagagtttgaaattagatgaattttgatcaaaggttcactggaattggatttgtggttggaaagatatgagtccctaaagattgaaaataaaataaaaggaaaaagggttactttataaaagtggggcccactgtcaagtgctccttcaacctctttttctcgtcttcttcttcctctcttctccttccagccgggtacagaggagagggagggagaagggcgtcggtgctccggtggttgaacggcctcgacgatggcgtccaagcgtgttcccgagcatcacgcacccggggagggtagaggaaggcagaggtaaagaggaggatggccggaacggcggcgacaagagcacagctccgacaacaagaggaggtggctgtggtggttggtttcggagggggaaagagaggggaaactagaaaaatgagttcacctcaccaaggcaagcccgatggcgcaagtatttggccagtggaactccggtgagggagatcggccgacggtaggtggcggcttgacatggatggagagaggctctgtttgtgtggagggaatgggtggtctcgccggctatttatagacggcaaaggtcggtttgcagaggagagggagaagggaaacacgacgccgacaaagtggagcggaagaaagcggcgccggcctcgccttttgattggctggccacgtcggttctactcgatggctgacgtcggcagggtgacgtcacagctgacgttggtgtcacgccatcagatacacgtgcatgcaacaaagatgatgcagagaatgggcctcatcgagttcggcccagtcgccaagtgagagcaaatccgaaatacattggaaggatctagactaagtaagggatataaatagtgtctaggagactagagagagggatgacttgtaactggaaataaatctatcccaattcttgtaattggaaataaatctatcccaattctgaaatccttcctctgtctcagctctgtctcaaactctgtttctttctcttactttctctccaagttgctgttcttcctttcgtttgatcttgcagattgggatcgtaacattttggtatcagagctcgtctcatccgggagaaaccacggttcaagacgcgattgcagaagcaggttgatgcgatggagaacaaggcggtagacttcgagaagatgctcgctgggatccagaactccatcggagcgatggcggcaaagcaggacgagactcaagtcatcgttcgccgaatggatcaaaccatgtcaagttggaagccacaagttgatgctgttgtcaagggattgcaagtcgagatggaggagttgaaggctcaggtggggcagctggagttgcagcatcaaggcggaggcaattcgtcgaacaacttgggtgcgacacaagcttcgtcctcggcaatcaaggatgaagtggagcgtcaggcacctctacttcccacgttgccagaatttctcgctgctgcagcgttgggagaatttggcttggatggccgccgccctgcttcaaactaccgggggaaagcacatgggatggtcaccacccttgtgccacctccggtcaaaagtacgtttcgatcaactacccctgttcgtcatgctttggatttttcggatgttttggggagagatgatcatgggggtggagaggatcgtgggtttaatcatcggttgcccaaattggattttccacattttgatgggagcgatcctcagaactggaggatgcgctgtgagcactattttggagtttatggcacgcatcctagtttgtgggtgagagtggcgaccatttattttatggggagagctgcatcctggttgcgatcatcaaaggctcatttgcagtttgaggattgggagattttttgtggagctgtagacaaaatgtttgatcgggatcaacattcgttgctcatccgacaaactgaacagctcaagcagactgggtcggtagaggagtattatgagaagtttgatgatttgatgaactagttgttgacctatgatccatatattaatcagaagagtatagtgcataggtttatggagggattgagggtagacataagaaatgcagttttgttacatcgtcctttagacctggagactgctcttgctatcgcttgtttgcaggaggaattaatggaagcccagaagagtaaggagattcgaaaatttggtgattctagtgcaagaattaagggggcttatcctttgccgttaccacctggcaaaagaattggagatgcacccaggaatctgccacgagcaattcctgatattggcaaggctaactcgaccactgacaagatcagtgcactgaaatcttatcgaagggcacaaggactatgctacttatgtgcagaaaagtggtcacctactcataagtgttcagggattgtgcaattgcaagctgttcaggagttatttgcaatgttttcagccgatcaacctgagcaagaattaagtgaatctgatggagaaggatcacagacactgatggcaatttctctgcaagccattcagggtactgttgctggttagacaattcgataccaagggctaattcagggttttgaaatcttggtgttggttgattctggaagttcttgtagttttatcaactctaggattggaactgatcttaaaggaatacaacctttaagagttcctttacaagttcgagtggccaatgggagtatacttcaatgtgaatctgaattgccaaatgccaagtgggaagtgcaggggaacactttccatactactttcaaggtgttacctctcaataactatgatgtgatattgggaatggactggttggagcaacatagtccaatggatattgattggcaaaagaaaactttaagtttacaaggaaatggaggcctagtgcaattacttggggttagttcagatattgctcattgcacagaattgtcttgtgcacaactatatgacatgcatgatcgaggttcagtagaagggatggttcagttgtgggaaattcaggacgagtccatgcaaccaattcctgaacaaattcaattgattctgtctgactttgcagaagtttttgaggaaccccgaggattaccaccttctcaagattgtgatcataccattcctttagttcctggagctcaaccagttaatgtaaggccttatcgttatacaccaattcagaaagatgagattgaaaaacaagttaaggagatgttggacaaaggactgattaagcctagtgctagcccattttgttcacctgtgctcttggtcaaaaagaaggatggatcatggcgattttgtgtggattacagacatttgaatgctatcacagtaaagaataagtatccattacctgtgatttatgaattattggatgaattatgatgaggacatcaacaccatcgatacatccatgtccccccatgtacagcatgatggtcctattacccgcgctcgtgcacgtcaactaaattatcaggtgagttctttcttgagttcatattcctcgtctttataccccggagacgcgtgcactcgtgttttactcaggaacgatggagaggatccaaaaggaagaggattcgcgcggggtggattcggactgcagggcagcgccaacttctgacggctgccacgacttcatgcgaactccgatttgggtgtgcaagtacttcatggaaagcttatcaagtctactttcaaatggatccagccacatgtccatatctgttctggagcggccgcaattgtcattttactcccgactattttctgtcaatggtgctgcgtcacctcttttggcccaatgggctgtgtatccaagttgggcccattaggggcgcgtcctagggttggagcacgaccctatggttgttcttcccctcttcttatagctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatttttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatttaatcgagttatcccttacctctcatcgaaagatcaggccacaaaccctagcgggttcgcatcaggtggtatcagagcgtggttcatcggtgagagaatttacccttcccttcgtcattaatttttttttcctatagtccagaaaagaccaacaaaaaaaaatagtagattagttttcccgtgatcctatagaccattgtgcctttttactagtactgcttagttaaggcttgttgagttttcgattgcatcggttgtgttaatttgctggtcttagtgttaggcgatcagagtttcgagttcttgccaccatcgcacatcgccaccttcatcaattttgccgtcatcaccaccgtcaccaccgtcgcagtcacccaccaaatcactttctatttgtgtttgatctgttgccgatagcttttgtgagttgccttgtatcctgctgccactagaaaggaaatagaaccctgattcgagtgaccttccttaaaacagtcatatctttttcatacggactcgaaattaggcttataatatatccatggacatctacaaaaaaagttacatccgattctccccggctttgccgggttcggcaaatttaaaatcgccaaattcctcttgcaaaattctgtttttgtggcgagaagcttggggacctattcgcatagaactttgaaaataattctacaagcttcatactttgtccgtttgagataagattttctgtggttggttctagtgtgctcctggttgtgaaaaaaatatcaaaaaaaaaaaagttgtgcctctctcctcagcactagagagagcaagcaaaaaaaaaaacaaaaaaacaaaaagaggatccagcgagcacaccccaccattccccctttgtcaccaccttccaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaatgtggtttctagttttctcttgagcattgctttcagcccaccaacagctccaccacaaacccgactacagcttgacaggtcttgttgctacagcaccgatacacctcgttccacggttgctaacttgtgggttgctgtccccctcctgtgggcaaggtaagaactggtaagagcttgtgagacaagctgcgagtaaagtgagagtgagcgtcttgcaaaagctacatcccaatagttgtgtagggcttacattacatcctccattgttttgttgtccttcatttctaaaccatggcaggtccagaggataaagatgaggaggctgcatctcattccccacgcaccaaaggcatcatccaatactttacaaggcaagtgaagcagcacacagaaggacttgatacagatttgcaggtgacaaatgagaagattggacaattggagtccacgcagatctccaccaacactaagcttacagggctggagacagcggtcgcccgcat

SEQ ID NO: 74626 - DNA, 724 bp, Oryza sativa
cgccgcgaatcccgccgcccccgtccgcccagcgtgcaatcaataggggggaattattccccgggatcccctccctctttccccccatttttccctccctctctccctcggattcgtttggaaacccctcccctaacctcgccggcgccattaatggcggccgggtcttccgcgcccgtttccccctcctccggccgccctctctcacccccaaccctatataaaccctccccgagctccccaccaccgtttccgccactcaccgccctctctccccgccggaatcgagctcgcgccgtcgctctctctctccgccgtcgccgccgagctccggtctgccaccgtcgtcgccccggaccacctcccacctcggcgccgcctccttcggcttcgccgcatcctcgccgacctcgtccacctctccgtttcggtcgccgaccgccggagcaccgtcgaccccgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatgtgtcacgaccggaaataacccaacgggcgttccttacgtgcgtgcattattccttgtcccaggaggcaaggtacaccaaaagttgatacagttcggagttcaacaagcggaagcgtaaatagt

SEQ ID NO: 74627 - DNA, 4032 bp, Oryza sativa
aattgacaatgttgatatccatgtgattgtatagtgcaaatttagttaccaatatgcactatggtaccaacagtgagatcccatctcaaaaaataaagtgagatctgagagaaccatggttgtgttaatgcaagccatttgctgattttgcttctaccttaatttaatttattgccctaaagtgaggtatagtattattctgagacactagggtgcatctctatacagtgtacttgtgttcaacatccatgaaattggcaaattgctcctacacatgtcctcgtagtgcttgactttgttgaccctgtttaatatgaaagttcaaagtgtagaattggtgcattttcccccctttagacctaatgctcctggattatttcatgacattgtctaattgctgcatataagacttgaatccttagtactattttattaaactttgacgtcttgattttttttcaaaatgttgacagtctttgctgtcatgagcaaatgagtacgtacaaaagacaaataagaaaatattagctaactagtgataggaaatttaacttgaaattatatatattgataatcatcaggtattatatcttctggtaattgcaggcaattgatgatgattgcaaccaaacaggacaaatgctagctgggttgcttaattggccacaaggaacctttgcctcaaaggtgtgttttttgttactccttccattgctttttactgctgtcatgattgccctcgcatgcaagtggggcgccaagagcatggcacagcaggctgggctgggcttgtcattttaagttcattacttgaagatttgttctccccttctcatcacttccccccgtgcctgttaatcctctcctcaaacacagctcctggctggggagatccagggccaaaacccccagttacccaagggttgtcccattgatatttaaacctagacaaccattacctttaatttgattaccaaatgagttcttaacaatgtatttgctccttcaatttttttctgcatttaaatgatctgctcctagaccctaaaccgtatgaagctcgtgttgaactttggtatagtttctcccacaattgtggaattggccacataggaccttacagtttttttggtttgctcatttttgtccttctgccatgtggcgtcccgtgtggacttgtccagtcagcgccttctttccaatttagactatgcaagtgactgaaatgcgtgctttgcatcacctgaaaaaacaaataatgaactacatagggtcatcctacatcgatggtaagaaaaattagggcaattcagttactttatatagtttgtagcatttgaaggccctgaatattgcctgcccgaaccctggatattgcctgcctgagaccatctgtgatgtcataagaggcattaccattaaaacaagccaactaacgaagctcagggcgctaacataccaattcacagttgaatgaccaatttgagcaagaagcaagggaccaaatgaactattaatctttcagattgtggaaggaatttctgagcactgatggaagtttgctgttccgtttttttaatcccattttaggaacattaattttttcttctttcaagatatctgatttccttttgttggccgaacatagtagagcaaccaaaaaaaatcactgtaatggcgttttctatgggttcacattgaccaagtgtttattggttttctcttatcatggtgtttccaattcaagtttgtgttacacaggcagttgtattcaaagatgctgtttgattctggcaggttatattgaacaaggaaaaggctactgtggagagagaggtcgatggcggaatcgagaccattagcttggatttgcctgcagttatcacgtatgttccatgaaacatttattttctttcttttagttttatttaacaaggctagtacttcgattcttcataagcattgcgatcatttagtgatctctgtcacatagctggatctttgtattgcattgtggttttgagccaatttcagaaattgcctaaactattgtttgatttttgtgacagcacggatttgagactgaaccaaccaaggtatgcaacattgccaaacataatgaaggcaaaatcaaaagtcatcaagaaagtcacccccgaagatctggatgtagatatcagatcagacatggaagtagttgaggtcactgaaccacctaagagaaaagccggtgtcattctttcatccgtcgatgagctcgttgacaggttgaaaaatgaagcccgtgttttataacattctttgtactaatgctcatgagctaaggaatgtggcatagggaaataaagtgtagttataaatggtcatcgtatgcaaataaaaatgtggcgttcccgtatagcaccagtatacctgctaatggtcatcgaaatgctagtgtgtgtgtgtgattttaagaagccatgtaagcagaagtgttcactaaaatcaatcaatctttactcattcagaaaaaaagataattctatttatagaaataaagatctaggcatctagcacacgtatgatgtggtaaaattagtttcgtctccactagatatgccttgagctctacaactatttacgtttcaacctcgttgctgttgtttcgtgggatgtagtgctggcttggtaaaggtaatttggttcaaagctgaaatattttcaagttaataaatcgagaggacaaaaacattgagctaggaaagtgttcataaatgggaagtgtctgatttttcttttaactgaaggagctcatgggttgtacttggaagcagcttctcactaaagtcagagatataggtccaaacaggagggactcgtcctcatggacccatacatcaaaaacacacatcccaacttatataggccgtgtttatgtcccccttcaaacttccgaaaatttcgtcacatcaaatatttgaacgtatgcatggagtattaaatgtggataaaaaaaacaattgcacagtttacatgtaaattgcgagacgaatctttagagcctaattactccatgatttgacaatgtgatgctatagtaaacatttgctaatgatgaattaattaggcttaataaattcgtcttgtagtttacaggcgaaaaatgtataatttgttttattattagtctacgttaaacactttaaatgtgtatccgtatacttaaaaaaatttttgccaagtaactaaacacaaccatagtatattacattacatgagtcttatcaggttgtattatcagatcgtactaagtacatgaataaatgggagtgacatacagtttgagccgatctatacatactctcttcgtcccaaaaaaagataaatcctgggtttccgtgtccaacgtttgactgtccgtcttatataaaattttttttataattagtatttttattgttgttagatgataaaacatgattaatactttatgcgtgacttatctttttttttcatatttttttcaaataagacggtcaaacgttggacacggaaactcagggtttgtcttttttttttgggacagagggagtacaaaatatcactgaccccctggtggaagcagatcgtctgacgttaggcgcacaacgtcagagggacgtccagcgtcgatccatcgtccgatcgacatctcacggtgctgctgcttccttcgttccgcatcgcacgagcacggcgaggacggcccattcagcccatttacgagcaaccgcggagggacaaaaacgaacgagactgctcgtcattcgtcaatctgccatcgcgcaaaaaaaaagaaaagaaaaggcaacccccggcatggctgcccaccgctccgctgtggctcgcgcctttctcgacgcgggcgtgagaggagcggactgccgagaaagactgcttggacctcgccctcttctccatccctcggccccatgtcttcccccacgcgagagcttccaggcattgccgtcctcgacaacgacggcttccacagcggcggcggcggtcgcg

SEQ ID NO: 74628 - DNA, 631 bp, Oryza sativa
gaaaaagccctagcgccgtgtgccctagctttgcagtcgccgccgccgctccagccgtgagccgccgtcgtttcagccgtcgccgtcgctcgggaaagaccaccgtcgtgctcgccaagtagtcgccgtcctcgtccgccctttcgccgtcgccggagatcaccggagcagcatcgccgtcgtcgacccgaaggttcccgccgcttcctcctcgtcgccgtcgccgtccgttggtcttccgccgccgtttaggtcaccggtgagttcgccgtgttgtcctctacgtcttggtgccctccgtttgcgtcctagtgccgccgttcgccggcgagcgtgcgccgttcgagccgtctcctccgccgagccgccgccgctgtcggtgacgtcaccgctgacgtcattggggtcgtccgccgtgagccgccatggacccgattgatctcggccgtccgttttggattggttcgatctcggccgtccgttcgtgtgaaccgccgcccgtgcgcccggtccaccaaaccctagccgctgacgcaataatccttcttttccttttcaaaaataattcattattgcgtcataattcaatttaaaccgatataagtgttttaatccgatttaatctttaaaa

SEQ ID NO: 74629 - DNA, 4458 bp, Oryza sativa
tggggatcgcggtgtccttcttgtcgcgcgccatcgtgcctttcgcccgttcctaggtggcggaggcagcaagaaggctagcaagaaggctatctcgtcgtcgtcgaggaggaggaggaaggtcgggctggagctaagcttccacgcggaggacggtgtgtggaggaaggagatactgatggaggagcagtgccagtcgttggacttctccggcatgatctactacgacgtcgcagggaggcgtctggagcagccgccaccgccgcgcacgctgctgtgcagcccgctgccgtcgtccatcaagctcgcagccaacgccgctggcggctactagccagagacaccccctgctctcacgggcttgcagcaaatctctgaacttttggagcaagcttagccagccgccttcctctgctttcttgctgcttttaattttaccttcttcgacatagcaataggtctctgcttctgatctttctttttctctccttcccttggtgtgtgtagtgacaagtgatcacagatcagtactatataaaagagttctatggaagcttagcttatgttttctgaaactagctcttgttttacaactcccactgtttacaactataattttgaatctttggtcatctagttgttcattagtaccatttactctctgactactttttagctctgcttttgtcgccgaaatccatgggagctccgccgccaaggaacgtctcggcgacacgcgcgggcggtcagcggggggcttgggggtggggacgaggccggtgccaacggcatgctacacaaccacgccgtcgactacgcgctagcacctgtccaccatgggcaagccaatagagcttgctacatgtgagcatcggaactcggaacaaactgaaagaagggaaaaaaagataagggcaaaattgtcattttatgtgatttctctctcattgattgagtggatattatattttaatgcgttcagtatccagcagcaaattaccagaattttgaagtgttctcgagcaaattcacatctttataatgttccacagctaattacgtatttttttgagtgtccttagcaaattttgcctagaaacaattgagatgatatgccatatttatgggcgatgcgcaaagatgggcatgaagaagaggtggaaagctattcggtggataacacctaccataagaatgggatggtgatcgaatggtgtgacggggttatgtatttagataggctcttgaaccggtagcttcactttggtatgaatagtcacggtgccatcgccgccgccaccaccaccaccaccatacaacctactatgatggcgtacaggaatggtagtttcagtgatgtccccgcgtacaggaacagtgggttcggtgctgtgcccgcgtcgagcacggccatggccgagctgcaggaggcttgggcgagcgaggcaaaggagctcaattgcatgcgctgtttaactggaggtctttgaggtgggagagaagctaacgaggatgtcctgctctcattgcttccgtgggccctgtatctcggattggctaagggtaagccatttctacctgctctgccaacagaagaacaatatatgaaaataactctcttttctgtgagaatttaatttcgtttgttcgttaaattcaaagaaccagcatgttgtttatttttggattcttaacacactaaacctttcttttaaacctttatttgtgatgaaaaatacaagggaaaattgtgtaccagtgtaacctcggcccaagcctatataacccatagcagtgaaatgggccaagattaataaacatgggaaagtgctgagcttttactggccaaaatcgtgatggacttcgagccactcccctcagccgccggcgacgccaccgccgacgagactcctcccggtcgcgccgtctgcagctccggctgcggccgcccaaccaccgtctgcctctgcccgtaccttcccgccacgccgctccccacctccaccaccgtcgtcatcctccaccacccgcacgccctccgccgcaacccgctctccaccctccccctcctcgcccgctccctctccaacctccgcctcatccccggccgccgcctcctcccttcctccgcccccgtcatctctcgctctcccgtcctcctgctcttcccttcgccggacgccgccgacctcgcttcctggtgccgatccacgcctccgcccgcgcgcgccaacccgacactgctactgctcgatgggacatggaagcaggccaaggagatgcacgccgctagcctcccgttcctgtcctccttcgccgtccccgtctcgctgcccgtcgactgcggcgttgacggcgacagcatgttcgagggggagcttgtggtgaagaaggagccgcacaaggggtgcgtgagcactatggaggccgtcgcgagggctctgcggctgctggagccggaggggaggggagaagagatcgaggagacgatggtgggggtgctcagggcgatggttgccttccaggctgagcatttgcagcatcggccgatgaaaccgagggtgaagatgaggaagaagaaggatattaagagggaggaggagatgaagaggaacacattggactggagtgactgaatcactgaactactgaagcatctctggacacattggactggagtgactgaatcactgaactactgaagcatctctggacactggacatacagtagctcattgccgaatcgttgctggtcattttggaggaatatcgctaacattatcaccaatgagcaaggtttgatctcttttggaagcatagtctacggttactagttctttatgaaaactaagtgagatgattacattttgatggctgtatctcaaaaattgcagcaaccatgcatgtttgactgttcgaaatgtttcaggattcaccagagtacctagatagactaaactataggaggatcatgaatcatgctgttctctgttctgaagacacttgtagggctgaagttctcattggaacttaggaaggaatgaactttatatttttccagagtaaacaacactgtttatgctactagatagcggggcttggggggtctacatgaacaattcatggtaattaaaggaattgataatcatcatgtagccaatgctaagcttgaccataccgcatatgtgctgaactcctgcttggctttgttctgcatcaaagaaaattgtatttgtttagattggtttagaaatgtttagcaatgttgtgctagctagcaattcagaaatgttcagaaatatttgtttagattagttctgaaatgttcaaatatgttcggaaatatttgtacagattatttctgaaatgttcagaaatatttggtccgactagttcagattatttcttgaattcgtataagttcggtatgttgctatgtatgtttttcagatgcacatgtacagaactttacaaatgtagtggcctagactagagcagtgtattgatcatcttcttttagaggatttatgagaaatattgtaagggctaaagggcatgacaattggtagtgcccctgtggggttactttcagtttcagtaatattaacctgtatatctgtacatgtgctagttatacagtaaattatctgctgtagctagcaactccactataaaacatgtcaaacttggcatattcttaacttgatgcaatacatgagagttactgatcaagtagtattcaattttgtaggcagatgctcacaagaatattcatgacttttgtgatttctgtaaacttgttcttcggttacaagaaacaaatgcgtaggttgatattgcctccatgattatcccaattctttatttgtttgattatgaacaaaatgccgtggagtgcagatttttgtttgaagtgcaggacattcataacagtgtactagtggcatgacatttggtttgttgcttactgagtgtgctccttccttttttattttgcaacttatgtgaccttgaccttttgtagtgatcaagagaaggagagggcaggagatgctttaagtgtttcttgagcaatttgtgcaacaggtattgggaactgttcttgagttttgcttttgcatgcaagttggagatgatatttcttcgacagaaatatgaggcggttgaagatggatttctaagcagaatgtgggttgaatgcagtttactgatgtcagattgttttggagctgtacctatgattttactgggttagatttccaaacagtactctgttgtaatgttctcttgtttgatgtaatgcttttctgccactatatgagttctgccttagtgaaaactaggcacaatctaaaatttcttgcgaggtgacccaagtcgttttgttaactttttttttttcgagaatacgctcaaggcttgcgtatcattgtatcacaagtgacgccgggggggggg

SEQ ID NO: 74630 - DNA, 677 bp, Oryza sativa
gatgattcagaccgaactggcaacccgaccctggtcccagcccgtccaaagccaacccaggccaaccattccacattttagttgttaagcaggtttgaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacaggcggaagacgtgacatagttcccaacccatcctagccatagacaagagtaccgacccaatcccacctacggccggaacccccgggacaggcaggcaggactgagccccctagcagcaggacatgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggcttcacttcacaggcagcttgaccaaggctacacctaatccttcacaccatcagcctcattgtagaactctttctctgatgaatg

SEQ ID NO: 74631 - DNA, 30507 bp, Oryza sativa
gtattagcaaataacatcattcaaggtattagtatttattggttatttaagctaagttcagatacatctttaatgtatcattaaaatgaaactctgctgaaattggctagtaagttagttcatactaataagttctggcaaaaatgctgctacatccacgtggggtataacttgattgattttaaacagcctacatattgtataaaaccaagaacgattactgttcattatggtgcaaaactggaccagacagttcttgttttgaaagttatcaccactgctggctctagcaccacataacattattgaattacaattactgaccttcaagcctttatagagtgctcgtgatctgcaagagcgaagacatgaatggtcatattcagatttaacgtactcttgaagacgatggattttctttcttctgcgccattgcttccaagaccaggcacaaggatatgcaagtactgaaagtatactatgtatagatccttcccaccactcgtatgcagccaccaaattgatctcatcgataaaacggttaaaagcatcttcatatctggcaaaaaaaaagtaacaagatatcacctatggcaaggaatacaaacaaaatactgatggagacatgaacattcttcggaaatatatatgacatagttgggatggtgcaagtaaaatatatgggactttacggaagatcgttattcttacaaattgcatgagatgggatggtgcagccgtgcaggtacattgtttggttggttatatagcatggtaggagactatctttggtaggtcatttggtagttttttaaatgatatgcattatattgcctgtagcttagttttttaacatgattacatgaatattcatttctgccaataagttcatgaaaatgaccaaaagattatttggatctttaaaggtatgtttttatatcgagtttcatctgtaacatcagtactaagcatgacattttgatctgagtctaatcattataattccaacttccaatcgctcataaagaacaatgcaattcttatgcaggtagtaaggtatgatgctagtagtaggatgcaatgtagaatgagccagctattaagaaatttaaatagtgtatgttttccctgttcaacattagtaaatagtaacacgtaaagtagctttttactatagaaaatgtatttacattgtgaatcattatgagatgaaataactataagtgatactctgctaatgtagattcttagaaaatcttacacgattccgattatagcatcagggggtgagtaaggaaggtgccaaggttcccggaaggtgttaggtcccatgaagtacattctgtgggcatggctttgtgtttcttctgccctgctagccccaggtacctacagaacaaatcagtgccaccatttatcgaaacaaatacaagcagaaagatttctttaacaacctgagatagaaagcataagtggtttctggacatcctttaaaatccaactgcactttgaatcagaaactattggagaaattatgaatttgtaaaaatcatggattgagcatttgactattgtgagttgacgtgcagatgccagatctagtgatttcacaatggggaaatatccagtgaaaaccatcaaataagtgaaaacccatgaaagccatgcccataagttctctaaatttagacatagatataggcattaaatacttttctaccaaatcgcaagtccaaatacagcttcatttgagaaataagacaaatttcaggtgaatagcgtcatgttactgttcacctgaaatttgtcttttttttacgcctaaataaagtttgagattcggtgggaatgtatttcatgcctacacctatctctagtaatcttttcataaatttacagaacttttaggtccagtttcacgggtttttacttatttgatggttttcatcgtatatgtcccctttcacaatagctctacattaatatttaatcgatcctaagattatgttgtatgaattgatacatacctcagccaatgaaagcaaaaaggggaaagaagcacagccatcattgtggattgcatttgttgaccggtatgtgatgtcactctcaccaatcttgactctgagagcacttaagacaagtgccaaaagaataatggtaaaagataggataattgcaaaagaccaaggaccaccaaaagtataaataagttcctcaagtggtgtgtaacagtttggcatcttgtacttagaagatatgcacttatatgggcaggacggctcggtaacaccacctagcatgtaaaaagttaatggttagtttctccaatttaacatcataaattttggagttacaaggcaattaaataattatagttccacataagaccatgtctttccaaggacctacctcttacatatatgaagtcagcgcggttaggaagactatccagagaacaaggcatacacagagatgaatcggacccaacaacatttttgtatgtaccgattgggcattcctggaatataatttaatcattactggttgcgaacaaactaataaaaagcatttgctagttaccaaaacaatagtacataaaaagaaactacctagttgcaaagtattgaccatatcaatataggatgttttattagctcatggatacagatagaaaacccggagtacacaatgaaatcctacatagttcagttaaaattaaaagcgtgtctgaatttgcaagtgacacagatcaacctggccattatgaactgttaaaagcataatataaacagaggtctgtgttcaactaactgttggttaagaactctgagcatcaagcagtagttattttggcaaaatgttgcttaagattatagcagtggcacagttatttgcagttttgcaccctctggggggcaaacagtttacgtagtagctgccatgcatcaccacaaaaaccattatttataaggaacaaataaccaccccatcctggtatttctggataagggcgagaaaccagtgtggcaacccaagttcaaaatagtttatctacgagtggtggtgatatcagaggacataaaatctcctctataacccctataattttcctctattcacatggagagaccaaattttggctcctattgcacacatctagcatgaggttaaccaacaggacagaaggacacaactatattctccctcttacatataagccttatatgaaataaagagattaaatttcttgaatacacacatttaaaataataatattatttcctatggattaggttattatcataacaggaacatgaagcaataaaggcacaatgagagaagtgctcatacggtgcaaaatgttccatatagtccaacaggacacttttttcctgttactgttccagtttctccaaaatgtccatcatcattaccagatcctccactatgcaaaaataaaaacaacaataaattttcagaatatttttttctaaattctagtactcaaatactttttgttctagctttgtcctaagtcaagcatgtatatctttgaccatcaatttttagaaatccgtatagttcaaaatatgagttgtatttattaaagtatttgtcagtgaatctaaaaaaaaatcatatgatgttaaaccatatgagtttttaaaaattgatggtcaaagatatacatgtttaaggacaaagctagaacgacaagtaatttgaaatgaagggagtaatacttttcaggatcaaagcaacacgcaaatttaattccatgacaaataaataatgggccatgcaacagcaatactagtaaaagcaggactatatcctgaaggtccacgaggatggtaataatagttgcattcatgaagtaagcatgcatttcgaaaaaagatgcacaaggttgctcaggatcactgatcatgtagcatactatctgtaggtccctgaacacaaaaactcaactggcaggacactaagcttgtagcgtagtgccacttgcaccattttgagtacagctaaaatgcagagattacactgaaataaagggataaccatgattttgagcattaattcattatgggaagccaaattgccacattgatcatccagcttaatagttgacatttttcttttgcaatagctttatgattgacattagtttggaacagctcatcagtggacatgtcactgtatctagttttgagacatgcatctacattagaaggcagaaactgattttatgatgacaaccaagcaacctcttttactatatgcagttatcaaatagccatagtttgcataccttgatgctactaagccgttgacagaagcaatctgaacatactcatccccagtagcaatatttgaccaatggaaatggattctaccaccaccaccacctcctccaccaattaaacctccattgccaccagaagctgatagtgatgagtttctctctagcagaagcccttgaagaaataacaggattgtccctccagaaccaccaccaatccctcctttatatgtcccattcgaattttttttagtgcctctatggctttcaccatcagagctcaaggagccataaattagcaattttgatagtggccatttcatggatccaacaactggattacgaaattgtcagatattagaacataaaaggaatacaaaaaacattgcaaagtaaatgcaattagtttcagaaaagaaaaggtgaattacatcaaagggtaaaatcagtataatatgcttatttgcaatgcattacatatgtcaagaatagaagaatggaaagcaaattgcattaactgtatatggggactcatatgatcaaattaaaaagcttgaaagaatacaaaaattcgcatggaaacatctaatatgagggtacaaaggatataaaagactgcaatataggattacaaacaaaagatggtacctaccaattaatcccccaccagcagtgttatcagttgactcagaggaaccactgccactccctagctcacacggaagatcagcactgccatattgtggacctccttcacttctcatcccattgtaaatccctatgccaccccggcccccatgcccagcaccaccaccagctccatatttgagaaacttccctttcccaatgccttccttgcaacctatcaaagaatccgaattgatgagtgcacaaagttataacattgataaataatgcattccagttgctttactgattacatcaagagaacacaagaatcacctaactctgaagcacttattgtgccattatttgtaacagtgacagttcttgctcgatgaatgtgaattataatccccctgactatgccactgacagttatgtcttcaacacggcaaatctgcaaaatgtgattttattaccaagaaggcagaagcttaaacacaatcagcacgcctcttactgctgcaacttgtcgagattcacatttacattaatataaacacaaatataacaataagtatagcactaatgtactatcgtttctatcagcacaattgttcacaaggaaatacataaatattagtgaaacaatcaatatacacgaacataagggtgtattttcattcagaagatgtccctccatattaaggctttgttcagcatcctgtgttggaaacacatctcttgcgcacggaaaacggagtggtccattagcgcgtgattaattaagtattagctattttgttttatttttttgaaaaatgccatgtgggcccatgatgttagtgtccactatatgaagacaaaatcccttctatgaccctaaaagtttagctaatcccttctacacccctgaattttgcttacttccttgtatacccctaaaatttgattttgatcccttccatgccccttccatcagttgactgtctaatttctataaaaataaccattttaccctttggatgaacataaaaatttacgaattacattattggaaatgtaaaagtttgtcgcatgagactattatagttatgagtttgatgtgtgacacattatttatgacaaaatatttttagataatgaaataaaaaatacgtatttattttatttttaaaagtcataaaaatgaggagcatacatacaaagataggactgcgaatgctcaccatattttttttatgaatgctcccgataaaaaaaatctattgttctattaaattttaaataaaaatttttatttattacatttgttttattttcaaaatttatgttaaaattttccgcactaattatttagtcccattttctacataaaatgcacatattctgcactcaagcaaaattttcaatcgttttcaagcttatattcaaacctaaatcatcaagggcattaaagacatttgccaccaacttaacggtgaaatgaaggaaaatgtgacggcaagggcatggaagggatcaagttaaatatcaggggtataaaagggattgagtgatttttcaggggtatacaggaaatttactcctataaatcaaatacaatgtgtataatttatatcaattgttcatcactatgagcaattgtgtagctcgacatacatgtacaagattgtaccaaatatgatatgatgattagagtgggaataattttattttgctttttgggctttcatgtgatcctgttgcaacatacgggtatttagctagtttgtacaaatatatgcaactattagtgtttgaactttgaaatctgatatttgccatttaatactcgtgtgttacagataatgttgtatgagaaaaaatgaataagttcaatgaaattcagaaaactggcataggctgcgttcttttctcagttcaacagtgattacggaaaacggagcgatccattagcacatgattaattaagtatctgctattcttttttaaaaaaatggactaatatgatttttttaagtaactttcgtatagaaactttttacagaaaaatgcaccgtttagtagtttgaaaagcgtgctaacggaaaacgaggactagaactgagaaaagaacgcagccatagaatggagaaggttcatgttattgtatgaccatgaaatttgtagtgcatatgtcaattgacgtgatatgcaggtaaaacacttccataatcaagtagaccgtctataagacctatcatgttggacactgggatggaaatgattatgaaatacacaagtgtaatttaaagtccatttgtcacaaccctccactcagagagcgtctctgattaatcctctgttatcacttaaaatataaagctaataaaataaatgagctccagaagaaaagaatatcatagtgttaatgaactatccttacttgtagtgtgaatgatagagagttgttaacatggcaatcatcaggaggtgtgattagctcactggggcaagttttactttcacagcgtgaaagggcatccctgataaacacaaaagttattccacggcattatttaaaaagaaataaagataattagtttcacagtgacatgagatatcttacaagctgctttgaacagcatcatctagtggtgcctgaacaaatgaaccaggaccaacctgctcatagtcatataaagggaggttgttagtttcgaaaacaatcaaatggagaaaattttaatgaacacaagatggttcggtatgggcagctgaaaataaaaatgcaatgaataaactccaaaaaaatataatggcatagaattgagaatacatcaagttgatttacttgctagttcctagtatccaaagtaattgattcatcgctctaatgcagaatacgacagaagaaaattataccagtgtcattggcaccgaggacctatttgtaagaaaaaatatttacattttaacccttttcagaacttctttacaaataagtcctcgcaccagtgtcatcggcaccaacccccttcacatcagtggcttagcttccagggggggtgagggtatcggagccagcatcgttagcgagacgttggacctcggcaccagtaagtttgttttttcaggggtctatttgtaaaataagtttccaaaaaggactaaatgtaaaaaaatccagctacatctactgtctaattccatgttcttaaaccccaatctccttcaaagggcactgcgagttcaaaagaacagcgaaccaagcttacagaacgataaaaggcacctagttctagctaatcacattcttaataataggagatgtctaatcgtaatactaggttaatatattttgggatggagggagtagattatattaagaaacagctttaaaaatgcccctctggtgcagacagtctgaaactctgaatgcaacccagctcaaacatttactttgtaagttatagggtctttaagaaattataagaaactaatatatttgtgatggaatatagtatatcaattgtcccagcataatatgacttagtggatacctagtggaaagtgcatataaaatagaggtattatctagcatatacaaaaggtaatgtatagcataaagatacactgtaccacaaatgttacaaaaggatgcaattaatcttacttcaatgttgtaaaacagagagagaaaaagtcggcgtgcttttattccatcaccagggccagtcaagttaagaagtccttgcccatagactcccaaagcagcattcgaagatatgactgacccatgctgtagtagttacattaaaaaaaaattaaaattccacaactaacaaaaagttgacagtgagttttttttttcaaacaacataccctgagtacaacaaggtttctggcctcaagcatagatgcaagaacaacatccttacccccaccatctatctgaatctcagaatcccacatcaagagcactttcacatacattctgaaagcaccatagacctttaacaagaggtggaagttagaactacagaaaatactaacaatgtttgaatggagttgccatacactaaacttaaaatgctctatatagcagaggtgacagatccaaaagaacccatatggcaataccacataaggttcaactaataatacctacatttgatcaaaaataaaccttagctaatttatttatttttaatttaactccactgtatcaaatagcactttcatgtctgaaattgctgaacgtagggcacttcaccaacacttgtggagcaagtgggtgaaccacgtgaagtatctgatgctccctcacgtgtcaaagccatgttgggtaacacactcgcatggtaggatattgctactccgctttcaggagttgacgattctactgatagtgtgtaacagcaatgccacaagaagtcctaaataaaaaccccccctgtattgctgtgggaatttgcagggaacaattttggacaaaagatgataaactttgtacaatctgacagcatcgtgatgaatcgaattgcagttccgttcacaagtgggctctaatgcagcccaaacaggcctgtgcatttggctggcctggtaggtttagcagcaggaactactaaaaaccaaagtatccaagaacgccaagataaaatctaatagctcgcgtattcttgctgtggctcacctaagagtttctttatagcattaattgcagctagtgggtcacaactcacaaactcaattatatagaaatatagggaaaagattaaataaaattaactataaaattcatgccatagggtgtggagcaaatcagaagagtagcatgaactaacaaggtccagaatggtatttctataaaaaaatatgtgaaatgaaatccacagattactagtccctccacccacaaataaaggcattttaggttgtttatacaaaaattaggttaaggagaaaagactttggtgccccttattaaatgagggatggttggggatgggagggctgattgggggtgcgatgggaagaaattttaatgagatgtgattgatggtacaggtagtactctaggaatgcttatatttgtggacaaaagtcaaacacatggaatgcttgtatttgtggatatagggagtactatacatatatatttactgcaaacagaacgggacaatttgataggtgaaatttgggtacaaaattatgaattattccatgttatggccactgaaaatacagccagacgcaacagcataatccttgctctacaaagatgccacagttgcatccaaggcataggtcatactgtcatagagtatcaccacaaggcagaaatcctacagctcagatcaaatggtgttaaatatgtagttatgcaccacatataatttccatttgtcaattttacatattagcccgtcgagtcacttgacccctcatgtttcacatctctcaacaacttataaacactattttataattttcaacaacaaatatttacatacttcatttgaggtatcattgttgtttcaaaacaatataaagaaatttcatatctctttcaaaatttaaagatgtaacataacatttattagaaaccaagtacgagaatgttttttttgttgacataatttaaagtgtttcaggtaaatagcataattatatgttatttatactatcccgtagccggggtgatagcagtgccctgccccggcactaaagatgatatctcatagcacactataaaatatataccgagttggttaattacgtggggcttatgaatcattttggcaccatcaatgattgaaaagacatacctttataactgagtcactcattaaaagctcttctgcaaccagctcaaattctgatattggattttcagacaacccaaagctgatgctacccttgctaagtagtctaatttggcctgtgacctgataaatagaaaaaaggagagaatgtattagtggacaggcaggtacgcataagtggagatggtaatacaggaaacaataaaaagcagcacctcgcaaaataaaaataaaaagagcaggtaaaagggaacagatatgtgttttaagaactactcatttactggtgcttgctggatttcatagtttcattgtattctgaacttatacagatcactctgttgattcatttcctcatccatggttttcagatagaatagaaaagctggcttttgttaggttattgttcggttgtttgctaccccttgtcacattaaacagactagccccacgttatcaaagatcatacagcatgaaaatcaggcacaactgcgcatcaacttctttcatggttttatatgtatcaataatttctgtaaaaataattgtctgatggcccgtgtaatggaaaagttataattaacgacataaatataataagctaacctgaaagatagaaaggaaaaggcacataaggaatgaaaaaacataacagtagagtgagaagaattgccaaaaacaattattacatgtattgatactcttatgacattgcactatatgacaacagagggccaccacaagccaattcaaatagtgctactcccaggcacccatgtcacaacctagtcagagcatagcagcatttcaaatggtggcgtcaaaccaactcaaacatctggcaccacagtacaaccacattagcttgttactagagtgaaatggattggattagaccaatgggtatcctaacccacatttttttcccaaatttagaaatgggtacaattaagcataataaaattaaggtaggtcggagttcagaaatcggacaatcaggacaggtacatgaccacttcagataggaagcaaacaagtaaagcaagatggatggcatatgcacatatagagcaggatatgttgaactaaccagaacaccatgttttcaagccttcaactattaatcatgcgtatgtaagtaacatgtatcagcagcctgcacaacaaagtgacaaaccacacagcaatatgactcatggctaggtggcttaaccctcagcccggtgatctcattttcgactcctcaaagccgcaatactacttttggtatgagcaaaggaaatggaaatgagctcgaccgagctgattgaaaggtagtgatgggctggaataactaaaaagctcaatataggatatctgcacggattcagattcaggaaattgctatccagaggttttcttttttctcgaaaacgcaggagggctgcatttcatatcattaagaaggaagagtaaagtaaatttcagaaaactccatcttttatggttaaagttgcagaaaccacatgtattatggcttgtggcacataaccacaggtttatggtttaagtgtttcatataaccccacacttattcaaatcatattaaatttatcatatctgaaacattattctatactacttaaaatgttagtagtggtggtgtccgttcagccacaccacctcctaccactgatatttagaccccacaatctatagtattacaccaccctccaatgagttctctcccgcttcattgctggtttatcttaaacttcgaaatcacctacttattcaataaggaaaatcataaaagcattactttgactaaatatgtgcttaattgacttaataagctataaactgaatttgttccagagcaaagcacgggctcttagctagttttttaaagtagtgaagaatcgaaccaataaccttagtcaagaaatcaacaattaaaattttcatatagacatattttcaaattttatgtaaatcttcactcaaatttcaaattttgtgaaactttagaaccataataactgaggttatgtgccacaagccataatacatgtggttttctacaactttgaccataaaaggtggggtttactgaaatttactcaaaaacatatatacagagaagaaaaacagggagaaaaaaagggggaaacaacccctcctctcccaccaccaagacaaaaccaaacaagaaaacagcctccgtatcataagttggactatatgttctcatatccaagtccaattagttgcaataactggatatggtgtcagatcagaaggggactatctaaccactttaacccctccttgttacagacaacatggtttcatattttgttgtgctaatatttagaatcagattggcacaggccttataatttattgccaaatgtctttaaagggatacagggagaaactttaaaaatggatgttaatgtggtttacaagcaatagtaaagaacctcagcggacaagacatcataggacttttttagagggttagaatatcccaagggattgagcataactgcctaagctccttgcatcccaacaacacattaagtatgtatgttgctgtgcagatgcaatacaaaagaacatagagacatgtaaacaaaagcataagtgatcttcaaatcgatattaatgtcatcatgtgcagacctgtactctggaccacagcaatgggaccaagactttagcattacactccacaagcacattggaccaaagtctagtcatcgggaaacccagcaatggagtttctgtatgtgtggtgtagttcccattgctgacctttagagtctgcaaagaactttcatatattgtacctgctgcacctgcattctgagggcacccaaaactttgtccacctgatgaatgtgaaaaggaatattttccattacaggaaataacaggaggaatgcattacaaaaatgttatagaaggacaaagtacatgttaaatatatacaaaattcagcaccatgaatgggcgcaaaaggtgagaaactgagaactgtgtcagcttaaagagatgcacaaaattttcaaaagtggaaaaaggtcctaaccatggtgaattcacaatggaagaataatcaacaaaaaagttatagaattcgtattaagtaataaaattatggaaaatgaggcaaataaaaatctagttgagtaaattaagctattcaaatcatggaagtcgacatttctagataacgaccaactgaccatgattattcaaaatttccatttcaattgttcttttactttgctctacaatttccccaccctgctactaaactttatattgttttcactctacattctaaaagcgctgctaagctacaaaacacttactgacgcgaatataatgtagagttcacatgcaacgactctaaggcccatgtgctcaattcattcatatctagctcaagcactattctaaaacatggccacctagccctcctaagtgatgtatttcaacagaaacacatttctgtgatgtcttgtggcaaataccacaattttggagtgccttctggcaacttttcccaataaaaatacagaaaagcttttacttgcaatgcagctaataaagtgcactaattgagtgagttctgcaaatggcatactagcatcagcacgtcccaatgacaataactttggtggaaaaaataactaatgctagagacaaattaaccaatacgtgacccacatttctgtgatgtcttgtggcaaataccacaattttggagtgccttctggcaacttttcccaataaaaacacagaaatgcttttatttgcaatgcagctaagccaataaagtgcactaattatgtgagttctgcaaacggcatactagcatcagcatgtcccaatgaaaataactttggtggaaataataactaatgctagagacaaattaaccaatacatgacccaaaagaaaaaagaaagaaagtctgtagacagcaatgtatatcaattgcacctatgtcattctgtattctatagtttggccaattatgttcttctggggagaaacaacagtaacagatatcaaaagagctgcataaaaacaaatgccaaaaagtactcaccatgaactgtaatctccagatcttgctgaatgctgtaacagtccagagatatcctcccaccaccacctccaccccatccattaccaccagcagcacttatcgtaccatttccatatctaagaatggcattagaataaggagttggatctcacagatcaccacagaaagcatagaacagaagtatggggtttgattcagtaaaactcctaggggaaggtttacaaacagttaataaggataactttgtatttagaacaattgttaactaacagttaatcaagttgaggatgagtaataaacctattctggtcctatagggctattcaataccaagtgctgttgaaacctaaaccagcaatctcatgtggacagagcaatatcactggaaagcagatgagcatttttcatgttgctggaggtgcacagaagtcaatgagggtgggggagcgcagaggtggttgccatggaagaaggtaatgggatgcatggggataggagcataggagcacagagttggacgaaatctgaatcatgttataggggaaaatgacattaataatgcaatttggattaacaacaacttggattcaactttgagtgggtttcagttttctaaggaacaatattgtaaaagcctgtctgatagagcaaaatattgtgtaagataacattcaagtcacaagcagctgagcaaagcaattgaaccaaattgtatacggaatgaaagagaccatcaaacctacagaatacggctttccaattccttttaaaaataattccaactaaaacttctagatgcggatcaatccaatgctttatatagggaaatggcatggtaaatcatcaaaatgctctaaacatttctgagatagcactacctaataatgttcataagaaaacaactaagttgtcagtcggagtgttcagtttatttatctatatatcactcatattctaacattaagttatgtataaagttcaggttgttatgtggtaaagcaattcatagtagaacaggcgaaattcaaataaatgcagttcttacagcttgaaagcatatatcataatgcttcctccagacccgccgcctcctttgagactgcccacaccaccttcagcaagtacatcgccgtcgacattcatgaactcacttgccctgagcatgacacggcctccaccatctcccccaaactgatgatcagcagccatgctaccacccttgctgccgtaactccatggccacgccaacgtggaccaagcatacacatcacctccccagttggtgtcattggagaccttacacgacgcgccacgcccaccgtgcccccctccggcaccttcaaggctatgaggcgtcccactcgtctgcggagggggctctccggcaagcccggtggtgttgacagtggagcgttgatccagcgacacgtttgtcgcgtagagactaacggagcccgcaatcaaatccacgtgctcgccgatggtgatgctcccggagacattgatggcgatgtagcagccggcgacggggcagatgatcttcacatggggcgaaatcaccacgctcccgtcgccgtacacgcagaggtcgccgtccagcgaggagctggagccgatgacgcaggtggtgtcgaacgacccggacccgttcatctcttcgcacgacctcgacctcgccgtgtggctcccgcacgggaactccccccgcaccgctccgccatcgaaggagcgacctccggctccgcctccaccgccacccttgtcagcgaggaccagccccgacgcgggggacgcgccaaccaaccccgccaccgccgcggcgaccacgagcaccaccacccacaatcccacccgcctcatctccgcggatcgccccaaaacatagctcaacggcggcgggattcgcccgggggtggaggcgaggcgaggcgagggtacggatctcgcggcggatcgatccccgagccctagagcggcgaggcggtggaggagagagagagagagagagagagagagagtggagacgaagcagcggagtgttacgctacgctgcggctgcggctcgcgaggaggtgggggaaggaggagagagaaagaagagagagagagaatgaagggggatggtggccagctggcgtgatttgtgtgggtggggtcagtaatcagtccacgctgtgctgtttgcttgcttgatcacctctcttaccatcgtcgtcaagtgggaggattagaattaagcaaaagcgattagtggttagtagtcgtagtagtactagcgagcgacggggagggagggagaagagagacggtcgctgtcgcgtcatggtacatggcaccggtgtcttccatccgttccgtccgctgtcacaggatggagccgcggggccgacgctgccgtacgtggatcaccgcccatcggtttttttttctttttctttttctttttctgcggggcggttttttttctaagggttacgtatgataatgccacaaatcaaaccaccaaatgatcatatatatttctttatatttctttttagaccagcataaaaatatagtatatttaaaattcagataacacatgtacaaacggcctgatcagccatcagataacacatatacagagttaaagagtgtttgtttgagccgtttatttgaactggacagcttggtttaatggacacacgcaaatgtgatggatgattagctcatgagtcatgatcaattacgtgttaaatattaaaaaaatagatttatttcattttaaaaagacttctatataaaacaattttacataaaataattgttttgcggtatagaaagagtgtcattggaaaactagaaagttatcgttttgggttgctgaaaagaaatcggtctaaaagttatggtgaagtaaaaaccttacaccgtttctcaaaaggaaaaaaaagagaacctagcccaagaacccataagagaataatacgtgataagtgattttgtactctttgtcgaccaacaatattttaattcattgtgttgaaaaataacctaaagtaatatttttaaaatcggaaatgctagataccaggatatctttattagcgttcaagatgggatcctctcccacactcatgcgactatggataaaaatgacgtggagaacaccatatttcatgacggtcgttgcggcgcagagacaaccagatttcgcacaaggttgcggcatggtggcgcggtgggtccgttgccacaggtcatgggccttgccgacacgctgcacagctacctatgctggccgagggtagtggcgccagcgcgccgcgcagggcttggtcatcgtcgttaaaccaataggagaggtcccgcgcctgagaacatgtgagcttgggcatcagagccgatggacatgggttgtggtggcggttaggatggagctgtcattgaagtggatagacgcgaaacgaggaggacgtggccgccagtgacgagctccaacgtggggtgtggacagtggaagacctactcgcggaggatgcggccaccggtgacgagcttcggcgtggtgcctaggcagaggaggacctgctcaatgcgaaggatgtggccactggcgacgagctccggcatggtgcgttgacagtggaggaggacctacctctcgtcaaatacattgtcgcccatagggagtatcgtttgatacctcataagtatcacctaacagttcacaggaatcatttgatacctacagctattagaacctaagtatcatgtgatacctcgcaagtatcacatgacaccacacaggaatcatccgacaccgtacctataggtatcagaacctgatatcgtaagtatcttgtggtacctggtaagtatcacttgatacctcacgagaatcatctgatgcatcgcatgtatcgatgaatatcaagtgatattgtcgtaggctttccggaccttccattatatttgagggatgaagtgaataattcaagtcatcaaacaaacataatgaaacatccgacacctcgagagaagaatattggagacattgctgggcctttaacctgccagtcaacttcaacctgagatgtgcccgtcaaaccactcgaaggcggcgaccagatgtgttacacattcaggagacttgacaaaaatggctaaagatctacaacatctcaaatattcttaactcatactcatgtgaatctagttcccaggatgtgcaatagattcacactttcatctcaagcatgattatacatagcaaacacaaataagatgaaagcgattataaactacatctactttagttacattagccgaccggccaaataaatatatagaacagcggaagcttgtctacccaatccacaagcacaccgactaggggtttaccccattaagttcaagtcctagaagaagcagtcgattacccgcatcactcaaagactaagactaaaacatgcaagcaaaagattaattcaatagcaagagtcagtacattattagaaataatgtactggcaagcaccaagacaagcctaacaccctacttgcaaggcatataatcaaggaaggcatgatatggttctttttagcataaagcaggttttatttgcataaaacattttcaaatcagatttgctttcaaataaatttcagcaagcaagcacttgacatattgggcatcaaagtagtcattaatcatgtataaatgtacacctcattgccatccatggcagcaaggagatcattctcaaatcttatcacaatttgaaggtaaatttcagcatttagaagaataaacacaagtttatactcaatacatatccacatgccgctcatgaccgcgagcacggctaatcgattagttttaactctgcagagtttgtacactttacccacatgatacgaaataataatcatgcaagagcatggcatgcgatacataagtacctgatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagtttctcttagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtacacaactaatcaccatatgtgcaccacttgaggcccaaacctaaaatccatgttttccaccattttatttatcaaatacttcatttattcatatctgtccagaacttaataaaatcatttttcatgttaatatgagcccaagtgataagtaaaactattctaagcatggctaagcaatatagtgaactagtgtcaatgtaactcatattccaagtagtattaggatatgattcctaaggttaggaatgagggagatggatatatgtggggttaaggtgataatgcaaataataggagtttgtctaacaagtttaacaagattttaatgtattagtgtacaatcgacatgcaagatttgcaaacattttcaataacctccaaaacataggttcaaagtgatcaaagagagggaggtgggacttgccttgaaactggaaaaagtcagcacctaaatcacttcttcaccgtttaagcaatcatctatacaatgtacacgttatgcaattaaaaacactgaaatatgcgaaaaatccaaaatgctctaaaatgcatgatttgtgcacagtggataggtactggtctaaaatgaatttatgtgaaagaatttctattttatctcatttcatttgagagttatgaattttagaagtttcgtcggtatagtgtaggatttacttaggtactattatgaagtgttgtcgtaaggtgattcttgttaagttcatgtttgttggggtgaagatatgtgtttttctaaaactaacacatttggtttcataatctttagagttaatatgaattctttatgtattttacatgttttaacgtgttctaggaatatagtctctatgtgtacatggcttgggagatttaggtccagaacttgctctaacttgctagtgatgtataaaatgagtattttagttatctaatctaatcttagttcataattttagagtttatattgttttactacatatttataaatagggatggtctatattagttacttataccaacctagaaattgttacacgagttaagtttgctaagtatttgggaattaatgctgcaactatgacctctctgatctaacaagttttattttggtttattcatagctaatgtgcattttaaatacctctatacatatattttgcttaaccatcacttggtgattaactcctaggttatctatttaaagattagagctataatttgtacaaaaggtgtcatattttattttactatgatgaaactcactatttgctggttctaaagaaacttagttcatttcatttggactaaaaatgaattttctaaaaattttacaaattaaaggctgctctatgttggttattccttacacgaatatttagaggcttttattacaaagtaggtatataattttattttataacttggaagtatatgctttggtgattcttcagaacttgggtttactcaaaaaggatctaagatgaattttatataaacttctaaagttcagtctatgtaaaactagttattttaaagataacaattttagaggcatttggtacaaagtaagtaattacttttattttacctaatcagagagtgcatgatgatgaatctgtataatttgagtttgtttcaaaataagttaaattgaattttctatgcattttataagtttgtatatgctttacgtatgacctaacttagataaattttagagacaaagtttgtacagtgagtgtcaagttttatattcctggaataaaggtcataactttgtgactctaaagcaactggaatcacttcaaaatgagctatatttgattttatatggattttacaactttggatgttttcctgttgaaattataatgcttagatgattttctttatattttccaatttttaaaagggatgggtgcactggtcagccctggccaatatgcaaaaaggtccctagggctttaggcaatcaacccgcagtcctgtgattgttctgtgtgtgaggtaggttttacaaaatagcacccagagttttgattcttctcaagtgaggtccttggtttgagctgatacagagcttgccatggccgagctcgttctcgagctcgccggcggtgaatggtggaaaatctcggcatgaaacctaaacagaagatgtagaggagttttgggcgaagctaatggtggtcttattgtgagcaatgttcaccggaatcaacggctacggcagcgcgagcggcggtggttcttgggtgtagagtccagatcctagcaattagtgtgcatgcatgtggtctcctagtttccagggtgctcaccgagggctcagacgaggtcgttaaggtcttggtggctgcgacggcttgcggatcattctagtggcggcgtttctccggggttgaacgacgtcggctcgaatggctcaaggacctgccatgcatgtgtgtccaagagtttcgtgaggtcccaaagatggtgtgtacacaaagaatcggactatagctcaccggagtggaaggaattgacaatggcgatggcgacgggttcagatcggcgacgaggaagaaaaggatgtgttctccgtgttcctagtgtctctggtggtgattcttggggtgtcttgaggaggaagcctaggcaatctttgcggaacagcggcttggctcgagatgaacgaggatggccagacgacgatgatgccgaagcggcggcgctccggtgcgtgctccagggcatcgtcggcgtggcttgcgttccggtggctgtgatgcacaaaacgaatggtggtcaacagagaaaatgctcggcgttgtgtggaaagatgggaacacgaaaaagatggaggtgaccttgactcaatcggcaattgcgatggtcgtctctcccgcggccggtgatgaagatgagagcagcggagaggcagaggacctactccctcggttccttcagcctcagagtgatgtgtggagttgggcgactcggtctggaggagatggaggcttgacttgaaggcgtcgacacgtcgtcaccacgcgtcgacacgctcgatctctccctctgtgttcttggtcagctgagggtgagggacagagaaaagggcaagcccaggtcactgccaagtgggtctaggacgaagtgctctaggtggaagggagaggtgtgggtaagattctgggcgaacacggttttggacgaattttcaggattatttctcttctccatctttgttaattcatatattaatttgtagtgcagaaaagctcatgtggattttactggagttatatgaatgtacctagttttcattttttttggttgtacttaaaaattatggatagattactcacagaaattagaagaaattgggccctttggatactagtttgaatttttaggagacctaaacagagaagataaattctgaaaaaaaatatatttattcatgataattaacctagtatttgaataaattattttccttatacacttccacgcaggtaaatgtacttttagacaaggtgtggttttagccaattgagaattataattaatctaatatttgactggtttgactgatttattcgaggtatcaaatttagttattaaattgtaccaaaattacagtgatatgtatttgttgagtagaacctacatgaatttttccatgattttatcttgcacaaattattttagataattagcaagacttatctcttgtatgcaaatgtatgtaaacatttatagaagttatatttggacctaaggtgatgttgatatgttagaattacagtttaccttacacatgtcataagcttcttacctatttatccataagtttactttagcattaaattaagaggatgctcataaaggtaattaagatagaatattttctatataagttaatttatttactaacttccatattcatgacatgctttcagatgaatagccaaattagtttagtgaggcttgacattagccatgttgatatattttaaggtgtatggcttctatttcgactctcctctatcccctagcactaggccctaatggtttagttgtttatctagatcttagttaatattgatgagacctattatgaaatgcaaatcgaaaatccaaatgcacatgaaggactcaagtcaaaacatgttttatgcgagtatgtatgcttacacataagtttacatttttgttctaggttataaatgaaaaagttttaattttccctccaattttattcatgcaagagttaaatcaatttcacctaggtttaaaaatggaaatttttggttcacaaaattgaagaactttgctttcaactagttttgattgaaattcaggtatgttacagatatcaacggatatcatatgctaccaacaggtatcagtcaatacctataggtctctcaagtatcactcgatacctggtaggaatcgcctaatacggagtacatgattggtatcacctgataccggttaggtatcaggacatgatacagcttagaggtatttggacttgatacctaacaggtatcattccgtccgaacgggattctgttgtatagcatccccttttagttggatgtatttgtaaaaaaaattctaaaaggttaaaatgtaattttttatttgtaagatagtaggaggaggacctatttgtaatacaaaatatttacattttgtagcccttttaaataaagaaaactattgtacaaataggtccttgtcgcaggtatgtttggtgatgacctctctacatgttggctacgaggggaatggtaaggtggtcggtgtcaacgtcattgatgccgaggaaagggttcacttctaaaataagtttttacaaagatttatttgaaaaataagtttttaaaaagaccaaaactaggagatgaatgaatgctctatccatcgatcgaacatgtgtcaattaggaagcgtgcgcggtccttccatctaggtccattctaagggcctatttagattggtgccaaaataaaccttatcaaaaaatttagcaatgccaaagttttggcaaattaataacattgtcaaaattttggtagaactggtttaataatgttaccaaaattcaatacacattgccaatatttagtaacaaactaaacatagccacatactacctctgtttcatattacaagactttctagcattacccacatacatacatacatacatacatacatacatacatacatatatacatacatacatacatatatatgtgtgtagattcattaatatctatgtgaatgtgggcaatgctagaaaatcttataatataaaacggagagagtaattattaattttaccaaataataatatggttgaaaatgtcatcaagaacatgccctaattttaccaaacctatgcagctttcactgtgactgtctctaaatatggaaaaaatttggtggagaccgggtgtaaccgatctcatctacagccctgctccggatggatgccacgtggatgacctagggattgaacggttagctcggccctgctcccggcactgcacgacgaggacacaagcggcttggctccatgagcacccgtgtctttcaggctctccgtcggctcgattttacgcacatcgcgtctcctttgcctggtgcgcagcgacctgcgtcttcctggggtcgtcctcttcctcctcctccagcaccgcggacgtcctgagactgacatatgggagcaccatggccaatgtgttgagctccaccactgacatcacttttgatgtgctctttgtactggtgttttttttttttttggcgatcggcttctagagtcaggtgctgtcgccggctgcttgtccatggcatgagaagaaaacacgcaaattaaaagtgtcataggatttgcatcagggagaagaactggaggcagcagggtcatcgtcgaagccgtaatcgatcaagtgttgcgtttcgtccgtggcggcctccaggaattggaagacgggtaccgtcgcagccagcagccaaacgcgccgcgggatcgatcgcctggcgctgcggctcgccaggcgaggagacgtggtctgcgttgaatcgagccgtcggcgaggctgaaagcgtctgcgcctggagccaactagccaagccatctgcatcctcctcgcacagcgcctggggccgagccacgtgatccattcgattctttggtagtccacgtggcaatcatccagtgcggagctgctcagctgctgatgaggccgattacacccggtctccaccaaatttttttcccctaaatatagacaggtccctcactccctctgccatgctggtcagcttcaaacgctcatggcctcttaagcgcgccattaaaactaacactacactgtctacacaccaccgcgtaccacttctcccccttcaccgccaccatgcgctccccgatccgacctcttctcctcctcctccccaccatcctctccgccctcgatctcaccgccgccgccgcggacgatgacgacaccctcaggacgtacctggtggtcgtctgccggatgaatggccccaaggaaggcggcgagccgctgcgcgcgtggcacgcctcgctgctcgcctccgtgctcaacagcacaaccgacgcgatcctctacggcgctggcgccggcggcaacaggggcgcgccggtgatcggcggggagagactggtctactcctaccagcacgtcgtcagcgggttcaccgcccggctcaggccgcgcgaggcggcggccatggcgaggctgcagtggtgcgtcgacgccgtcccggactccacgtacaccctcaccaccacggacacgccgcggctgctcggcatgagcaccccgcggaccggggcgtggagcgtggccgggaacatgggcgacggcgtcatcgtcggcgtcctcgacaacggcgtcgacccgcgccacgtctcgttcggggacgaggggatgcggccgccgccggccaagtggcgcggcaagtgcgacttcggcggcgcgccgtgcaacaacaagctcatcggcgggcgggccaagacgctggaggaccacggcacgcacacgtcgggcaccgccgtgggcgccttcgtcagggacgtcatggtggaggggtccaacctcgggatggcctccggcatggcgccccgcgcgcacctggcgatgtacgaggtgtgcctcgccgacatgtgctccgccacggagatgctcaccgccacggagaggggcgccttcctagacggcgtcgacgtgctctccatctccgcctccgacaacaagcagaagcccttctacgacgacctcatcgccgtcgggagcttctccgccgtcatggcgggcgtcttcttcagcaccagcgccgggaacgccggcccgaccgccgagacagtcaccaactgcgcgccgtggcagctcaccgtcggcgcgagcaccatgggacggcgcgtaatctccaaggtccagctcggcaacgggctggtgatctacggcgaggcttccaggaggtacaaacgcgtccagaacaagccgatcgtctacgtcggcggcaggttcgccgacggcgcgctgaaggcggtcgacgtccgggacaagatcgtgctctgcaatcgcgtcgaaagtgcagccatgctcgagaagatggtcgccgacgccggcggcgtgggcatgatcgccatctccacccagatgcagttcctcgcgacaacaccactcggcgccaacttcatgcccctgtcgcgcgtcagctaccccgacggcgagacgatcaaggcgtacatcaactccacggcgaaccccatggcgagcctccgcttcgccggcgttgtgctgaacgcgtccgcgctgccggccatcgccgagtactcctcgagagggccatgcgacctgcccaacatcggcgtgctcaagccggacatcaccggccccggcacgaacatcgtcgcggccgtcccggacaagagccccggcgcgaacgccaccgcggcgcccacccgcaccttcagcgcgaagagcggcacgtccatgtcagcgccgcacctcgccgggatcgcggccgtgataaagaaggctcacccggagtggtcaccggccgtgatcaagtcggcgatgatgacgacggccgacgtgacgcaccgtgacggcacgccggtgatcgacctgtcgacgggcgcgccggcgagctacttcgccatgggcgccgggctggtgaacccgaccaaggcgctggacccggggctcgtctacgacctcaccgccgacgacttggtcccctacatctgcggcctcggctacaacgacagcttcgtcaacgacatgatcgcgcagccgctgaagaacgtcacttgcgccaagtccaagaagatccaaggcaaggacctcaactacccgtccttcttggtgacgctcaccgcggcggcgccggtggccacggcgaggcgcacggcgaccaacatcgggaagcagccgctcgaggtgtacagagcggaggtcgtcgcgccgccgggcgtcgccgtcgaggtggtgccgaacaggctggagttcggcggcgccgcgctccagaggagggagttcaccgtcaagttcacgagaggccgcaacgccgccgtcaatggcgcggcggagggcagcttgcggtgggtctcaggcaagcattccgttcgaagcccgctcgccgttctcttgaagccatgaatggatcatcggttgtagggttagcgatgatcgattctaaataggatcattagtggaagaaaattagatcaaagtatgcggttaataagatcgccttgtctaagctctctgtttggtgtttgctatataaaatcagtttcagtaggcaacttttgtgtgtgattttcattttaaaatccacaaatccatggactagttaacaaggggtatgtgagttgcattatcctaatttcagtttttgcttcacaaaatttaggcagttcagaaactattgtcgtaataattaaacgctaaagcacacaaggcattctgaagaaaactataaaaggagtaaagcattgtcagttgttttcagaagaagtaatataatgtaccaaatattcagaatctcaatccttgaaacgttgtcagatgttttcatagtatgaagtatcaagaacaacatgaactgtaatctgagctggtaaaaatatttgaatgttacaacatattgagagatctctgtgagggtttcagatttcagcttcactctttgagagtttcaggaacaccgcagctagcgtgtacttgtccaagagcaagataatatgttgtttcagctcaaattgcctgattaaatatccaaaactttcatgaacacgtcataccagcccattataacatacaataccttcatgaacacaatgaaatcaaccgtcaacttctgcttgaaattgttaaggtttttagtccatcagaggccaaacaaattggagacaaagcactaaccatcataaaaaagtagtaatgacaacaaggttgctgcaacctaaaaacttacaatataaatcacaagaactgggcagtgttggaaattaatcttgttgtttacatttttagttattttttgtatttgcattttgggacaaggcagaagtgtagtatgtgtagcatcattttagataatggaagctttatttagactcagttaattacatcaagatgataaaatcaaactgagtcacccacggcccctgcataaaatgcacacagccaaaaaagaagaaagaaacaaccagaacatttcccaagtacaaaagtttgatagaaacatatatcttagtggctatcaatccatagactagacagctacccatgctcctgggtaaaaaactcttgcgccacctggtccaactgtcgtgataccaccgcaatagtatcccacagtcccggttggtggaggatagcccaggtacggagccaccgagtaactaaagtgataacctgcaaaggagaagacaccatcttgttattaaaaattactccattcctgcttagccaaatagaccaacacagagttgttgcacccataaaaagcagattcctcatgtctttggggacacaagatagccaactcctaaacatatgacaaatattgcgaggaggttttaaattagaagccaaatgaactacagaccacaccaagcgagataagcaacactgaaagaacaaatgttggatggtttcatccttgtgacaaaaacaacatgtcttgctacctttacaatttctcttagcatggttgtccttggtgagaaatacgcctcgacgcaac

SEQ ID NO: 74632 - DNA, 18879 bp, Oryza sativa
gatttgcgatctggatatcaccagatccgaatggctgttcaggatgagcacaaaacaaccttcaaaacacataatgggcattatgaatttcgggtgttaccatttggactgaccagtgcaccagctacatttcaaggagtgatgaattctgtattggcaaatctgttaaggcacagtgttttggtatttgttgatgatattttggtgtatagcaagactttaactgaacatgtcgagcatctcagacaagtgttacaaatcttgactgatcatcagcttaaggtcaagaggtctaaatgttcttttggacaaactcaactagcatatttggggcatattatcagtaagaatggagttgcaactgatgacagcaagattgcagcagttaaagattgcgattaagctcttcttatcatccacaatctgatggacaaacggaacgagtaaatcagtgtttggaaatgtttttacgctgttttactcatgcctgtcctaatcgttggcattagtggttagcacttgctcagtattgatacaatacatcatttcattaagcaatcaaaatgacaccatttgaggcattgtttggacataagccgaattactttgggttattgggagcttcttcagcaaattctccagcattgacagattagctcagtgaaagacattgtatggatactttgatttataatcatcttttgcgggctcaacaacgaatgaagtttcaagctgatcaaaatcgttcagagagagttttctctatgggggattgggtgtttatgaaacttcaaccatttgtgcaacaatctgtcatgacccgagctaacaggaagctttcattcaagttttatggacctttcaaagtactgcagtgtgtgggaacggtggcttatcgattagctctgcctatcacaagtttgattcaccctgtagtgcatgtctctcaattaaagaaagctttagcaccaactgaagaattgcagtcagagttgcctcatcttgatcctgaagctggtcatttggcaactccagtttgtgtttgtgctcgtcgtctgtgtcgtcgtggtgcgaagatgatcgagcaagtacaagtcgagtggtctggtttatcttcttcggcttgtacctgggaaaattttggtgaattgcattgccgttttccttcaacatcagcttggggacaagctgattttcaaggggggaagaatgtcatgccatcagatacatgtgcatgcaataaagatgatgcagagaatgggcctcatcgagttcggcccagtcgccaagtgagagcaaatccgaaatacattggaaggatctggactaagtaagggatataaatagtgtccaggagactagagagagggatgacttgtaattggaaatcaatctatcccaatactgaaatccttcctctgtctcagctccgtctcaaacgctatttctttctcttactttctctccaagttgctgttcttcctttcatttgatcttgaagattgggatcgtaacagttggtgacggatccttcaagtcgacggaaaaacgacggcggcggcgcaaagctgcgggcgacggcagcgcaaagccaaggcgacggtggcggcagcgtgcgcgtgtgccacgcgcgcccatagggaggaagaaggaggcggctcggccgtgggctggctgggccggctcggctctgatgggccgacagcccaaggaggagaaaagtgtggaggacggaaggaatgggccaaaaggaagggggttttggcccaaaagaggaggaacttgattattttgtgtagagggtttttaaatggaaatcaaaggagatgaaaatctaagggatgaatatttgtggaccttttgaattttggacaaggaattcaattaggatttctaggaaatggatcttaagaaatatgttggggggctttttagaagtttggaaaagaaatttaaataggatttctaggatatgaaacccaagggagtttgtttgtggactcttttgaattttgacaaagaatctaaatatggaatttttataataaaataggtttgaaatatttttaaaacaaaattaaagatatttattttgaaatataaattttaaaaggataaaaataaagatgctccaatttaaagaatttaataaggaccaaatataaaacttgacacaaaagatttatctactaactttggataaattttgggatgatagcaaaaatagatggaggtaaataactaggattttagcctccaaaatatgtggtatggattctcggtgaaatatttgtggctaaaggaagttggattttgaataaaagggattggaaataagtttcttagcacaagagaaatcattcaaatatttgtgataatattattcttgtgcgaagaatgtgatcaagtcataggaatcaaattggcggatggactaaaataggaacttgaccacaagatattttggatcaatctagaggaggtaatggttttttggagataggtctagctaggggtttgatccaaaataaattccaacaaaaggggagttatagtagtttagccccaaggataaaaatggttaatgggatataacagagagtcaggccaattgggaaaatattggctcaagctaaatagtaaactttggaatcttgaatggataatttggatgaatgagattccaaaggggaagtatttgttggaggatagaactagattttggaagtaataggtggatgggaaatcataggtatttttataagaataggattggaagtaggatggtaaattttgaaggataagtgttaactttaggggggggtagtattttatagactatggagatatttgggtatagatccaaagggaaagtattaactctagagaggttggagaattatatttcatgtactcgggagatagttgagtgggaaatgaaaggatatttatggttgttggaggtgttcgaggaaggattcaaaggaaatataatatagagccaaagttagagattaaagaaaataaatggaaaggttttatgaaatttgaaataaacaaaataaagaataaattaaggattttataaaatttaaaagagagcatttaaatttgcaaataaaacttagatccaaaataaaagagaaggttaaaagcaagattgctccaatggaagaatcgagaaaagtgcaataaaacttttcgcaaaaaatttttccctgaaaatttgagtatgttacatcacgtgtgttccacgctgactcagccgttacgttggacaaaaccgggatcaaaaccaccgaaggtcctaaagtgaccggttttgattagttaagagacgcaagatatctggttttatggtttgagaacgtttttttacctggctttatggttgagtgcgttttttttatctcgatgacaagtctaagtgaccttcaggtggtgtttgaatctcctgaagatgaagacgaagatgaatatgaagattaagtgtttcacgcaaaacgaggtggtaataacgtgcgattaattgagttttaattattataacttgaaaaacgaattaatctgatattttagaacaactttcacatagaaaaatttcatacgaaatacaccgtttagcagtttgaaaaacgtgttgttttaatccaaaaagtttatcccctaattttgaaacaaacagggcctcagtgtactttttcccatgcctggcagccttggcgtcgtccaccatcccggtgttcatcccgcggcccagtcacgaatccaaccgtcaccgtctcggtccggtctaagcccttgctgctccaccacgcttcttattccattctccttccgccgccgcccgctctctgttgcgccgcagttgggagcgaaacccttgtcttcctcccaacccatcttacccaaaccctaaaaaaccaaaaaaaaaatccgcaaaattacccccgaaaatcccaaaaaatatcgccggaaccctatccttcgatcggatccacctatccccctccccggtgatggcggcgcaggttcaggcggtgccggcggcggagggtggtggcgcgccgccgcaggccaacggggtcgtggctgcgggctctgctgccgccgctgcggcgaccttccaggcgacgtcgctgtacgtgggggacctcgacgtgagcgtgcaggacgcgcagctgttcgacgtcttcagccaggtcggatcggtggtatcggtgcgcgtttgccgggacgtcaataccaggctgtcgctgggttacgcctatgtcaacttcagcagtcccgccgatggtgagctctgttcttctccttcatatcaattatttcttgtgatgatttgttggtcatgggtgatgggtcgttagggttctggcagggaacaattcgaatcgcctcaactccattacttattgaaagtgtccaggccattttaatgggtaggatttgtgtgctaccaaatgccggaaactatttagtctgttttaacatgctgattgtattcattaactgaggtttgtaaggagtatataataatattggttttttttattacgttttgtatagctgtttgttgtctcatacatatctaattacatatatagtaagttgagtaaacgagttacctcatttcatgccaagaaaactttttgaggacagttgaattgtttttcttgctgatagggatttatgttctcttgattttaacgaaaatgtcctcacttgcaacaatataattcgagatgtctgttttagtgcacgatgtgggggatcgttgatgtgaaaggtccttccatagtattcgacataatcaagttacttttaattggttccaaaattttgtaagcatggcttgtcatttgcctctgaagttcttgtgagagtttgctcttctgtaactgttaagttagatatgtgttctgcttctgataatatatttcaatcacatgatgtacattaatttggcaaacaagttctgattgtttatcaaactagaattgcaacttgcttcttttcttactttaaaatctgttgcagctgcaagggcattggaaatgctgaacttcactcctattaacgggaagcctatcaggataatgtattctaaccgtgaccccagctcacgtaaaagtggagcagcaaacatatttattaaggtagcacattcatattatgtattcatttcatagatagccaacaaagaatatctcttttgacatcagtttatgttgttaacagaatcttgacaagtcaatagataacaaagctctctatgacacattttctgtatttgggaatattctttcgtgtaaagtcgcgacggaaatgtctggagagtcgaagggatatggttttgttcagtttgagctggaagaagctgcccagaatgctatcagtaagctcaatgggatgcttttgaatgacaaaaaggtgtatgtagggccttttgttcgtaaacaggagagggaaaatgtatcaggcaatcccaaatttaacaatgtgtatgtaaagaacctatcggaatcaacaactgaagataatttaaaggaaatttttggtaaatttggacccataactagtgtcgttgtaatgcgtgaaggtgatgggaaatctagatgctttggatttgttaactttgaaaatccagatgatgctgctcgagctgttgaagatttgaatggcaagaagtttgatgacaaggaatggtatgtttgtagagcacagaagaagtcagagagggagatggaattgaaagaaaaatttgagaagaacatcaaagaggcagcagataagaaccagggaactaacttgtatttgaaaaacttggatgatagcatcgatgacgatgagaaattaaaagaaatttttgctgattttggtactattacctcttgtaaggtttgtctcttatctccgctagtttgccgtaatagttaatacaatttattcacatactttggttgtttggtcagtttgctgctgctgattataaagtatgtggcaggtcatgagagatttgaatggtgttagtaaaggatctggctttgttgcatttaagtctgctgaagatgcttcacgagctgtgagttgtatttatatctctgggcatcatatttgaaaaccatatttcaggaaattcattaacatatttgttctgatgattgcagcttgtggctatgaatggtaagatgattggcagtaaacctctctatgtagcacttgcacaacgcaaggaagaaagaagggcaaggcttcaggtaacattgacggatgagatgtcctgtatacatattcctaaaatgttattctctgtttctaatatgttcattttacttttgcaaaacttgacgaacatgattttatttttgaactacaattagaacaataatgaattttcttcccaatgctattcaatgcaatagtgtttgataaaactatgctttttatatattgttttgtgaaagttctaatggtctggaaaataaacagtcatttctgataccagcggatccatacatggaccctgtttttaggtattcatgttgatgacttatttcaggcacagttctcacaaatgcgtcctatggtgatgcctccttcagttgctcctcgtatgcccatgtatccccctggtgtccctggtgtaggccaacagctgttttatggccagccacctccagcttttgttaaccctcaggtacatcagtacatgaactccatctatctaattaatgaattatgaatgttcatgcgatcatcaacatatactgttaaggaattttcgaatcagtatgttgctgttggattagaataactataattgttcaaataaacaaaagctgtaactttgatttgctaccaatgttttgatatagctttgcattgtaaattttgaaattccattctggattgaagctcataaactactcaaacttgccaaaataactatgcaaattccaacgttgagcttgttaccagctacttgtcattcattttggagcactattattatttttaacacttaccaacattttatttctgcgtgtagcttggttagttttcttgtctgttttgactaattatatacatttaaagtaaaaactatgatgatgccagattgttgtttaccaacttgctaagtgctaaccattacaactgatggaatactttgttgtgctctaaatctagtgtacgttcatgtttttcctttctgaattgattagtaaaactgttatgcactaccaattacattgttatgttttattctttcacgtgttatttctacatttacagtagcagtgagaagtgcagaaaaacataaaacaagatagaacctcgctattgattgtgcatgttagttttgctggacatttagtgaactaatttctcacttctagctcctttaaaaaatttcagtaccaagcatttattgaaggaaaaaacatacttacatgtgaaaaatggacttcacaaaattaaagtgagatttctgcgtgagtggccacttgtgacttgtgaggactgttttggaaacaaccatatcgcaaacgttgcttacgattatcattgacatgttttatgtgagaataatctaaccaagttgaacattcctgatgatatgaatgaactgatatcttaatgggttaattatgactgatgcctcaggagtattataattgttttgtcatctatataagtgaatgaatattctggatagtatgggcacctgtaactctagtttaggagagtatgtagcgtaaggtgccttgttttgtcatccttgtaaggtgcattgcttagccaaaagtttctcggtaactcggttatctttggtgctactggatgagattttgttgccctccttggcactgttacctttgctgtgaaaaagggcaaactgcccttggttctgttttggattctgtcgttcttgtgaatgttgtgtggtggatgtgttgatgcttgacgagatggtgaggtctagcctcgcctccttagagccgggttgaggccgaaggggagactagagataggttcaactttatttcttgattgattcgctaggaaatgccgtgctcccatatggccagccacccaacaaattctacaaacaagtatagctaataacttgcaaactaattgaatccatgaggggctgagtttcgcccataacatccccacacaacgattgacttgcatctagcctcatcccctcttattaagccttctacatcctggcttttaacattatttggaaaggaaaataaatctaaaattattttggtgtaccttgccagcctaaggtggggccctacctggaagccctcagtatccatgtgatatccaaagcttgaatgtcctgctggcctgagaaccctagaaaaccttggcaaagtaacaattcgtgaagagcctgcattcttgctattgaggcccaatctgcaagcccatgtgatgtaaagccatgagccatgtacatccgagttgtgagagatagcgaggggcccaacaatcagcccaaatcaggttcctcttgggagaataccctatcccactgctttatgccacgtacatagaatgctgcgctgccaccgtgcaagctgctacagtcgtgcactgttaagaacatgacaaatgacgcaacgcacctgcggcacgcaaggcactaacgctatgcactggttgagcccccaaactgagctcctgccagcgcagctcgcacatcaccatggggtcacgcaggtgcagccctcgccgtccacagaagcagcgcaccccgctgattgtgtggaggccaccccaatgagtcaactaattgtgctgcaacctcccatcacgctcgaggactccgctcgcttgccgtgctagctactcgcgaggatagtggtgcactttgtgcccgtggggacggaaccaatttgcatggagttggacgaggcgtgcatgtcaccgccaattgtggctcaagctcctcgagtcgtgccagttgttctcggtgattctgccagaaaattgtatgcctgagtcaccaagcgctgccttgtagccatatcgatgctgttgccaaggccaacaaagtggatgacagattgacggtcaccagggagctgcaccgcctccaaaagacgcattgctgctcgagggaaccgcttgaagatgtcttgctgccgtgtggtcgcaggagggaacagtgacggtgcgacacgatggtctcccgcggcgacggctgacttgattgcttcctggcgagtgctggcaaaggtgtagcagcaccactgcagctgcggacactgatgattgccaagggagtggctctgtggccagtgacatggcctccacctctggtagtgtggccgatggttgaggagagggtacagaaaatgagtctgttggggtggtggcagtggagaagttatcgttggacaccgccagcccgcatggagtgctgcacaaagtccctcaccttattgagcccatgatggtgttatgcatggcaatggatgagcgatgcagggcgtggaggctgttgatggcagccatggtggactctgggaaaggatcacttgaatctgatacgaaggtgctgtgtgggggatgtgtaggtggtcgaccaccccagagccgggttgaggctgaagggaaaactagagataggtttaactttgtttgttgatttattcctattttttttaaatctgcagggtgattttacctagcagaatttttgcaaaaagatgaaagaataaaatctataagactacctagcatgtcattgatatttgtagctttgtgcattgtagaaatcttccatgactgatttccattagaaactagggggaaaacaaagctgaacaatttaacctccaaaagaggatggatataacagtcagataaggctgtgatttggattgtttcttttaccaaatacatcaatatgtttattacatatgaaggtggggatggcaacagcctatggtaagcacctggtttaaaaaggttgtaaaactttgtcctcattattgtacaatcagtcttttatcaaatacatcaatatgatgcataatttgcagtttatgcactacaaatcagccttgctttacaatttacttgcacatgctataatcagtctcttttttgttgcctatctccccattgccttctcatttgtattaatttgtattatcgaaatgttactttctgtagcctggatttggcttccagcaacatctcattcctggtatgaggcctagtgttggaccaattccaaattttgtcatgcctatggtccagcaaggtcaacaaccacaacgtccagctggaaggcgtgcaggcactggtggaattcagcaaccaatgccaatgggccaccagcaagtaataatgctcagtttgtagtgacataatgaaactcatttgtttaactttgacaaggagtttgcctccttgtctaacccttgcatctcttgttttggcagatgcttccaaggggtagtcgtggtggttaccgttatgcttctggtcgtggcatgccagacaatgcattccgtggtgttggaggtttagtgccatccccatatgagatgggaagaatgcctctcagtgatgctggtgcaccaccgcaggttccaattggagcattggcctctgcactggccaattcacccccagatcagcaaagactggttagcttatcctttttgcttttatgcacatatgcggatctaaggataaatttcaatctggaactgggatcataacttcctctcatggctgcagatgcttggtgaaagtttatacccgcttgttgatcagctggagcatgatcaggcagcgaaggtcactggcatgcttttggagatggaccagactgaagttctccatctcattgagtcacctgatgctcttaaggccaaggtcgctgaggctatggaagttctccgtaatgctcagcagcagcaggcaaataccccaactgatcagctagctgctctcaccctgagcgacggcgtcgtttcttaacttggttggcatcttatatctgagactgcaagtgatgtagtatgtacttggtgtgttttggaacttgaacctgtggggaagtctgtctttatctttgttaaacggcagttcagttacttcagcattgtgtggatctggatttcagttcctatttgtgttttcttaaaatattgggattgcaatatgatttactcttggattgatgccaacccatgaactagattcttgttatatcaagaaatcatgacaggattagccatgcaatgcttagtttttttcggtagagcagtagagctaactaacatagcgcaattgtgtagtgccaagaaggcgaatggatagtaacacacagggggtgtacctcacaaccgacccaggcaatctagaaaatcatggcaacaatctagaaaatcatggcaatcatggattattccagttactagatggagtccggcggcaggacagtgctcatcaattcggatggtgcaatttttcaagtctccagctaagtgggttttggttttgtgatctgggaccacttaggtgtctatttgtctacaacaagctgaatcacagaaatgttcaacggttcaagcctaagttgattcggtgtgccttgtcccggcggagggctaccaaggcatcaaattgtctctctatcatccaacgaatccagccagactaatcctgtgttcttgttagtgacatcaagaagttggtagccgatttccaggtttgtgttaagaaatcttgggcgatctcatccacccggaggaataggtagcagttgccatgcctctcctcgccaacaatcggtagagaacgaaccgtggctgttggtcgcgccctttttctcctctcggcactcctcgacaaggggcgcagtggaccccatccattgcgcatgtataaattgaacactacgatcaatgagaaatcaatcctctctcgtttcgtgttttgttaacatgttatcagcactgctcgcgaaagaagaagagaagggagaagtagaaatcaaggaagcagcggcctccagcgcttgaaggtacgatgcctatcttaggattgaatttggacgccgttctcggcctccctcgttggccccgaactcaccttctacaccacattccccgctactcaatgtgttagcgccgcgccacccatttcgcccactacggagcccaatacgggcccatggccaccaccaccaaccctggcgccatgtggtcgttgatgccgcgccgactgctgcctcgtaagcccccgcctcgccggaagccatgaaagcagttaattagttttgtaaactctatgtaatggtcctgcaaacccatgatgttatatgttatttggcaaatatgtttgttaaaataccccgctttactaaatttaccggttgtcttaataatatgccttttgcatatttaaaacacactctaattactcactgtgtttattggcaaaattatttaaattttgtatttaacttagcaaatcctcttaattatgtattgttgatgcaaaatttaacacctccacacgaaggcctggaagatttgtttcacttcagtgcaggtcctaaaattcgggttcagcacgtgccagttgatttgatcttgcaatcaacgagcgggacaatagaaaaaagttaaatgacgatagccgatcggcaaatgggctgatgttgtatcgtatcagctgatgctagagagaatcagctataaattatatgaaatattgatcataaaactaggtttagattgaacataaatgtaaatagttctcctttaataaaacctatcctgtaggtcgaacccaattgatccagcacaagattgatgatatcaaagttgattattatacaataatgtgatctaaacagctagtccatgaacataaaaagtatgaacaaaacctaaggtaattacaattggatcaaaagtgaatagcatgggcatccacaatgtgcatctaaagtgggtagtaaggaataaaatactattactactaccaggttgtatacattgtaagtaacaaataccatgtaatatgcttactacctagccataaggaataaataaataatctctctcatccttctctcatggctagtgactgtggggttcagcttactagccacctttattctttcatcattgtgactacaacaacaactaatacccactaacgtattgtaacatcctcaaatttttaaactaaaatttgactgcatcatgctggcttttgactggtttttatcttagattagcaaaatcaaaattctctttaaaagttctctttttatttttgattttggttcgaggattacccttagaacccccttaacctagtttaccaataaaccctaaattttgccctatcctaaaccttagtggatttagcaaattttcttcaaattccaaaacttagaaactttctctagatcacccttctattagtgagacatttttatagtgcataatctttgcaaaactcttccaaagatctctagataaattctttctccttaggcaaaatattcaaaattcctaaatacttcttttgggccgaaatcctctctctcccttcggcccaattggcccagccggcccaagagaggcagccgcctctatcctcctccaggtgcgcgtgttccacacgcgcacgccgccgccaatgccttccctcgccgctaaggaaacgaagccggccgccgtctttcgaatcttcacgccaccgtcgtcgtgcactccttgacctcctcctccacaaccgcctctccccaccgcccttctcctctataaatagccggccatccctccccttctctacctacaaatggagcttcatctctctctttctctcccatgtccggccatgactgcccccggccgatctccctcattggagcttcgcaagccaaacccttgcgccaccaactccgcctcgccgaggtgattccatttttcccgttttccccttttcttccaccccatagcagccaccatcgccacttcttttagtggccggagcaagttcttgcagctgccgttccagccatccctctctctccctccgccagccaccaccctctccggatgcacggtgctcgggaacaccatgcgccgccggcgtcgccgccctccagccgccggaaaaccggcacccctcctccccttcctctctgttcaaccgaaggagagaacgaagagacgggaagaagaagaagaaaagaaaaagaaagagaagaagataaaagactgacgggtgggcccctctatagtaacctttctaatttctcaatttaattcaaatccaatctttagaagcccatatcttttaaaatataaacccaattcccgtgaaacatggaccaaaattcttctaaaatctttctctatcttttgaggctattttttgctattttctcattttattttatttttgcctatttttggattttattcgatttccttttgaatttgaattttatatgtttaaccctaggtcttgaggattcttctgacacattagataatatcagtcaatctcaggacatcgagcaaggcaagttaccatataccttttgatcatttaagcctatattttataaattatttatttatagccttctattcaatattctattttttatgcataaatcaaccatagaaacccagacaatttagtattgcttattttgcttacaatctggttaaaataccttatacttagattgggacagtacgtaagatttggttgattcctgggtggctagtactgtctcaatcgatataagttttgccaggtacttatgtcaaacgaacgggtacgaccgcagttctagaatggggacagacctagtcattatgttacttagcaatgtgatacctctgtgtagtggttcttatttttaagtcctcgagcaggaggcaactatagctgcgaagggaaatttctaccattaccatgtactggtaattggtttgttgagctcaattataattatggttataattctaaaccctgatcgagatgacgtggtgtcatacgatcagttcccctcaagtaccccgggaacgccagaactcctctcgctgctgttaacgtcacgttcagagcgcatgaggatataagttcatggaacaggtaccacaattgttaataacctaatactgggccatgactaagctaatgaatattggcaagtcgtggactgcgggtaaagcgtacatctactgcagtagaatattcatgaaactattcgaatagccgtactcacggaattgagtaccgggactcatatggtaccctggttagaaacctaaagtatatatttcacaaactcttgctttaatatttccagattgtctattattgctttctgcaaagaactctactctatgccaacgcataacatgtttccatggtagcttgctaagtattgtgaatactcacccttgctctcattaacctttttcagatttgggtcaagaggaagacccctatgactattattatgatgaccctgatagcttagaaaatccctagaggttataccttcctagtcagaatgtactagaacttccgctgtgtaatattagtacttatgtttaattaggtgagtacctattcttgtaaaacccttagaattgtaaactttaacatatgcaatgaagaaccagctgtattacatgtatcaatatttactgatccaggcattgatacattaatctcagtcggatccaagttattagttttgggacccgacacgtatggcccacccttattcacaaagtaggtagtaaacatcggtgatgcctaataactaattcaatctttctctttaatacaagcaattatgatagatcggacccaaccgagacagtattaattgctggcaacaaagatcagataatttaaaaattatatggattcacacaaaaagccgatgagattgcttaggttacgggtaaataatgtatcggctaaagctctggtacaatcttatgcaaaaatatcatacatagttaaatctattaaacaaaccatattcttagcagattgtacttaatcaagacagagcaaaaccaatagccaacttaatagatatcaaggtgtgatacaattgcataagaggatatatgtaacatattaggtaaagaaagaacatgcaaacttaaacctaaaatacctatatcatgtaagatcagctgaaactccgatgcaacccctatcagcaattatcgagcaagttagttcttacaactttgactataacttagtatatcaaacctaactgatgcaacaccaagctatattaaaaattgatagatctgaacaaactgatatttgctattcagggtggtagatacattaactaatctaaaacaacactataatttaatataatatcgatattcccaaatttaaatcaaccaacacacgttaaacaatattatcaactttagattacctaatgtatatgataaataattgctatatcaactggaagtcgaatccatctgaagtaaacagtagccccgacgatgtcacaccctgataaatacatcccaacttaaaaatcactttctaaaaggaacaaaggaaattattaaaagcttaaaagaaatctcaaacactaagagcatctccaacagcctctctactcaactctcgaagccaaaaatttggcaaataagccaaaaacactatttgactctgcaagccatcaagcctatccattggccaactttggctagtctcccaggctggctattctcctcttcagctcttcctctactcatgcttttcctctccatcgccgagccaccaccacgccaatcacccgcacctccaccacgctcccttctggccccgccggaaagcccaagtcgcagccgtcgttgtcgtggtgcatgagtgggcggctcgccgccgaggaagatgagcggcagcggcagctcggcgacgaggaggggcgactcatcgacgaggaggagcggtggcggcggctcggctcctcggacctacggtggatgggcacacgacaacgacgacgaggagtggtgcggcagctcggctcctcggacctgcggtggacgggcgcaccacgacgacgaggaggagcgatggtggcggctcggctcctcgggcctgcggtggataggcacacgcggcggatccggcgtcgggagcggcgcgcgtcgcgaatccggcgccgggcaagcccgcacgcatggcgacggatcggcggcggagagaagcctccgtgctcccgtccccctttctctgtctcgcatctccagcgatggcggaacctcgtcgtctcctcaccgccgccgccgacgttgccgtgtccgccgcatctctagcgccgtcggtcgcctcgtccccgcacggcagccccctccgtcgaccacctccgtcagccacctcgtccgcacgccgtgggctcacgtggaaaaggggaagatagagggaagggaaaaagaaattagagactgacatgtgggacccatcaagattggagagtgggatagagagattgttggagtaaaaggcaaatatgactctctaattttttggccattggctaaatggacatttggagagtccaaaatagctaatctgttagagatgctctaaaatacgtcccagaaaaatccgaaagtggcttggagtatttttgttaaattctccatgctctaaaattggttcctcatttttacttgaatttttaaagcaaacaaaataattttaaagcaaaaaaaccaaattcggagtaaatttaaatgaaaaacctaaaaataaatctctcctctttgggccatttacggcccaaagtctgttttccctccccgctggcccgctcggcctttctctccctccctccctccctcccttttgggtcaatctccctctcccagcccgttcttttctccaagccaacccacttcctctcctctctctccatcggacctaagtccgtcctcgacgcggcctagccagcccaactgtaggtcgtcccctacctctagcggctgactgctcctctctctctctctctctctctctctctctctcctccgttcggaaccctagcgccgccgccgagttgatccacctcctcgcacgattctccaccaaattgatcagaaaagtcggttcctttcctcctctttatttttgccataatttcccactcaattgtgtacaaactcaccttgaatcgatgacttttcatctccggcgaactaccggcattgatggccggccagtgagctcccccggccgttccactcctcccctgcctataaatgggcagcaacacctcccctcccctttgaaagagaatctatgcccctagtgggttttggttaattgatgacaaacgattaggggattaatgcgcttattgaatgtataagcaagggattagtctgatgaagaaccaatgaagattacgaagaagaatatgcaatacaacgatgtttcattgtgattcaaggctagaagtgacgaaagatggcaagatgatgtgaccatgcctaccagtgatacaaccattgctcacatcattgatcaacaagaagtcatcaaggtcaagtcctccaagtgctggaatccgattcggccacctgctgcactgttgacttcaaagggccgccaaagctgcataggacctctgtttttggcccttgagtacttgacggaaagctctcggagtcctatttccaatagaaccagccacatctccgaattccagttcgtttggctgcaatcacacaaacaaggttctgcgtcacctatattgggccaatgggcttgtaactttatttgggaccccggccc

SEQ ID NO: 74633 - DNA, 10027 bp, Oryza sativa
gggggggggggggggggtctgagcagcccggagggccgcttccctccccctcaagctttgctacctcggcccaggatttgctaagggcctagacctatattacactacgacatgggtatgtaggggagtcgcaccgtagctatggccagcgccatggcatgccacaagagaggatccaccggtcctcgatcatcttctcctcctcttcctcaaactctctcttgccccctcctcccccgaagatcacgcaaaccctagctcctgaccacggcgagacttggacagaagatcacacaaaccctagttcctgaccaagttggaagctaaaagcgagaggagaaaggcttggagttggaagctaaaagcgagagcgagacttggagttggaagctaaaagcgagaggagaatcgtgtggcctagcctctccgcctgctcgccccgctctcagtggagttatggacgagtagaagaatggaataaattcattttatgacccttaactttgacagctacttcgattttcgtcttgaaccgatacacccgatatgttaaaaccagtgcaatatagattttaaggtggtttgaacaacggtttcaactaacgtgatgtctacgtggctaatttgatttggtctttatctggcgtggcatcgacgtgtcacattaagcaaaattcaacaatttaaaaaataaaacaaaatatgtgggcccatacgctagttaaataataagattaaaaaataatgggatccacatcagtgggcccatttccttcacctcatcgcatcaattctctatctcctcccatttcctcttttttcttgctccgactacggggtgagcaccagcgtgtcgaggttggactgcagcttccgctcgtcgcgctgctcctttcctcgttgttcgccgtgcctctccatgccgccctcggcggtggcggtttgcgggggcatgcgcttgacaagaggtcaccagacccaccaccaccatcttcgcctcgaccttggccgccattgtgccaagttgagctccgctcacatgcgtgtgcccacacacacacaccgatttaagaacaaatacttaaaaataaaatacaacgaaaaaaaccataaagcttataagctaaatcctaaatgatgggttgtcaatgttgagcaagaaaattgacattctaccattctcaaatgggtgctttgctaaaataccactccacaattgaaattcgccagaatgtcactctcaactgggggctccgcccaaatgtcattttctttcaattaaaatagttgtccctttcctccatctttgatgaccaaaatgcccttggttgtgtggcggtgtgacgtagaggcgggctagtgagcgtgagcagcagtgtggcgacagaggcgcgagcaatgggcggtggctggatggcgcgggaggaggtgcagcgacggacgacgcaaggggaggggcggcggagaggcaaccagcgaacgcgagcagtagggtggcgatggagaggcatgaatggggatgatggttggatggcatgggaggaggtgcggcgatagggcggcgcgaggtgggtttaactatttgccactcttacaaagtgacactcttgagatgccactcttccaaatttctttacagaaatgccacaaggagagagagctaatatttatgaattaccaattttacctaattagaacgccatgtcagctttgcaagtatgataggagacttaaaatgactcttttacccttgggtcaaagtaatattgattatcatatgagataaattattatggacaaatattcattgaaatatgagggaattatatacaaagtttgtatacagtattcgttgaaatatgagagaaatttatacatgatcttgttatgcgtacacaaacatcaaccaggaaacagacacaagtatgtattaaaacagacaattggtagattaatttctcaaatcaatctactaatttcgtagatatatgcgagatatatctacataggtacgcaatattttatatacaatttatcgtaatcacgtggttttcatatataaatgcaacaccgccttggccaacaggagtagggctattacatgtgtgcccgaatctgtataaaaatcattgtctctcgtctcttttacttcaatcttgcgtataccatagctccaatgatccccatactctatgttggcagtatctcatgagacccttcgaccagatctgccgaaaccgtgcgaccagtcaggattcaggctcaaggtgttaagttcatcggggcaaagccccatggtgaaggcggtgaagccacatggcgaagacaatggagcgaggacggcaaaagatggagccccatggcgaagactgtacatcctgggcgaagggtgcccgccaaaggagggtgacttcgccatcctggccgctttggccggcctttgggccggcattcgccaaccaggcccattagaggcccatgtatgccaatgacactgtatacccatgtaaatgtccctttcacaagggcaaccatataaattcccctgtaaaacctaaaccctaataggggggcctgtaacaaggatataaatagacccctagggccatgtaaaggggatcctaagaaaaattctcaatctaatacactttactgttttccaaccatcgttgagtaaccacgtccttcgacgtatgcagttgtcatttcgacaacagctggcgccgaccatggggacctccaagcgaaactactgagagcgaatgcccaccaaagagggtcgtgaaggagaaggttacaaggtgaaaggaaagcgaagctgggggagagatggccaccgaagagggtgtagagccttcggcgcccgtcgccgaggatggcggagcgccaccagcttcagcacccgcgccactgctgccgtcttcggctcctatcgcctcgctggggcaggtgccgaacacgcctgacacgatgaaggcggctgcagcagcaagggcactccaaaccagggcggagatcctttcgacaagccatctgctggcgccccaagccgctccatcacaaccggcaatggtctcgactgcgctcgtcgccgcacaagtaaaccctgaccccgaaacacaagccgaagccgacatggaagccatgcgacagaatatgacacgactccaaggcatgcttcgacagatgcaagaacagcaacaggcgtacgaggcagcgaggcgggccaaggccgcttcggccccaatcctccagtattcggcaggctatgtcccaccccaagtctacccacaagccacgcaagtgccagcatacttcgtcgggcagccttcgatcgcagcggtacatccggcccctcgcgggcagccgcaagctcagccggtcactgttcaagtacacccacaactgcccggccaagtgtcacaagcaatggcaaaaggggcttcgactcggcaggcacagcttcaagctttccttcagcaacttagccaacccagaacacaagtcagggtgcgcccagttggttgccgtcgaatcagccaggtctgggggcttcgccttggagtcagggaccgcagttcgacttcatcaatgctgctcaggcaccagctgttcggccgcaagcaccaacgccaggcttcggggcgaaccaagcaccaaaccaggccgccatggcgtggccccagccaacgttcgactcatccatggcggctcatcaagcaccaccaattggaaccgcgcagccgaacactgtggcccaaccttacgcgcaagccgttacctcgcctttcgccacgccatatccgcaacaaggtgccgtgaacagggcaggggcgaaaaggggctaccactgagtgggggaatcaagatccgtccaatcccaccccagttcaagttcctacccgtcccacgctattcaggcgaaactgacacaaaagagttcctatccatctacgagtccgcgatcgaagccgctcatggcgacgagaataccaaggcgaaggtaatacatctcgctcttgacagcattgcccgttcttggtacttcaatttactagctaacaacatttactcatgggagcaattgcgcgatgtctttgtccttaattttcgaggcacctatgaggagccgaagacacagcaacatctactcggcattcgccagagaccgggggagtcgataagggactacatgcgtcacttctcgcaagcatgatgccaagtgcaggacatcactgaggcatccgtcatcaacgctgcttcggccggactgctcgagggcgaactcacaagaaaaatcaccaacaaggagccacagacactcgagcacctgctccgcatcattgacggatacgcgaggggcgaagaggattccaagcgacggcaagtgatccaagtcgagtacgacaaggcctcagtcgccgctgtccaagcccaagtacaagcgcaagtatccgaaccggctcctctcgctgttcgccagtctcaaccaccggtccaaggacaaccgccaagactaggccaagctcctatgacttggaggaaattcagaactgaccgtgcaggcaaggcggtgatggctgtcgaagaagttcaagccctccgcaaggagttcgacgcccaacaagcaagcagccatcaacagcccgttcgcaagaaggtctgaaaagacctctactgcgcttttcacgggcgctcttcgcacaccaccgagcaatgtcgaaacattcggcagcgtggcaacgtgcaagatccaaagccaccacaaggacaagccaccgaaccacctcgcgaagctattcaagagcaagcgccaccggccgaacaccgccaggatgggcagcgcagagtaatccaagtgattacaaggaccgacccgccgaatcagctgtcaaaacggcaaaagaagatgcaacagtggatggtgcacaacatcacttcggcaggcgaaggggccccgcgatacctgaactagcagatctctttcgagccagaggatgccgaaggggtgctgttcccacatcaagaccccttggtgatctcggccgaggtagctggcttcgaagtccggcgaatcctggttgacggggggagtttggccgatgtcatctttgccgaagcatatgccaagatggggttgccaaccctagccctcacccaggctccagccttgcttcgtggttttggcggcgaagtagttcaggtattgggccaagtacaactggtggtagctttcggcataagtgaaaacaggcgcgaagagcagatactgttcgacatcgtcgacatcccatacaattacaatgccatcttcagtcgtgcaaccttgaacaagttcgaagccatctcccaccataactatctcaagctcacgatgccgggcccaattggtgtgatcgtcgtcaaggggcttcaaccttcgaccttatcaaagggcgatctggtagcaagcaggacagtggacaatgttgaggccgaaccacatgaccatgctaaacgcatgccgaagcctgcacctcacggcaaggtgatcaagatgcaagtcgacgacgccgatcccacaaagtttgtcctgctagggggcgatctaggcgaagaggaagctgaggatatcctgaaggtgctcaagaagaacattgacatcttcgcctagggccccgacgaagtgggaggtgtttcgaaggacctcatcatgcaccatctggcggtcaagccgggtgccaagccaaggaagcaaaagctgcgcaaaatgtccgctgatcgccaggaggcagcaaaggccgaagtacaaaaactgctcaaggcgggggtgatccaagagatcgatcacccagagtggttggcgaacccggttctggtgaggaagtcgaacggcaagtggcgcatgtgcgtcgacttcacagacctcaacaaggtatgcccgaaagatgacttccccctaccacggatcgaccagcttgtcgactcgacagctggttgcgaactcatgagctttttggatgcgtactccagctatcaccagatccacatgaatccggccgacatccccaagacagccttcatcacgtcgttcggcacgttctgccacctcagaatgcctttcggcctgaggaacgccggagcaacattcgccaaaatggtgtataaggtccttttcaagcagttggggtgaaatgtgtaggcttatctcgacgatatcgtcgtaaaaagccgcaagactctcgaccatgcgtccgacctacaggagaccttcaacaacttgcgcgtggctggtatgaaactaaaccctgagaagtgtgtttttggtgttcgcgcgggcaagttgttgggttttcttgtttctgaaaggggtattgaggcgaaccccgagaaaatcgacgccattcggcaaatgaagcctccgtcgagcgtacgcgaagtacaaaagctcgcaggccgaattgcggcgatcagtcgatttctctcgaaggcagccgaaagaggtttgcccttcttcaagaccctccggggcgcgggaaagtttagctggacacccgaatgccaagtcgcgttcgatgagctaaagcagtatctgcaaaacccacccaccttggtcagcccaacaccaggaagcgaaatgctgctttatctagcagcttcgccggtggcggtcagtgcagctcttgtccaagagacagagtcaggccagaagccagtatatttcatcgccgaagctttgcaaggggcaaagacaagatacatcaaaatggaaaagctcgcttacgctctagtgatggcttcgcgcaagcttaagcactacttgtaggcccataaagtcactgtgccatcgcagtatcctttgggcgaagtactatggggcaaggaaatcaccggccggctcagcaagtgggcggcagagttatcacccttcgacctacattttgtcactcgcacagccatcaagtcccaagtcctagcagacttcctggccgaatggacaccggcgttcgcccccgaacccgagtccgtcgaacagccttgggtaatgcactccgacggctcgtggtctcaaaagggggcgggcgcctaggcagtactcacttcctcagggggcgtgccgattcattatgccgcacggatgcagtacggcactaccaacaacatggccgaatacgaacctgtactattgggcctaagataagcataagaattgggggtacggagcttgctcattcgaacagactccaaactagtggcaagtcatgttgacaagtcttttgacgtcaaagaagatggactgaagaaatatgtggaggccgttcggtctatggaaaagtgcttcgctggcataacggtcgaacacttacctagaggccagaatgaggaagcagacgccctggcgagatccgccgcctgtggaggcccgcattcgccaggcatcttttttgaagtcctatacgcaccaagtgtgcccgcagaaagcctagtcatcctggcaatcgaccaggcagaactgggcgaagatgcagaggactggcgaacaccgttcgtcaagtacctcaagaacggctggctcccggaggatgaagcagaagcgaagcgcttacagctcagagccacaaaatacaagcttatctctggccagctgtatcgctctggggtgctccaacccttacttcactgcatctctttcgccgaaggagaggaaatggcgaaagagatacaccaggggctgtgcggtgcacatcaagccgcaagaacggtcgcctccaaagtgtttcgccagggagtctattggcccactgtgctgaaagtttgtgtcgagcaagccaagaagtgcgaaagctgccagcggcatggccgaagccaaactgcacctcagtacgagctacaacctatcgcaccagtatggcctttcgccagatgggggctagacatcgttggcccattccctgtggcgagaaatgggtacaagttcgcaattgtagccatcgaatacttctcccgctggattgaggccgaaccactcggtccgatcacttcagcagctgtgcagaagttcgtatggaaaaacattgtctgccgtttcggagtgcctaaggagttcatcactgacaacggcaagcaattcgactgacaaattcagagaaatgtgcgaagggctaaacctggaaatcaggttcgctttggtcgcacacccacagtcaaatggggcggccgaacgcacaaatggcaaaatccttgaggcactcaagaaaaggcttcagggggtggcgaagggtaaatggccagacgaaatgctatctgttctctgtgcccttcgcacgacccccaccagaccaaccaatttcagcccgttcatgcttctctatggcgatgaaacaatgaccccaactgatctaggggctaattcgccaagagtgatgttctctagaggcgaagacgggcacgaggtgtcactcgaactccttgaaggggtaagagtcgaagcactggaaaacatgcgcaaatacgccacaagcacttcggcaacttataacaaaaaagttcgcccgatagagctgttgcctggccatctcgtcctaaggaaaaaggcgaaccctgtggcggtcgggaagcttgaatcgaagtgggaagagccataccttatcaagcacaggtccaggacaggctccttttgcctagcgacgctggaaggcgaatagttcgaccattcctggaacgctgcttcacttaagctcttctatgtctagaacgggtggcacccaaattgccaacttgtaaaaatgtataatactgttatgtaagcctttcggcactatgtaagcccttcggcacaaaaatgcaaaaaaagaggaaaataaaaaaagagaggaaaaaaaactggatgtagggttattatccgccgtggaggcacgaaccaatataaaatccttgtgtttttcgcctctttacctgtgtgaatgataattcgtggaaaaaccccaaggcaaatgtcacgcccagaaattcacgaaccataatttctaagctgaatgtgcattaaacccttgtccagcaccagccagggtacacaaacgacaattgttgacatacagatccacgtcttacaataatataaaagattacaaatgcaacggaaatggaaaaagcgagctaagcctgaagacttgactcttgcagcgggcgactccattccacatgcattcctgatggtagcgacgaaaccaacctttctgagacagctccaactgagaagaactttagctctggagtaggggaaaagagagcaagactgagtactacccactgtactcagcaagtcataccggaagaggaggtatgatgcaggatatatccaaaggaggctagaggttcatttgcataaagctagtatttaaaagcagtagttgaaggaaataaaacagttgaagtaattaatcaatattaaccaatcactgtccaacactacactacgttgcaacaggcccaaccaaccacctgaactacaccagttcattagctaactaggggtgagactaatcacggtgaatctggtcgaccgcccataaccgcgggcacggctattcgaatagttttactctgatcagaggtgtacaactgtacccacaagacacagccccacaacacgttcccgtgcgccgacatgccaccacgacataccggaaagaggccgtgacaggaccttttgcataaccccctctaaccaatcgcaccacacctcaggtttcaccctcactcctcgcaaggcagcgggcagtcccctctcgtgccacggtgaatccggaagccgatcaaccggacaccccggccgacccaactccatcacgcccacccttgcctgggtacgtcggctagaggaaagctacactacaagcccagccgttgcccacgctggcttgtggtaagaacgataaattcttccagggcatcccgcgaaccggtccttaatcgccatgggcacaactagcaaaaccatgcacccacagcccaccatgtactgtattttaataaactaacaccattg

SEQ ID NO: 74634 - DNA, 9124 bp, Oryza sativa
aatttttaaagattaaatcggattaaaacacttaaatcggtttaaattgaattatgacgcaataatgaattatttttaaaaaggaaaaggggatttattgcgtcaccgggctagggtttgggtggaccggcgcacggcgcgcggttcacacgaacggacggccaagattgatccgatccaaatcggacggccgagatcgatcggtctacgaccggctcacagcgaacggccccgatgacgtcagcgatgacgtcaccaccggcggcggcggctcggcggctcgggcttgcatgctcgccggcgaacgacggcacggcgacgcggacggaaggcaccaacgggtagcggacggcacggcgaactcaccgacgaccaaagcgacggcggaggaccaacggacggcgacagcgacgaggttgaaacggcggcgctcttcggcttgacgacggcgacgatgctccggcggtctccgacggcagcgaaggggcggacgaggacggcggcgacttgacgagcacgacggcggtcttcccgagtggcggcgacggctggaacgacggcggcgcacggctggagcggcggcggcgacggcaaagctagggcacacggcgctagagctcttccgacgacgagaggcgaaggcgagggctgcgacgggtagaggagacaccgggggtccttttaaacgggctcggaggcggcggcgaaggcccacggcgacggcaacggcgaaggaaaccttcggcttggagagagggaaaaccgatccgaatcgaactcgattccaaagctttccaaagcgattgagccaaagattccaaaggagaaaaggtagaggagatcccggagatcatttcccctctattgattcggccggagaaggaaaggaacggccggatttggaaagggaacggcggcggcgctcggcggcggcgcgctagggttccggcccgaggaagacgacgactccgacaggcgggacccacctgtcagcgacagcgagggcgcgcgcgcgcggcggactgggccggctgggccgaggagagagaagagaggttttgggccgactttcggcccaaagccaaaagaagactttttaaaacctttttcaatttaaattattccttaaatgcaattccattattaaaaatactttcttagctcaaataaatcccagaaaaaatctaggaattatagaattaagcaaagtatttaatgaaattttatctggcccaattttatattggaatttattaattaaacttagattttcttttcaagacttttaaaataaattctagaaattccaattaaacaacaatttatatattttgaattttcagggtgtgacaggacaccggccctgtgccatgacatctcgactaccgggccacagctcgtgtagccttcatttgccctggagatgtccatcgaacccccgacttcgtccatctccatccgtgtacttttgtttataaccagactgagccacaaactaagccttacccactagacatgtggaagtacggtagtgctttgcaacagaggcccgaagaccggtccttatatggccgaggtgcagcggccgagagaggggagggaaagggggaaacgaaacggcggtccacggctcaccccgagtcgacggcgatgacgaaaacggcagccggagcgaaggaaggtggcggcgcggctcgggtcgacggggtcgacggcgttccggcggtcggcgagcgaagcggaggggtggacgaggtcggcgaggatgcggcgaagccgaaggaggcggcgccggggcgggagatggtccggggcgacgacggcggcggaccggagctcggcggcgacggcggagagagagtgcgatggcgcgggctcgattccgacggggaggaagggcggcgagtggcggaaacggtggaggggagcacggggatggtttatatagggttgggagtgagggagggcggccggaggagaaggaaaccggcgcggaagatccggccgccattgatggcgccggcgaggtttgcgggagtgaatccaagcgaatccgagggagagagagagggaaaaacggggggaaagggagagggaatcgcggggaatatttccccccactttaatgcgcgcggggatggtgggaggcggcgggattcgcggcggcggcggcgctagggcacgggcgaacggcgggagtgtcgggaggaaggggatgacgggtgggccccacccgtcagcgagggtggtgggcgggcccgcccgtcagcggcgcgcgcgcggggagaagtccgagtgggccgcggggagaggagagggaggggagggagctgggccgagccggcccaaaagggggaggggagggaaagggaactttttagggtttttctttttataaaacctttttaactttgtttatttcttcttaattattatttgtgctctgaaaattccactaaaatttatttacgcattttaggcttttaggaaatatacaaaaatcctccaagccttatttgacttttatctttgcacattttaatttttgaaggctttcacatggattttaattattctaatcataatttagaggatgtattttagagtcgatttgggacgcgacaattattgatcaaataattactgaactgttctttgtatcatttaggaattgagctctgaaaaaatccgagaaaatttcagagagttgacttaatcatggagaatttaataaaaattaaatccatccatgctttagatttaagaaattttatttcccacatttaacttcacttgtaaaattaaagaacacttaatataaattctattattaatttattaaataatttataaatcctgaaacgaaaatcaggatgtgacaaactaccccccttacaaagaatctcgtcccgagattcggaacggctagaaagaaaaagggaataggtaaactgcagtctatcttattccataactccgataatcattctaaagctttaaagaaaactactgctgctttgaaactggtggctgagctgtaacacttgaaaacgcaactcttgaagacgcaactggcactgcattggctcctgtgacaacaatgttgttgacctgaccttgcgactgctcactagtagactgtgataacttaacagtggttgggttcgatcctgtcatgacaggcagcctcagtgaattggtgatttataataagccagatatagacgataataatcatcgctgctccgtagcagcacatttgttcgcagcggtgtcaacgacgaaggcaatacctgttggttcattccaacagcttaagaagcttgaggtggacagcatctcagcggtgtttgttgcccccatttgcagcctcctcgcttccaccctctacaggttgaggttcacttatgatttgtggatgaaaaatttcacaaaagagcaggagcaggcacttcagctcctcacctccctccgaaatctagaattctatgagtgccaccgtctgcagtcccttcccgaagggttgcatctcctttcttctatctgcacattaggcatcgtcggatgtcctgaaatcagatcgttgcccgaggagggcatcccagcttcactgaaaaaactactagcaatgcgttgcagcgtcgacctgaaggatcaactcaagagattagaagaatcaaaccaagatttacaagtattctacatctgatcacccaaggtaagacgtgatgtcccaactcctttgttttttactctttcatctgcagttgttcatatttaaactcttttttacctgttcgttgttactgttgatcatctagcgagccaccactactctcttttgaacaatgaagtgcagatacacattctaaagtcatttgaacaatgataaaaaatcaaatccgatgggaaaaaacaagaaattgctagaacatgttggacaatcgccatcttttcttactgtgcgcaacaagcctaaccttggcattatggaaactttgcagtaactttgcagtaattagatcgtggatgttctgtacgttgctttattgggagtgatgaccaaaccatttgccacacatagcttgtttttttcaagagaattacagttttgattaaggagcaacacccaaatgattgtggagctaacctcgtttgtctctatttcatcatatgttatgttacagttttgattaagcagtattagatttagatgagagcaactgtaattgtttatggttctggtaacacagtttcatggtcattagtaggagaattctttgaccttattaacttgttccctttcagcaaagcattgtggaatggtgttttttttagcctattcagaaccagttttttacataatggaagctttattaatctcagtaaatttcatcaagtgatacaattattctgagagcacattcggcttctgcaccaaagagtacacacagccaacaagaaagaaacaaaagataaactcatcatccaaaatagcagaaacaaaaagaactttaggagcccgctaaccgtagcctagaacgtcacccatgtgctggggtagaaaactactatatggccactaactctaattgttgacaaaccgcaatgatagtaccctgcaaattgaccttctgaaggatagcctatgagcggagccaatgtgtaatcaaaaagataacctgcaaaggagaagatatgttttttcctttcaaaaaccacattatttctgaaaagccaaatagaccaaatagtggtagttgcacctaataagaccaaagatctcaaattgcgtgattgtcttcttatccaatgcccaaacatatgagttgtactattagataaaactaatattcgaagcaaactgaattaaagaccaaaccgcgcgggcaaaataacaatcaaagaacaaatgattaatagtttcatctttgtggcagaaagaactagacttgtttcctctccaattccttttaatcagattatcttttgttaagattactccatggcgtaagttgtcacgcccgaaaattcactagtaatttccgaacttatttgtgcataaaatcctcgtccaggaatcagccgaggtacacaaactaacaatttaatatacagattcatcaaaatatctaaaacgataaatacttactaaagaggcacttagtcctcaccatgaagaaaactgcagcggaaaaaaaaaaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcgcaaagataccaaaggttggcataatataggctcatttgcaaaagcagcatttagcaaaacatttaagagaagtaaaacagtggagtaattaatcagaaattttaatcaacactgaacaacacgcccatgctgctcaggcccaaccattctgaaacaaccatacccggctgtacagatctaatctccaatccaggagctaagcaaattattaccagatataacatccataattattgtgagaagtgtgggactaatcacgaaaaacattgctcaacccgcccataaccgtgggcacggctattcgaatagttttactctggccagaggtgtaccactgtacccacaagacacagccccacatcatgtcaccatgtgcctcagtaccaccacggtacctcggaaaggggctgtgacattaccccttgcataacacaatccaccgcagtgcaccattcctggatcataatcacccccttataaataaggcatggactccccagcgacccccgtgggcttatctccgccacttctcagtctggtgccccgcaatgaaccatgctatacgaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatatctaatatctagctgaaccaatatataaagctcaacttgtcaagttataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgcactcacgaaccttcgcaacgacggaaacgacaagctaacacgcaaaacgaagaaaaagactaataaaaaccaaataaacagtacatataaagtaaacaaacatgtagatcataattttagatgaattatgagacttgaacggcctcattctgacttcataagaatttattatgaaatttacaagattaaatctaattaaagcccatttaaaaagaattaaataaatttaattctatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaggaggattattgcgtcagcggctagggtttcgcggtggaccgggtgcacggcaacggttcatgggaacgaacggccgagatcaaccctatccaaaacggacggtcgagatcgatcggtccacgaccggctcacggcggacggtcccgatgacgtcagcgacaacgtcagcgatgacgtcagcaccggcggcgactcgggcggctcgggcgcgtatgctcgccggcgaacggcggctctacggcacaaacggagggcaccaagacgtagatcacggcgcggcgaactcaccgatgaccaaaacgtcggcggaagaccaacggacggcggcggcgtcgaggaaaaggtggcggagaagatcgggtcgacggcggcgacggtgctccgacggtcttcggcggcggtgaagcggtggacgaggacggcgacgcgacggcgaccacgatggcgatcttcccgagcgacggcgacgtctggaacggcggcggcgcacggctggagcgacggcggcgacggcggcgctagggcacacggagctagggcgctacggacgacgagaggcaaaggcgagggtggcggcgggtagaggagacaccggggatccttataaaggggctaagaggcaacggtgaaggcccacggctgccggcgacgagaaggaaagatcggggtttgaaggaaagagaccgatccgattcgaactcgaatcaaacacattccaaaccgatttagccgatgtttccaaaggggaaaaggtggaggagatcccggagatcgtttcccctcaatcaatttcaccggaaacggaaaggaacggccggatttggaaggagacggcggcgcttgcgctagggtttcgggcggcggcggcggcgcgaggaggaagacaggcctgacagacgggccccacctgtcagcggctgagagagaagagcggcggctcggcggactgggccggactgggccgaggagggagagagaaagagagagggagggttttgggccggctttcggcccaaagccaaaaaaaaaacctttttcaatttaaattattcatgaaatgcaattccatttattaaaaacacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaacaatttataatttaaggattttaaacaagaaaagcacttaacaattataattagatcattattgatcaaataattactgaactgttctttgtatcatttaggaattgagctctgtaaaaatccgagaaaatttcaaagagttgacttaatcatggagaatttaataaaaattaaatccatccatgctttagatttaagaaattttatttcccacatttaacttcacttgtaaaattaaagaacacttaatataaattctattattaatttattaaataatttataaatcctgaaacgaaaatcaggatgtgacataagtaccataagaagatcttaatctctagggaggactttgatcttccagattcttttgtttatattgggaacatcggtctgcaccaacgcaagataaagagatttaaccgagaatctaccatcagtggttagattccatttaaactcatctgggtcgtgagataatataatattagcgatgcgtgagagaaggtgattccacgctactaacttagagccagtaaggtccctgcaccaagaaaagcttagaggactggtctggaaaatttctgaaatagttgcatgtttatgcctaacaacgttatagagatagggatattgttctctttaacaggcattcccccaaccatttatcttcccaaaaccgtacttgagagccatctttgatgttgaaagagccaaacctaataaaatcaggcttggccttcattagactagcccaaaagtgtagcgcccgttccgtcgtggcgcctagcgggaaaattaactcttaaaaaccctaattgcgaaatttgtttccttgcttgttgtctagtgtccgtgccatctcaagacctcaatccccgatctatcgtcaagtgcaattcccaatccaatcctttcaatcaaattccaccgcaaaaagtctattttgcctcccccgaggtcgatgggcctaatctcgctcggcccatctctctct

SEQ ID NO: 74635 - DNA, 8531 bp, Oryza sativa
agggagggttttgggccggctttcggcccaaagccaaaaaaaaaacctttttcaatttaaattattcatgaaatgcaattccatttattaaaaacacttccttagctcaaataaatcccagaaaaatctagtaattatagaattaagcaaagtatttaacaaaattttatctagcccaattttatattgagatttaacaaattaaaattagatcttctcttttaggcttttaaaatcatttctaataattccttttaaacaacaatttataatttaaggattttaaacaagaaaagcacttaacaattataattagatcattattgtcacgaccggaaataacccaacgggcgttccttacgtgcgtgtattattccttgtcctaggaggcaaggtacaccaaaagttgatacaattcagagtttaacaagcgaaagcgtaaatagttatttattacatgggcagcgacggcccagcacactcaaagacaacgaaaaacagcggaagactaaggcgacgaccacaggcgcttgacggcaggcacgagctagacaccaaagccttcatcctccaggggctcctcttctgggtttgggaaaaattgaacaagactgagtacaaccaccgtactcaacaagacacacccacaagtgcagcataattgcaaaggagtacaatggagttataatataggggttaggttttgcaataaacagcatttaaaagacccttagttgctcaaagctaaatttaaaacacgatcctagaactatttaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtatgaatccaattccacaacaatccaacaaatccaatgtgtccaagtgatatgaatattaccacaatctagagttttaaaaccacctaatgttacctaattaatcagcgaagcatctacctaaaatcatactagtgataccacgagtagagtgtccactagttgggggttttgtttatcctagggtgaacaaggtaataataacaataacaataataataaggtcataacaaaggtaaataggcatggctaaataaaacagtgataacgcgggaatttaaataaagcgatgatgcaataatttaaatcaaaataatttcataaattgggattcaatatgttcaaggatgatgtgtcttgccttgctcgctttcccaaatgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattccgagttcaaatggccaagttatagccatttgaagtttatatgctctttaaatgaatatttgcgaatttcttcatttaaattttaatttaaaatcggatttattgcgtcagccgacgggaggggcgcgcggaccgggtccacgggagtggggcccacgcggcagcctcacggtccacggtggaccgggtgcacgcggctggcgccggccggcgccgtgggtcccacgcgtcagccgcacccgcgggcgcgggcggctgacggccgggccccacttggcagccgcgagggcgcgcccgaaggcagcctcgccggcacggccgacgggaggcgacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaaacggaggaaggcggcggcgcggttcgggacgacgaggacgacggcgctccgacggtcggcgagcgaaacggaggagcggacggggtcgacgacgacgcggcgaagccgaaggaggcgacgccgagaggggaggaagtccggagcgacggcggcggcgaaccggaactcgtcggcgacggcggagagagaggaaagcggcgcgagcgcgattccgacggtgagagcgagcggcgaacggcggaaacggaggagagaggcacggggaacaattaaatagcgtcgggagagagggaaagcggccggaggagatggaaaccggcgcggagatctcggccgccattgattgcgccggcgaggatcgcgggcacaaaatcggacgaatccgagggagagagagaggggaaagtgggggaatcgggagagggaatcgcggggaatgattcccccctcattatggtgcgcggggacggcgggatgcggcggaatccgcggcggcggcggcgctagggcacgggcgagcggcgggagcggcgggaggaaggcgatgacaggtgggccccacccgtcagcgagggtggcgggcgggcccgcctgtcagcggcgcgcgcgcgggaggagccgatgggccgcgggggagaggagagagagggagggagagaattgggccgagccggcccaagaagggaagggggggaaagaagacttcttttagggtttttctttttataaaacctttttaactttgtttatttcttaataattattatttgtgctctgaaaattccactaaaatttgagggctccttttagaccaaggagaatttaacaaaaattctccgggccacatttgaatttttcttgtacgtattttagtgtttgccaatttctttccgaattttaattaattctattattccttttagaaaatgaattttaatttcgggatgaatttatcaggacgtgacaaatccaccccccttacaagaatctcgtccccgagattcgaggaggctagcaagaagataggttgggcggtcttctcttcttgtctgacttcttccgtcgcgtcttttataacaacttgcctagcaaaacttctctactctggactgcttggctcaatctcctgttgcagatggaatcttctcttcacctgacttgtccctggttgaacctttagctgacttcgactgggttgcggcacttgaagatggtgcttcagttccagaacttcgcatagttcatatttttggcgtcaacctcatagaagttacccatttcacgttatgcgtcgagatcagctcgtcattactaggataccatgcttgtcatcatgagcatatcatgcttgtcatttacttctaacctgccaccaactgcctcatattagctttcctagtctccgggtgataactacttctgctatttgatgcaagggtcgataactttgcctttgaattatgtttcccaagagaaccaacttatcccacttgacatactttgacgtcttcccaaatggctttactgctggatttgttgttgtctaatcattatcctgccaaatctgaggcttcgttgttagatgcgattttaatctgacctctgtagattatcttcgaacatatcacttggttcataactgggaatagctctcacgaacaagcaactcggattcactttctttacatttggttcacttcccactattctcttcatgttgtcatcatttagcattcaacatattcctttgcaccttccgccttgatgtgttctttctcgatggatcgattggtaggaaagtgcgttgagcgatactagtgcaagtgctttcattctagtagcatctgatacaaagcccaaggttgaaccgagctttagattccactgttcaggttttacttattgacttcttggtcatgtcacaaaagtttccatccttgtccccatagaagtacttctacctgtggtcatctctcttactcgtgaattcacctattttaatgacagggcaactgttgtagggttgtttgctatcgggagtcttccttgagtgacacaaatcatggttctcgttatcctttatcaatcacctttcgacctacttcttttcccagtaaccaaacatcttttccgatctcttccattaatcacctttcgacctttctcaaccaggtactcttcactccgggtgttgaggatgcttctggggcaatgaggtgcttgggcgtgctgtctttcagagaaaccttgaagtagttcgtcaaaagctagactgacgattgttgcctttgatccgaagagacacatctgaaactcttagtccaaacaaatgcctctttggttgatcacttgattttcttcgccatcaatcgctaggctatttgattcctaacagattatgggtttacggaaatgagaccctaggtctccctaatcaacaacaaaatgtgcacaactcacagcacttgcactcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgtatttgctccagtgaccacttggcgattggcatgtctgcttccttaacaggtactacagtttgtaacagacaataactttcttacgctcgggttcttcatcttgtacttgatttctttggctgctgtgcacgggcgggagggcggctcggcctggaggggggggtgcggcttgggccgggcaggccgggagggggggggagagacagcccgggagagagagggaggagggtgctgggccgaggggaagggggcccaagaggagggagagaaggagagggagagaaagagagggaggaatgggagacttcggccgcgggccgaggggagagagggaggactttgggccagacttggcccaaaggaggaaggagggttatttttaggtttttctttttaataaactttgttaattgtttttgttgcttaataattatttccggtgctataaaaattcaagtaaaatttgagggctccttttagaccaaggagaatttaacaaaaattctccgggccacatttgaatttttcttgcacgtattttagtgtttgccaatttcttttcgaattttaattaattctattattccttttagcgaatgatttttaattcgggatgaatttatcaggacgtgacaggagggtcctcagcagaaaagaaaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagtttgctgctgacgaagaagatggccaaccaacccgccagttccaacggagagaagcatcaagatggatgaagtcgggggtcgatggacattctccagggcaaatgaaggctacacgagctgcggcccggtagtcgagatgtcatggcagagggttggtgccctgctgctagggtgctcagtcctgcctgcctgtcccgggtgtcccggccgtagggggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataacattgtatagctctaggatcgtgtttacaaaatagcttgagcaactaaatgtctttaaatgctgtttacttcaaccctaacccctctatgttataattcccttgtactcccttgcatttattctgcacttgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgatttgtatcaacttttgctgtaccttgcctcctgggacaaggattaatgcacgcacgtaaggaatgcccgttgggttatttccggtcgtgacacaccatcacctgggacgagttttcatctgtattcaagagatcccatgttcccgcaggaatgatcacactgagaaaacgagagttccgctacctgaagcaagaagatttgaccgtcacagagtacctgcacgagttccatcgtttggctcactatgcaccagaagatgtggaaaatgatgaagacaaacaagagaagtatctccaggggttaaaagatgagatcacagtgcaactactcctagaggaatatgaagattttgagaaacttgtggacaaagccatacaactcgaaagtgagcataatcggatgaagaactgtaagagaaggattgtcagcatcccagtattcccatgtggtaaccaaagacagcgcacggagccacttcagatcaccggatcttctgttgcgcatcaagagtttcgccccaagaagatggacacaatgcagacaacaacattagcaatactaatgatgatgataccaccaacaaccatgcttcttgccccattagtgaccactcaaatcaagcgtgcaatgtcaacatcattcaccaaggtgtcgacgatagtatcaatgatggcacccaaaatgacaaccctagcaattgtgactctgagaaagactccaatggtgatagcaactatggtaccactgatgccaatgttagcaaggatttccaaccaccaattccaactccaagtcagaatgatcgtccccagacggatagctcagcaaagaagacgttgatttgctacaattgcaaaggaccagggcattactcgagggactgcctgcaaccaaggcaaagtcgatctccacattaccgccaatttacacgaagcagacatcccaatcgtattgtggtcactggagcaaacgccgtacccgtgaggcctcgtgttaatcagaacccatagcagaaacaatgtgccgatgctaagcacctttccttttaggcagtgcttagtattcatgtaatgagggagaaatgtgtaatacagacaagttctatgagggttcttttggaagatgtggatatgtgattatgtgtataattgcttactgataaaggagacctagggtctcatttcagaggaactatgttctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatg

SEQ ID NO: 74636 - DNA, 7029 bp, Oryza sativa
tctctgtgagggtttcagatttcagcttcactctttgagagtttcaggaacaccgcagctagcgtgtacttgtccaagagcaagataatatgttgtttcagctcaaattgcctgattaaatatccaaaactttcatgaacacgtcataccagcccattataacatacaataccttcatgaacacaatgaaatcaaccgtcaacttctgcttgaaattgttaaggtttttagtccatcagaggccaaacaaattggagacaaagcactaaccatcataaaaaagtagtaatgacaacaaggttgctgcaacctaaaaacttacaatataaatcacaagaactgggcagtgttggaaattaatcttgttgtttacatttttagttattttttgtatttgcattttgggacaaggcagaagtgtagtatgtgtagcatcattttagataatggaagctttatttagactcagttaattacatcaagatgataaaatcaaactgagtcacccacggcctctgcataaaatgcacacagccaaaaaagaagaaagaaacaaccagaacatttcccaagtacaaaagtttgatagaaacatatatcttagtggctatcaatccatagactagacagctacccatgctcctgggtaaaaaactcttgcgccacctggtccaactgtcgtgataccaccgcaatagtatcccacagtcccggttggtggaggatagcccaggtacggagccaccgagtaactaaagtgataacctgcaaaggagaagacaccatcttgttattaaaaattactccattcctgcttagccaaatagaccaacacagagttgttgcacccataaaaagcagattcctcatgtctttggggacacaagatagccaactcctaaacatatgacaaatattgcgaggaggttttaaattagaagccaaatgaactacagaccacaccaagcgagataagcaacactgaaagaacaaatgttggatggtttcatccttgtgacaaaaacaacatgtcttgctacctttacaatttctcttagcatggttgtccttggtgagaaatacgcctcgacgcaactaccaaatgaagattttaacttttaggggcactttctccttccaaatccgtctattgataatcggaaatgtgtaggatcatggcatagcaatttgattagcagaagcatgtgtagtgcggagtgggcagatcaacagctaggagttgagtgtctactcatacatgtgtaggtggactagattagccatgcatgtaggtgattagcagccatgcatggtgattagccaacaggggcggatctatcatggggggcgcagggtctcaatccttcactactggcgtaaggaccatgggtgccgccatgaagccccctctaaatttttgtgctataagtagatgggatgggggatgtagctttgtctagcttcttcagaccatcctgttatttcttcatagatccgccactgttagccaagtattaggatatgcacgtttggagcaagaagcggtccaggtagtacgcatgcatgcagagttagttagctttggattcatgtgtgtggttgcatgcattagcaatgtgctcctgcttatggcgtccacggctgtatcgtgtgagcgagagtagttgggttgttggccaaaaggctcggggcccaacggcctggcccacaacacggcgttttggtccggcccaagcatggcatggctcgactgctgtcgggccatgctggcccagcccgattggtgttgggccatgcttgggcctctgcctcgacatggtgggctagcccgacctagcacagtccaatgaccaaggaggcaaaataaacttatttcagccatataaggcatggaccaaagagatgaggcacgtaaaatagacttattccagccatataggacacgacccaaagaaatgaaggaggcaaatagacttattccaaggaggagcacggtgggctttcgtgccttcagggcggtctggcacggcccgagtcttattgggccgtgcctgggccgttggtgcagcccgtgggtgggcccgacccggcccgatgtaggtcgggccatgtcggtccgactgattcagacagaataaattgaacagaaactcaaagaaatctaaccaaaaacatatgcgaggctgcaccaagaaagctaccagaacagagattaactaagttgaaacttcacgcgcccaaatcaagaacagatagacaccccaaaaaatcatgtgatggtcattccctataccaaaatcttcagaatttctgtttgttacagggggtaacatgagtcacatctctggaccaaaaaataatcacaatgataaactacaagagtcacaagaatgaactaatgcaacactaggagctaacaaactcggtggggtcaccgtgtattagacatctgacggttctgggatgtggatcagagatcggacggtggatcagttgccacgacggatcacgtcgattgcttaggttcttgaaaccaatcttagtgttagtagcttcttggagattccgttatgttctttggatagagtttgtactttgggttggctgactttttgatggagctatgtgaatatttgtgcaatgacaggcaccaatttttgtcagttcttgtgattcctacaatatctgaatattgtaaatatctgaataaatgtggaatgatagtcatccatttctgtcagttcttgtgattcctacgaatctgaatattctcaatgtctaaataaatgtagaatgacaatcatgcaattttatcagttgttgtgattcctgtgatatctgaatactccgaatatctgaatgttgttactgttatgatgatcagtgcttgtttccaaaaacctgaatgtttgtgttagttcctgaaggaaattgttgggattggtgtttgtcagtcagtcactgttctggtgcttgatagatttggtgatgaattttcagttctttcgacattttactactgtactaataattcagatgtaatctttagtttaaggttgtcttgaatgtgttgagctccttcaatgtacttgatcttgtgagcacttcttagattcttatgccatgttttgtctgattcacagttaaatcttcaaattgctactctctgatgttccctgctgtttagttagagcttcagaagtagggcagtaactatgattcaggtttagtattacctagtagtcggtgttattttaatgtagatctttttgttgagttgatttgagtacatgctattgccaattttaattttgtaagttgttagtatgctttgatattgccaacagtgaagaatgtggttttgtaggacataagaaataagtcccatatccaagttcgtccctcaattgcaaaaccatgcaaactccattcttcagatctcaaaatcaggcaacaccatccctgtttgattgtaattttgacaccactgtcaaacaaagtggaggtctgggttttgtttggttttgagagcaaggaacagatttatccaattttgcacttgacacaaaaatgaaactgagtaagagctcaggtatgggtaagtatctttattcaggagatctctttattcaatggcataacaatacatagcatgatagcagtactccttacaaacaagggtggatccacagctccttgtgtaattgtttgaaactatacttccattctgttgtctacagcatacatgccaagtacatcatctctctggagtagtcatacacactgtccctatctctatctttactgatttcaagtacatgatacaattcacaccggtacatcatagactttctttaccaatctataaccggaattcagaaagagtagtcttgaacttgccatctagcccaacggagtagtaacgcgcggtgtaatctctgacgagtgcctccctgtacaaaggcgggttctcatcagacaacagctccttgatcgggccatacatcctcgtggaaatcggatgaaaatgggtgctgaagaaacaggcaatcgagactctcggttcagtgttcttcgccaccactctatgctccacactcttgtaattgtcattggagatcaactgaacatatgatcaaatggaaagaataagctccgaacaatcaagaacatgtttctagactattttctgaattcaagtttggttggtcttgactctgagcatggtacctgcaggagatcggcaacattgacgatgaacgctccaggagttggcgtgacatcgacccatcggtcctcatggaggatctggaggcccccaatgtcatcctggagaagtatggtgaggaagccggagtccgaatgccggcttgtcccgatggcgagctcaggctgggggcagggagggtagtagtggcatagtatgatttgcccctggttgcattctatgtctgtcaggtagctcggtttgagcccaaggccctccgagagcagctcgaacagtgtgttccccaaattctttacttgtttggcatattcaaacagtgcatccctgcatattaatgcaagctacatatgttacccttaaacaccaaaagagacctgatggtacgactaagtctcagcaatccaatttatagtctagaaacactatatgctaaaaaaaagggggcatctataagtacaggtaaaattctgatttcgtcaaagcagtgccccttttactgacagtacaggataaacacagggctcacttttttagataatataaaggaggtcccactctgagtaatttcattgtacaattagtttttttttgataaccatgtgatgtgagtttgaataaaaaaggctactaattatattgatatcctggaaactattcttgtatcttatttttggggcaccggacatgaaagtatgtgacccagcaatcatcttttccttctctgccctactactacgcagcttaatttgtcatttcggatactattcgaaaatttccagattcaagatgcatgatcctttcacacaaaaaagcacagcaacaacaacaacaaaaaggctgtactagttgttcttcccaataacaacaataagcttaactgggattgttaaattagtcagcaaatgactcagatcttggatctaatcaagctgatctcactacagatttcactaatgagcttaattaactcgtacaaaggccatcatattctaaagatttaccagcaatatcctaattgaagtgtgatacttgcaagatctaacagtattctagggaagaagtatacagtgaggctgtgagaggaagcggcttattaccggcagatctccggcaagtcggcggcgggcggcgggtcgggcgccatgcggaggtagagcgtgtcgcgccagttggccaccggcgactggtacaggtcgaagttgcagtggtacttgacggctctcccgggctcgcgcgagtagagccgcgccttgtcgctgccctcgccgcctccggactcgtggaacgcgcgcgccgcgcccgccgcggcgtccatcgcggcgaggggaaccccgtgccccgtcacctggaagaacccccactccgccgccgcccgccggacggcgtcgaccacggccgcgcggctcccgctgatgtcgatcaccgggacggtcgtcgtggtcgtggccgcggacgatggcgccgtcgcctccggtggttcttgatcaccatggacgacgttgtggaagatgcgggggaggtgggtggcgcccgacgcgacgaggccgcggacgccggagagggtggcgtcgagcgcgcggagctcggcggtgcggtcgtaggcggcagcggcggcggcgggggcggggtcggaggccggcatggtggctgcgcggtggattgccggtgcttggtgtatatatcggcgcaaagcgaagcgattgagcgaagcgtggcgagacgcgcgtgctcggtgctcctacggcgcgcgttttttttttctctttattctttttgagagggagtgcttctaccggcgcttgatgagtttgaccgtattaaacaccattactacgatgatatgagcatctcacgtatacccatcttatttctaagtacctcacactatgttttatattaaaaaaatagccgtaaataccagaacgagcgttaactttagaatttaaatttcagtggacaaaatttaccacagaaaaactaatcaattaataagtttcgctcacttctaatgaattaaatttgaatatatattatttattttttaagaaatatccgggatataatttttgttggtacaaatataccgccgtcgctgtatgggagtgtgaaatcaacacgatatcgctgaagcgttacacgaaaatgacgataacatgacggcgcgggcggtctggcaggaccaaacaacgacaccgcttggaaatgattaattatatcgattaattactaataatgctaagtaaagaaataacaataattaattaatttctaatgaagctaattactctattaatcgcgctagttcagatgcgaagacgcgtctcgcgcactcgtcatgcgaggtagatctgtctcgcgccctcgctctgtgagactctggcgagtgcatctcgtggcactgtcctgcgacaatggtatacgtctgcaaatttcttataaacgtgtatacttttgtaaaaccagtaaaaaaaatgttttcatatttttcccgcttctgactccctctgtttactcactccataaataagagtaaaaatttgttctaaaagattcttggtggtagagtgatctactagtcctgaatgaatataatctcttctcatcgttacgtattaataaacgataagtagtttttaatcattttcaaaatatatttagattagctaaaacacttatagttatttagagatggatgaagtaactttcgaagaatggctgctgccggtcgaaaaaaaatcggccggtcctttctatccagacgtctctctcaactctacgcattctgcacatgtactgattag

SEQ ID NO: 74637 - DNA, 7038 bp, Oryza sativa
gtcggacacgactcttatctctaacaaactcgaagataccataagtctttgcggcagacttttgcccaaacatatctctaagaaaatacataaaacatcctaattaatagatacaattgccttctcatgactctatccatgcgtggcaatcctcatgaagctcattaactcaatccgacaacgtattccttgtcatattgtcggactcggctcaatcggctaaccctgtccaactcggactctgccgatccaggtcgtagccgattcggactccagccgatctttactccgtttccgagacgatctccatctcgaactccatctcgatttattcatctccgatccttggattaccaaatttggtcgttaacaatatggaagtgagtaaatacattaacttatatagaaaatattctaccttaattacctttataagcatcctcttaatttaatactaaagtcaacttatacataaataggtaagaagcttatgacatgtgtaaggtaaattgtagttctaacatatcaacatcacttcacgataatgagagtccaaatataacttttataaacatttacatgcatttaggaaagggaaacacatataagacataagtcttgcgaattatctgaaataattcgtgcaagataaaatcgtgggaaaattcatgtaggctctacttaacatatacaactcactgtaattttggtataatttaataactacatttgatactcgaataaatcaatcaaaccagtcaaataatagattaattataattcctaatcggctaaaaccatactttgtctaaaagtgcatttaattgcatggaagtgtataggggaaataatttattcaaatactaggttaattatcatgaataaatatatttttttccagaatttatcttctcattttaggcctcctaaaaattcaaactaatttctaaagagcccatcttctaatttctgtgagtaatctatccataatttttgagtgcaaccaaagaaaatggaatctagatatcttcatgtaccttcattaaaatccacatgaattgatctgcaccacaaattaatctatgaattaacaaagatgggaaaagaaataatcctggaaaaatcattcaaaatcgagttcacccagtttcttacccatccctctcacactcctacctagcttacatcgacctgggcccacttggcagcctccttgggtcgccccctctctgtccttcaccccagccgaccagcgtgagagagagggagagatcggcgccgaccgcgctctgggcactcatcaaattataaactttaaagttatgaaataaaaacttgcactcacaatacaaatttagcctctaaaattcatctaagataaatcatacataaaacatatacaaatttataaaatgcatacaaaattcatttcaactcattttagagcaaacttagtttctacagatccattaacatgttctctaaaaacaaagtgaaataaaacatatacacactttacatcaaagcctctaaaactattatctttaaaataactaattttacataagctgaactttagaagtttatataaaattcatcttagatcctctttaagtaaacccaagttctgtagaatcaccaaaacatgtacttccaagttataaaataaaattatatacttactatgtaataaaagcctctaaatatttttgtaagtaataaccaacatagagcagcctttaaatttgtaaaatttgtagaaaatttatctttagtccaaatggagtgaactaagtttctatagaataaaatatggcaccttttgtacaggttatagttctaaactttaaatttatatgataagtgctaaacacaaagtgttgattaagcaatacatatgtatgtatatgtatatagttgcactctagctctaaataaaacccaactaaaacttgttagaccagagaagttatagtttcatcctcatccaccaaaactctcatataataatctctaagtcggtatgataagtaattaacatagaacattcccaagcatataaaataatgaagtagagtaatatgatctataaaatttatgaactaagattagattagcttactaaaatactcatcttatacaacactagcaggttagagcaagttctggacctaaatttccaaagccatgtacacatagagactatatgcctagaacacgttataacttgtaaaatacataaataattcatattaactctaaaaattatgaaaccaaatgtgttagtcttataaaacacatatattcaccccagaaaacataaacttaataataatcaccttacaacagcatttcacaatagtacctaagtaaatcctacactataccgacgaaacttctaaaactcataactctctaatgaaatgagataaaatagaaattctttcacctaaattcattttagaccagtacctatccactgtgtacaaatcattcattttagtgcattttggatttttcgcatatttcggtgtttaactgcataacgtgtactttctatagatgattgcttaaacggtgaagaactgatttaggtgctgaatttttccagttacaaggcaggtcccacctccctctctttgatcactttgaacctatgttttggaggttattgaaaatgtttgcaaatcttgcatgtcgattgtacactaataaattaaaattttgttaaacttgttagacaaactcctattatttgcattattaccttaacctcacatatatccatatccctcattcctaaccttaggaatcatatcctaatactacttggaatatgagttacattgtcactagtttactatattgcttagctatgcttagaatagttttacttatcacttgggctcatattaacatgaaaaatgattttattaagattctagacagagatgaataaatgaagtatttgacaaataaaatgatggacaacatggattttaggtttgggcctcatgtgatacacatatggtgattagttgtgtaccgatagggggagtgtgcacccaaaccgacctaaggacttcactcaatgtcagttcatttcgtatacagtacaaccacatgtgctagtatgggatagccaaagcttagtaaattatttatggtttagccttatattctggtaggctggtgtgtatgagttcgtataattcagaggagcttcctatttaccccgatatggtagtttaggtgactaagcgtgtccaatacaatggtattgtgcccgttgtgtccgttgtgtccgccaccacgctgttaagtttaaggcatgggcctaccacttaacgttctaggttatatttccagtatgcttaggatggaggaacacgtatcgcgctggtgtaaggctaaatcatgaattttggaaaagctttgctgcgggtaataaatcgggtacttatgtatcacgtgccatgctcttgcatgattattatttcgcatcatgtgggtcatgagcggcgtgtggatatttattgagtatagacttatgtttacacttctaaatgctgaaatttaccttcaaattatgtaattatgttgagatttgagaatgatctcattgctggcatggatgacaatgaggtgcatatttatacatgattaatgcctactttgatgcccatatgctaagtactagcttgctgaaattttatttgaaaacaaatctgattttaaagtgttttatgcaaaataaaacttgctttatgctaaaaagaaccatattatgccttccttgattatatgccttgcaagtagctagggtgttaggcttgtcttggtgcttgctagtatattatttggtgttaggcttgtcttggtgcttgctagtacattatttctaataatgtactgactcttgctattagattaactatttgcttgcaggttgtagacttagtcttttgagtgatgcgggtaattgactgcttcttctaggacttgaacttaatgggggtaaacccctagtcggtgtgcttgtggtttgggtagacaagcttccgcggttctattatctatattcggctggtcggcctatgtaactatgaagtagttgtaagttagatcatttttgtcttaagtgtattttgctatgtatttccatgcttaagatgaaagtgtgaatctagtgcacatcctgggaactagattcatatgtgtatgagttaagaatatttgagatgttgtagatctttagctatttttgtgtcacgccctgaagttctctccctagctaaaattcaattaataaattgttgcaagaaattatttgtttaaaggcaagagggaaaccctaaattaataaatgcaaataataatcggaatcggcatgtggaatttttcttgaattctacatgtcaaaatatgctaataggatttttagtggaattttcaaagcctcggagataattaaaatcaattaaaaatgagcacaagcattaaagaatccctagaaattctttttttccttttcctttcttttcccccttttgggccgccggcctgctcctcccttccctccccgaagtccttcctccctccctctctctcgggcgccgataggtgggccccacctgtcgggccttcctccttcctcccgcgccccactccgcgccccgtgcccaagtcgccacccacgtcctcgccttcccgcccgcgcacgcacgcccacaaggggcggattcaattttgaagccccctcccactctctctctctctctctctctctctccacctcacacgtcgccggtgaaatcgggagctttcccggccacgtccgcccctcccttgcccataaaaagcctccccgcgtcctcctctccatttttccactttccgcctccctctcccgtgctctctatcacgccggtgccatcacacccaccgccgccgccctttagccacctccggtcgccgctcgccaccgccgagccacgccgttgtcgtcttcgggttcgcacgtccgagggctacctcatccacccctcctctatcgaagtccgccatcggaggccgccgttcgctgcacgccggtgagcccttccttagccactgcagtcagccatggctctcgatcgccgcggacctctaatccccctctaacctctctcttttcctctcttagggtgtccaagagctcggccaccgctcgccgttgccgtccatcgtcgcccccgccccccccccccctacgccggccgaacccctgtgaggcctcccgccccctcatttcccctttcactcccctctagtgccggtccgcgctgccgccttcgtgctggccgccgccgtctcccgcgccgccagtccccgtcgtgaccgcgcgcgccgccgccgctcgccatggccaggcagctggcttgaagccgagccgagcccggccggtgccaccccctcccactagccactgcctggtgggacccacttgccaggtaccacctcctccccttgtgccactgtcatgcggggcccgcatgccggcgcccctcccctctctcttgagccactgatgtgcggggcccacatgtcggcgccccccctgctgacgttagctagggatgctttatggcacaataaataattaagggcttttcttttatagtaaaaacacagattatcttctaaaattcataactaattcatccgagcttcgtttaagtcaattcaagtctccgtaaattcataaaaatccctagaatcctttaaaaatggttttgtttcttgtttcagtagtcttatagcttgttttgcttgtgtactttgtttgtcgcgtagatttcggccgtttcgtcgatccgcggtttctcgaagacgttgctgtggtcccatcagcgcgagagcatggcaagtcatgcattacaattgatcatagtgtacccaatttacaaatgtcccgcatttctattaaatgttgcattcttttacaatatcatgtgggatgggtcctattatatattgtttcccttacgccattgataacttgggtattaaaatgcatagatgttggattaggaattgcttagccatgcttagttcaactagtacacaaaggggatcacattaatgcatagactttgattatgggtaattagtgccaccgcaatggtgttagttaattaaaatatactacatggtgggctgtgggtgcatggttttgctagtcgtgcccatggcgattaaggaccggttcacgagatgccctgaaagaacttatcgtacttaccataagccagcgtgggcaacggctgggcttgtagtgtagctttcctctggccgatgtacccaggcaagggtgggcgtgatggagttgggtcggctggggtgttcggttgatcggcttccggattcaccatggcacgagaggggactgcccgctgccttgcgaggagtaagggtgaaacttgaggtgtggtgcgattggttagagggggttatgcgaagggtcctgtcatggcctctttccggtatgtcgtggtggcatgtcggcgcacgggaacatgtcgtggggctgtgtcttgtgggtacagttgtacacctctgatcagagtaaaactattcgaatagccgtgcccacggttatgagcggtccactagattcaccgtgattagtctcacccctagttagcttatggaactggttagttcaggtagtggtttgggcctgtctccacatggtgtagcgtggagcagtgatcggtttatattgattaattactacaactattttactgctttcaactactgcttttaaatgactgctttattgcaaatgaacctttagcctcctttggatatatcctgcatcataccttcccttctggtatgtcttgctaagtatagtgggtagtactcagtcttgctctctttcacaccagagttgaagttcttctcagttggagctgtttcgaggaagttggttccgtcgctgccgtcaaggatgcctgtggaatggagtcgctcgctgctggagtcaagtct

SEQ ID NO: 74638 - DNA, 1076 bp, Oryza sativa
taaaccaacatctaatcattttgatacccaagttatcaatggcataaggtaaacaatatatggctgagtagtaggacccatcccacatgatattgtaaaacaatgcaacatttaatagaaatgcgggacatttgtaaattgggtacaatatgatcaattgtgatgcatgacttgccttgctctcgcactgatgaaaccacagcaacgtcttcgagaaaccgcggatcgacgaaacggccgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattcactgtgtttttactataaacagataaatccttaattgatttattgcgcaatatctcatcccagggctgacgtcatcaacgagggggcggcaccgacatgccggacccacgggtcagcggcttaagggggaggtccgcggtggaccgggtccacggaccgggaaggagacggcgcaccacgtggtgcacacgtcgcgccgacgtggcgcacacgtggcggccacgtggcagccacgcgggcggcgggtcgggtagatcggacggcgggggcggctcacggccggccgcacgggctcggctcaagccggcccgacgccatggcgcgcggcggcgcggctcgacgcagcggcggcgaccgggggcgaccggccgacggcggagggcggcggcgtcgcggcaacgcggacggcgctagcggcggctaagcagctaggtggcggcgcaaggctaagcggcgcgggagagagaggaagggaggaggggccccaccgacgacgattgacgacggcgagcgacggagggcgacggcgatggcaggacgagctccgagaccacctagcgaacacgaagaaaggggttagagagagagaggaagatggaagagggcgaggaagccgacctaatgctgcagctatggcggtgctcaccggcgcacggtgcggaatgggttcc

SEQ ID NO: 74639 - DNA, 16090 bp, Oryza sativa
tgggccttggccttcggccggcccagcggggaggggcaggggggagagaatgggccggcggcccattcgaaaagaaagggagggaaaaagaaaaagaaaaagaaagaaatgaatttccagggattaaataatgcttgtgctcaattttaattggttaaaattatttctagagctctgaaaattccactaaaaatcttgttagcatattttgacatgtagaactcaagaaaaattccacatgccatttctgattattatttgcattaattcaattagggtttctctctcttttacacaggtaatttctcgagaccatttattaattactttaggcttgggagaagaacttcagggtgtgaaaaacctacccccccccttaaatggaatctcgaccccgagattcggaagagctggcgaagaggtgcggatgggcggccttcaactcatcttccctttcccatattgcttcttcctcggagtggtggctccattgaaccctgcagaacctggtaaccttgtttctggttcttctttcactggtctcaaggatgcggactggcttctccacataagtcagatcttcttgaatgtcgatgtgctccgaattggcttgttcttctggtactcttaagcacttctttaactgagacacatcgaacacatcatggataccagccatgttggacgggagttctagctgatacgcgacttctcctcttcgttccaagattttgtatggtcccacaaagcgtggtgccaacttgcccttcgtctggaaacggtgtactccccggagcggagtaacacgaaggtacacataatcccctgcttcaaaagtgagctcccttcggcggttatcggtgtaactcttctgccgagactgagcgatcctcaatctttccctgacagttcagactttctcctctgcttccgttaacacatctgttccgaacagttgacgttcgcccgtttgatcccagaagagaggtgtgcggcacttccgaccatacaatgcttcaaacggtgccatttgcaaactggcctggtagctattgttgtaagagaattcagcataaggcaggcttttatcccaagctccgccaaaatcgagtgcacaggctcgcagcatatcctccaatatttggttgactcgcttggtctgaccatcagtttgcgggtgataagctgtgctgaaattcaaacgggttcccaattcttcttgtagtctctgccagaactttgaagtgaactgactccctcgatccgatacgatcttcttgggtaccccatgcaaacacatgatccttgagaggtaaagctctgctaatcttttgtccgtatatgtggtatgcactcgaatgaaatgagcgacctttgtgagacggtccacagctacccagattgagtcatgtcccgatgatgttctgggtaaaccagtgaagaaatccatcccaatttcctcccatttccattccggaatctgaagaggttgaagcaaacctgcgggcctctggtgttctgccttgacccgctgacaaacatcgcagagtgcgacgaattcagctatttccctcctcatgctggcccaccaaaatttttccttgagatcttggtacatattggtactgcccggatgaatggagtactgagtctgatgagcctcggtgagtatcagatctttcagctctttgtcatcaggtacgcatacgcacaatctttctcccagccagattgtgccatgttcatcttccaggaaatcccgggcttttctgaccctcatattctttttcagttcagctatttcaggatcatttatttgagctgctctgacttgatccataagcgtaggccgcgcctctagagcggccacaaacccgtgttctacgattcccaagttgagatgttcaagctcctgctgcaattccttacacatgccttcggtgcccaaagcattgcagtagctcttcctgcttaatgcatctgccaccacattggctttgcccggatggtagtgaatgctcatgtcataatctataattaattccagccatcttcgttgtcggaggttcaagtcaggctgagtgaagatatacttcagactcttgtgatcagtgtagacttcacagcagttgccaataagatagtgccgccacattttcaaagcgtgaaccactgctactaactcaagatcatgagtaggataattggtctcgtgtggacgcaactgccgcgaagcatatgcgaccactctgccttcttgcatcaaaacacatcctagcccttggcgagatgcatcacagtagacctggaagtctttcatctgatccggcagaattagaactggtgcagatactaacttcttcttaagttcttcaaaactttggttgcactcaactgaccacttaaaattttcatctttcttcagcaactgagtcatgggtctggcaatcttagagaaattttcgatgaaccgacggtaataacccgcaagtccaagaaaactccggatctgaaaaattgtctttggtggggtccacttagtaactgactccacattcgacggatccactgccacaccttgagcagtaatgacgtgacccagaaacttgacttccgacaaccagaagttacacttactgaactttgcatataactggtgctccttcaatttctcgagtaccagacggaggtgctgctcatgttcctcttcagactttgaatagataagtatgtcgtcaatgaacaccacgacaaacttgtccaaaaactccataaacactttgttcatcaagttcatgaagaaagctggtgcattggtgagtccaaaagacatgactgtgcactcaaacaacccataccgagtagtgaaggctgtcttgggaatatcctcttcccgaattctcaactggtgatagcctgatcgtaggtctatcttagaaaacactttggcaccctttaactggtcaaacaggtcatcaatccttggcaaaggatatttgttcttgataatgacctcattgagtgcgcgataattgacacacatcctcttggtcttatctttcttctccacaaagataatcggggcaccccaaggtgaagtactcagtcggatgtatcctttccgcagctgttcatcaacttgctctttgacttctgctagctcgttagctgccatcctataaggcctcttgtagatcggagcagttcccggtgccaaatcaatccagaactcgatttctctcttcggtggcattgtagtgaggtcttcaggaaacacctcaggatactcttgtactatagggatatcctctaactccttaggacttttctccactatttctgtctgttccttaatagcagcctgattcagacttgctacggacttctgcgacactggagaacggaaggtgatcttctcccctttgtcgttggttagggtgatggtgcgactcgcgcagtcgatcactcccttgtgtctggtcaaccaatccattccgagaatgacatctaggtctttggattcaagaaggataaggttggatagaaacggtgaccttttgatctctatagtcatcgaggggcagtagtgtgcggtgttcatgtcatttccaggggtatgaacccgcattggtattttaagttccactaccgacaatccatgtgtcccagcaaacttcttggaaatgaaagaatgcgttgcacccgaatcaaaaagaactgttgccggatatgagttcactagaaacgtgcccagcacgacctctggtgctgcttgtgcctcctctgcagacgcatgattgatgcgggcctggacgaacttgggtccagcacgctttagcttcggacacttgctagcaaagtggccgtgcttgccatagttgaagcagggtcctggctttcctgcagactccttcttgagctgttctgactgggctgacatagctggtagttctgactcagctggtgccattaatgggggtggagttgagttgtggtggtgctgctcactactgttgtgactgccaccgttgtagtcgttgttgaagttacccgagtggtagggacggtgctgacggacgatcagggtggaaggctcacccagctgtcccgtcatgaagcgaggcttctgactgttcccctgaggagtcctgaactgagctgcctttcttttacggtccattttgttgcgttgctcttcctgatggatagccttgtccacaagcttcttgaagtcctcgtaaactcctgagatcagctggttggtcaattcatcatccagaccaaacaaaaacttctcctgcctcttggcatcggtgcgcacgtcctcaggagcgtagcgcacaaggcggttgaactcatgcaggtattctgtaactgttctggttccttgttgcagtgcacggaactctcttcttttgtgccatgatcccctcgggaatctgtgccttcctgaagctttgacaaaactctgcccaagtaacctccgttgcatctagacgggttaccacgtagttgtcccaccaggcagaagcgggaccttgcaactggtgtgtagcaaaagcaaccttctcttggtcgttgcattgcagaaggttcagtttcttctcaatagcatggagccagtcgttggcctccattaggttggtggtgcttgagaaagtaagtggcttgatatagaggaagtctaacagcttggacaaatgtaatggtggaggaccagactgctggttctgctgcgcctgctgcaacatctcatggtaatgttgctgcatctgttgcatcatcattgtcatcatctgaatgaccattgggttctcgggcggtggagatggaatgttgctagatgcaccactggtatgtgctccattgatctgctcttcgctgccactggcgccgttggagtcacggggatcattccttgtcttcaccatctggaggaggataggtagaaataagagaaaggaagaaaacagacggcttagaaactaatctttcttatatatttatgtgcaattatcttaatcttgattaaaacacttaaaaggaagcaaacaactcctaattaaggcagccataccactaacacatgatatcgaccgccggctaacccacaagcagcaaacctaaacacagaaactagcaagcaacagactaagaagacgataaagctaagggcggtgactctgaagctcggagcggcgcttgcgatcgaggaataggtctgacatctaaagaggacagagggataggaaccaatacatgctcaaatccaaattaaacaaagcaacgaatgactcaagcaactagccaaacatgatgatttttatgcatggaacatttttcatgaacccaaacaaaagatactaatgcaaccgactaaacaataaattaatgcacgaaatagatgcatagctataatgatacgcataaaatctccccattgaacctagacacgacttagtgcatatcacctaataaattcccgactcactgtcaaataaattccgaataaaattttactagaccctagactgcctctagccgagaaatccgattaaatagcgatcaagatttttcccacaaatcaaaagaacaaaccccaaaattttcccgaaactaatccaagtgcaaagggcatgtgcagatgaaaaggtttcagagggctcttagggtttccaattggcatgtcttacggtcaaggtcggctctgataccaacttctcacgcccagaaattcacgaaccagaatttctaagctaaatgtgcattaaacccctgtccaagaccagccagagtacacaaatgacaattgttgacatatagatccacgtcttacaaaaatataaaagattacaaatgcaatggaaaaggaaaaagcgagctaagcctgaagacttgactcttgcagcgggcgactccattccacaggcatccctgacagtagcgacgaaaccaacctttctgagacagctccagctgagaagaactttagctctggagtaggggaaaagagagcaagactgagtactacccattgtgaatctggtcgaccgcccataaccgcgggcacggctattcgaatagttttactctgatcagaggtgtacaactgtacccacaagacacagccccacgacacgttcccgtgcgccgacatgccaccacgacataccgaaaagaggccgtgacaggacctttcgcataaccccctctaaccaatcgcaccacacctcaggtttcaccctcactcctcgcaaggcagcgggcagtcccctctcgtgccacggtgaatccggaagccgatcaaccggacaccccggccgacccaactccatcacgcccacccttgcctgggtacgtcggctagaggaaagctacactacaagcccagccgttgcccacactggcttgtggtaagaacgataaattcttccagggcatcccgcgaaccggtccttaatcgccatgggcacgactagcaaaaccatgcacccacagcccaccatgtagtgtattttaataaactaacaccattgcggtggcactaatccaaaactatgccaataatcaaagtctatgcattaatgtgattccccttttgtgtactagttgaactaagcatagctaaacatttcttaaaccaacatctaatcatattgatacccaagttatcaattgcataaggtaaacaatatatggctgagtagtaggacccatcccacatgatattgtaaaacaatgcaacatttaatagaaatgcgggacatttgtaaattgggtacaatatgatcaattgtgatgcatgacttgccttgctctcgcactgatgaaaccacagcaacgtcttcgagaaaccgcagatcgacgaaacggccgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattcactgtgtttttactataaacagataaatccttaattgatttattgcgcaatatcttatcccagggctgacgtcatcaaggagggggcggcgccgacatgcccgacccacgggtcagcggctcaagggggaggtccacggtggaccggttccacggaccgggaaggagacggcgcaccacgtggtgcacacgtggcgccgacgtgccgcacacgtggcggcactggcagccacgcgggcggcgggattggacggccccgatctacctacgggcccggctcaagccggcccgacgcccatggcgcgcggcggcgcggctcgacgcagcggcggcgaccggccgacggcggagggcggcagcgtcgcggcgacgcggacggcgctagcggcggctaagcggctaggcggcggcgcaaggctaagcggcacgggagagagaggaaggggaggaggggcctcaccgacgacgattgacgacggcgagcgacggagggcgacggcgacggcgggacgagctccgggaccacctagcgaacacaaagaaaggggttagagagagagaggaagatggaagagggtgaggaagccgaccgaaagcggcggccatggcggtgctcaccggcgcacggtgcggagtgggttccgacggcggaatccgacgggagaggggtggacggggtggcccgctcgacggcgaacgcggcggcgtcgacggcacggctcggcacggcggctagcggcgactggagcggtggcggcggcggtggagaggagggcgacggcactaggacggtggagggcacgagggcgagtggttgcaaaacaaaaaagagagtggcggagacgggggtgctttatatagacccgcgggggtcaatcgtggccgggatggccgcgatttcgccggccgacgtggggaggtgggagaggagagagagaggcgggattcgaaaatcgaatcccggccgtctcgagagcgggagcggcgggatagtggggcggcggttgcgggacgcgcgggatgcatgcggggtgagggcgacgtgggcgcgggcacgcggggaagagcgcgagcggcggttgcgggcacggcggctccggccggaggtgggagacgggcccgacaggtgggccccacctgtcggcgacccgaagggaggagggaggaggcggccggctgctgggccttggccttcggccggcccagcgggaagggggagggggaagagaatgggccggcggcccattcgaaaagaaaaggagggaaaaagaaaaagaaaacgaaagaaatgaatttccagggattaaataatgcttgtgctcaattttaattggttaaaattatttctagagctctaaaaattccactaaaaatcttgttagcatattttgacatgtagaactcaagaaaatttccacatgtcattttttattattatttgcattaattcaattagggtttctctctcttttacacaggtaatttctcgagaccatttattaattactttaggcttgggagaagaacttcagggtgtgacagcaaacacccgatcagcgaaaacgctaggggggcaaaacgaatcggccgaagcatcgctcgccgaacgttgaaaccgcgacagcttgtttcgaaaaaaaccaaccgaacaccgttatactcaatccatgtgaaaacgtaactgctctcagcacgaaatgtcacggattgaaagcggaagttgaaagctaaaaagtcagcatacctatttcgctaatatacgcaaaggggccgacatgtttcgacctaacgaaagcacgaaaggtgccaatgcgaaaaatagcgaaaaggaaataaaacacacgtttattaacttcggaaaaatgattgaagaatactgccatacaacatggtacaagcaaagaaagcaatggcttcacggcctacctcacaaataaattacatcttcgcccccaaagcaatccccactcccaaagaaatggttcggcgaacatggttcgtcgtcactactaatgtcatacactaccctaaggggggaagggggcgaaacacaaactagactattttcacgcccgaaaattcactagtaattttcgaacttatttgtgcataaaatcctcgtccaggaatcagccaaggtacacaaactgacaatttaatatacaaattcatcaaattaactagaacgataaatacttacttaagaggcacttagtcctcaccaagaagtaaactgcagcggaaaataaaatctaacgaagctccggctccactcccacaggcagctcaactggggtataagccaaacgtcttctccttcgcaacttgtcttcaactgaggttgattaattattgcaaggtgagcatatgacatactcagcaagccacacagcaaatatgcaagtgcacaaggataccaaaggatggcataatataggctcatttgcaaaagcagcacttagcaaaacatttaagagatgtaaaacagtggagtaattaatcagaaattttaatcaacactgaacaacacacccatactgcacaggcccaaccattctgaacaaccatacccggctgtacagatctaactccaaaccaggagctaagcaaattattaccaggtataacatccataattattgtgagaggtgtgagactaatcatgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcaccccctcaaaaaccagaggcatggactccccagcgacccccgtgggcttatctccgccacttctcagtctggtgctctgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgaatcataagttatcccaataatgtgctaatgtttctaagcatggctaagcaatcatatctaatatctagctgaaccaatatatatagcccaactagtcaagttataataacccaaggtatcaaggaataaagtaatcaatgcaaattggccataacaaaggaataggttcacaccacccagtgacattcgaaaataaatgcacagttgaaataaatagagaatttaaatataggatcaatatgctcaaaggattgtgtttaggatctgtgtgacttgccttgcaataatcggtcttcaattaatcttcttgaatacttccggcgcactcgcgaaccttcgcaacgacagaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatatatttaaagcccatttaaaaagaattaaataaatttaattcaatttatggacaattttaatatgtagatctttattttacacaatttttgcaacttgaaccacattaaactgagttacaatgaattagttatgaatttttaaagattacatcgattaaaacacttatatggattttaattgaattatgacgcaataatgaattatttttgaaaaggaaaaggaggattattgcgtcagcggctagggttttcggtggaccgggtgcacggcagcggttcacgggaacggacggccgagatcaaccctatccaaaacggacggccgagatcgaacggatccaccgcggctcacgggaacagcgacgatgacgtcagcgatgacatcagcgatgacgtcagcaccggcggcggctcgggagcacaagctcgctggcgaacgacggcgcgacgacgcaaacagagggcaccaacgggtagagggcgacgcggcgaactcaccggtgaccaaaacaacggcggaaaagcaacggacggcgccggcgatgaggaagaagcggcggcaaccttcgggtcgacggtgacggcgatgctccggcggtctccggcggcggcgaaggggcggacgaggacggcggcgacttggcgaccacgatggcgatctccccgaacgacggcgacgacaggagcgacggcggcgcacggctggagcggcggcgacgacggcggcgcgaggcggcacggcgctagggcgctacaagcgacgagaggcgaaggcgagggtggcagcgggtagaggagagctcaggggtccttttaaaggggcaaggaggcggcggcaaaggcccacggtgaccggcgacgacgaaggaaagctagggctcggagagagtagtcgatccgaatcgaactcgaatccacggatttccaaatgaaattaggcgatgattccaaaagagaaaaggaagaggagatcgagaagatcatttcccctctaaagatttcaccggagaaggaaagacgcggccgaatttggaaggagacggcggcggcttacgctagggtttcgggcggcggcggactgggccggactgggccgagggaaagagagagagggttttgggccggctttcggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttttaggcttttaaaatcatttctaataattccttttaaacaacaatttataatttacggatttttaaacaagaaaagctcttaacaattataattagatcattaatgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctaataataatttattaaataatttataaatcctaaaacgaaaatcaggatgtgacaactataacgacgctgggcgattgcttcctgacgatcggatttctgatggtttcgccaaaagcgaaccatatcctcccgacgttcggtatggacactatcgtagtcttccagggttcgcccgggtgcgcccgcatccagctggcaaccttcaaaaccttgtagctgttgccgttgattatcatctcacggtaaactggccgaaacggacaccacaccttcggcaaacccttcaccgctacgaacttttcgtttttacttcgccaataaccaaagagggcccgaatacacagtttccggcgagcaccctgataaaatagcacagcaaaggcaaataggaaaaacgctgagttaagacatgaaaaagtgggcaaaatggaaaaactgtcgtacgcgaaaataatgcgaagataacgcgaaaatgatacaagcgcatatgccgaaggcttcaagcacaacagttggctaaactagggtcattcatttcatatgttaaaaaagccgcttttggctacaactagaaggacagagggccatcgaccaaatatacattgttcgccctccacgacgaacacaaaaataaagccacaaaatctaaaaagcaggcggagggcctcacacctctgggtgatcctcggcatcgcctctgcccccgccggccgtcggctcttcgccttgatccgccgcctccgcctttgccagttgcttgagcaggcacgccttagcagtggagcggccgtccttctgccagaactgcttacgccaagctcgcagagcgggcgaaacgtcctgcggactaatttcccagtcccctttcgcaaagttggggaactcggcgacgtgctcgcagccgaactgctgcagaaggcccaaggcgaaagtcgcggacacgcgcgcacagctgtcgccatacgtagtggcgcagtccgagaccgcaccgccggcctgctgagtccactcggagaagtcgaaggcggaagcaccttcgccagggactccgcgcattctcgcccccatgtcagaaagggcgaggcgaagagtttggctacggtctttgcggactcggtggctttcgccatctccagcgtgaaccgttgcgcttccatcttggcattcgtctccgcttcgacgacctcttggcgaagagcctccatctttggctcggtaaagttgtagtagtcggtcagagcggcggaatgagcctgctcttttttgagctcggccttgaggcgctcaatctccgccttcgcctcactcccctcctccagttcagcccgaagccgcttgttctcggccttcgtctctttgagggcgtgggcgaggccttccatttccaggctcttgcggcccagttcgtcatctttggctcggagacggttcttcaaaccatcaagacgagcccgcatggttcgctcggtcgaacagtgggccgcgaggatctggttcaaaggtaagagagatagagcgaatgttaaagacaaggtgtcgaaaggtggcgatcaaaataaaaaacgacaatcaagctacgtacccgaaccgccaagctcttgacggcagagcagccctcgtcgaactcgttctgctctgtgaacagactcgagctgccagccggagaaacgagtttgctcaccccctcgacaaacgggataagttctgcccgggtttcgaaatcgccaggggcaaaatggggcacggcaagggagtaatccgaaacggatgtttcgaccgccgttttcttctccttcccaggggcgagcggcgaaacaaccggctggcgaacagggctgccgaagaccctagccgcggtcttcgcaacctgatcgattgaggccgaagccccggcgacactcccgccaaccctgcccgcatcgaccttaacgccgggagcggtcgaaagacccaagcttcgacaggcgggcgaagtaggggtctcgtccgaggactcgtcgtcactaaagacgcgaccgacatcgacgagcctcttcccggaggtctttttaattgaaccccccttcgccaccttggccgcagcgatcgcgaccagcgccttcgccccctccacatccttttggcggagaggggagcagttcgactccaccccagtctcgacaggctcggggctcggggttggagtgtagccgggcgtctcggcgcgattatcggcggcttcgccagcggccttttcgcccacagcttccgtctcccccacatccccctcctcctcttcgtcgtcatcttcgatggtctcctcgtcatcggtgtcggagtcgggggcccttcgcttatgaggggtcctttttacctgccagcgcatccgcttgcgcgaaggccctgcatcgtcatcggtcctgtgagggttcgcccggggaggcagttcgccaccataaacccggttcacccggccggccgcctgccgcgtgagcagctggctgaactcagtgaccgacacgtcgccgatcatctttcgggcttcagtgtcggcctgtgcaagagtcaaaactgcgaggacgaaaggtgcaactatatcatgcgtcaaaccgggaaaaagagcgaagcacaaaagtatggttaagcatagactcaccattcgcccccgcaggcatgacgagcttcggcaagccgtcgacctcctcgtcttggtcgatcccgacttgccacgactgggaaagggggaagatgtgaagcatgcataactcctccaccaagtcgcggcagctgaggcgagagcagatccggcatagcagaacgaaccgggcctccatggcgccatcgacgacgaccttgggcttcctgttcggcgagatcgccccgcgtcgccacctgagggcattcgccgcatcagacccagcctcgaaggggatggagtggtagaaccactttgccatccaatggcgatcccacttcgacatggttgcgttcaccggctagagatcggagcgctcggggcgaacattgaagttcacgctcccgaatacagtcttcttcgtcccggccggggtgaccaccgtcttcgagttcacagtggcgaagaataccacgccgaagaggtcggcgctcggttcgaatccggcggtctggcacgcccagtcaaagatggcgatgcggacgagcgccgacgggctcaggtggggaagctctgtcacgcccagaaattcccgaatagaatttcaagcagaatgtgcattaaaatccccgtccaggaccagccggggtacacaaacgacaatgttgacattcaaatccacgtcttacaaacatcataaaagtcttacataaatgcagcggaagaaaggaaagacaacaggagctaagccttgactagaactgcagcgggaacaccactccacaggcatcctcgacagcacggacgaagcctactcctcagagacaccttcttccaacacatactcgtgctctgaggttgggaaaaatagagcaagactgagtactacccactgtactcagcaagtcataccggaatagaggcatgatgcagggaatcatcaaagaagagctagagtggttcatttgcataaagcgagcatttataaacagaagttgaaagattaaacagttataatacttaattaatattaactatccactgtccaatgctatcccatgttgcaacaggcccaaccatccacataaactatcggg

SEQ ID NO: 74640 - DNA, 2044 bp, Oryza sativa
cggggtcgggctcgacatcctgacggcgctcgaggcgtaggaggaggaggaggcgcacaagcccgcggtgttggcgtcgtccttcgccgccacgaccacccaacaccgcatatcagacgctggaaggaggggatagagagagaggagagataggagagctgacatgtgggcctaagggcatttttgatacttcacacgttttctctctcctctccaaccggaaattattgttctaatcagcgcgatgtctattggcaaattaccacgtttatggagtgtctttccccaaaagtgagttcgggcggtatcctacggctaaaaccacgaaatcgcagtgtcctgtagtaaaatttgacttttaagaacgagtataataaggtgatgtaaatgggctgtacaagttgccacatcacatttatgcttatagaggaaaaactaagttagagggcagtagcccgtcgatccgccatccatcaagcatcgaacgctcgctactcgctcagagaaaaatgggtgccgccgatgcactactcgctcgctgtcgttcaccgcaccgctggcttcagctgttgttaagttaagtatgccgcttgtgaagttgatggctgggtagcatttatctgtgtccaagctgtttggccagaggagcaagaagcagagcaggaagccaaggtcctaggggtagggatcgagcaaccccgccgtgatctttagcttggtcggctggaatactagtccgtcctcaccgttgaggagctagacgaggaacaaattgaagaaaaaaaacactcgttttctcttcatttcatggccgcaaatttcttttcttggttaacacattacactctcttgatgtcttctttaacaaatggaaagaaagcgtcatcttcgattggttctactctgccctcgccggaggtgacatcgcgtgccccacgcacggggaacatcgacggccgacgcgctccaccagctcgagaggaactcgaggaggttgagcggcggttccggcggccggagctccctagcgacgtgggttgaacgactgggcgatgcgcttctgggacaaacgacaaaggacgaactgcagtggagcgaatgctgccgtgccgttagatacgggattctggagtcggacctccacgtagccagagtgcagcgaggctcccgcgcgcacgacggcactagggaggacgcggaggcgtgggacggggtcaaggaagagggtggtggcagagggggcttcatcgggaagcacgggttgtggccgtgtggcgacggcagcataggcctcccctccctcacttgtggcagcggcgcggcgcaccaccggctgcactgcagcggctcgtggtggcgtcaacgcgaagatgtgggccgttttttatttgccgtgggccgagcctgtctgctgtgcgtgtttaactccgttggatgctgaacggatggtcgagcgctgccggacgtccctctgacgtagcgagtgcgggcagtctcgcacaaccaaaaaaggacaacgctgggaaaagattaatgattactagtgattaagtatcttaattaattactaataatgctaattaaagaaataataataaataattaattgctaaggacgctaattagcctattaattgcgctagttcggatgcgaagtcatgtctcgcgcactcgtcacgtgaggttgagcggtctcgcgccctcgctctgcgagacagttgcgagtctcgaatctcctggcatcgtcctacgacaacggtataattatgcaaattttttataaacgtgtatattcatgtaaaaccagtaaaaagagatatatttttaaattttttcccacttatgacttcctctgtttactcactctataaataaagtaaaattttgttctaaaaagagattcttggtggtagagtgatctactagtcctgaatgaatataattaatctcttctcatcgtttcttttttctcgttttctgtacgtattaataaacgataagtagtttttattcatttgcataatatatttatattagctaaaac

SEQ ID NO: 74641 - DNA, 2174 bp, Oryza sativa
cttgctggcagcgcgcgtgtcggctagaccgtccgtctgcttgttcttcggaaccccaacttatcttatgtattcattccttttttttacgaggaaagagtgattatattaaaacttaaggaggtttacaatcacgatccagaagctcagacacacaccgaggagctttgaaccgccagactacacactctttcgacctaagagccagctgtgctagcttatgagcaacacaatttcctcctctatgaactttctcaatcttgcactggggaagtagctgtaactttgctttggcctcctttaaaatcgtccacagacgacatctctctgaatccagccccctcatcgcttgaactatattggcacaatcagtttccagtacaatcgggaggttaatccattttagcgctaggtgtataccctccagacaggaataggcttcagcctcctccgcctaactgcagtgcctgatgatcctccaggccgagagcaggacctgactgccatgatctcgaataacaacacccaggctggcttccccggtctgctgaacaaaagctccatccgtattcactttcgcccagtttacctgcggctttgcccaactatttggttgacaaatgatttcagtttgcacccttctaccttcctgcttggatacttagctcttcccgttctggtttccttcatcctcatgtttaatttgctcggagtgtcaaaacagcaaagccccaaagtttgcagtcccaatgttgcaattttctcaacactgggggatttgcaattatgacactgcaaacattaagctttgctataatgacactggacccatatttcatagacacagatgggcccatttatcatccactcggagtgtcaaaacagcgaagccccaaagtttgcagtcccaattttgcaattttctcctcaacggttgcctatcctgtgccaaacaagatgtcgtttcggtggaaccaagctctccataacatgagcaagaaacaagctctaacatcctgagttaagccttgaaggatcaacaaaagccaatcagggcccgtgcgtgccagcaagtattatgctggcagcttccaacaggaacgaagagactccctcagagctctcgccctcatacatgagatgacagcatgaaactcatcctctacttccataccacaaatacgataggtagcatcaacttccaggtttcgggagcatctatttcgtatagtagcaagacccttgttagctagcctccaagcgaaaatcttgatcttatggggcaccggtgttttcgagatggagccccaaatactgcgctcaccatttgcagccgagctggaagaaccaagattagaatcaagcctagcatgcagcaccaacttgtaagcactttgaatagagaagagacctgacttttcataatgccacgcaagaaaatcctgtctgatattgaggcagtttaattttgagaatttctatggcatcaaaaggattgcatattcgccagatcagatccgcatcccaggaacgatcatcttgctttattaactgggaaacccaacgaaggcgacaccttccagcaacaccagctaacataagcgaggattcactcggtatccaccgatcatgccagattcttacttttgtcccatctccaatacgccaaatcagacctttcttcagcaattgaagaccatattccaggctcttccaagtcaccgatgagtcacccaggaaaacagcatctattaactcactgttagggaaatatttagccttcaacaacctggcgcataagctatccggaaactgaatcaggcgccaagcttgcctggctaggagagcttggttgaaaagcctcatatcccgaaaacccaagcctcccatgaatttaggcagaattagctgttcccaagcgatccaatgcactttccgtttattggtctcatcaccccaccaaaaatccctgatcattttggtataatgtcggctcccaaaactaatgattcagaaaccgacatgtttagactgtatcaagccctggatcagtagattgatacaagttcaataatctggatcgtctttgcatacgtctaggcatagctttgaaggagatattattatatgaagtaatagggtatttacaagattgtgtctaactattacagcag

SEQ ID NO: 74642 - DNA, 11826 bp, Oryza sativa
aattcgggatgaatttatcaggacgtgacaggagggtcctcagcagaaaagaaaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgtcagttccaacggagagaagcatcaaggaaacacaaatcctcgccaagattacagtttcagcctaactccagtgccaggacagaggaaacaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtcctatagcccgcgttgcaacagctccaattccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcactgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcatagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgtagtcctgtcacatcatcacagaaccaatcaaggatgcagtcactagaacaatgccagctatatctctccagaatcaaaatgagcagccatgtttgtggttttcagttcgctacttatcatggtgtaatcgaaagtttgcagcaaccatgtaatacataaatatattcatgtctataaacagtgagcttgctatgcttgtggatgattcacgttgagaatacaatgtaccgatgttaagcaccgtccctttttgtttaaggcagtgcctcgtattcatgtaatgagggagaaatgtgtaatacagacaagttccaggaggattcgtttgaaagatgcggatatatgatcatgtgtataattgtttactgacaaaggagacctagggtctcgtgtcagaggaactatattctaacctcgagttaataaccaacctgttgatggaaaagaaaaacaattaaactgtgttgggttaaaaagccaatgagacagtagttggggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattaatctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacgaaccacatcaaggtttcactgaaaggcagcaagccaaaggatctcatcgtccccagaagcgtccgcaatccacattaaagaataccacctgttagaggtaagccgaaagatgattgataaaagagattggcaaagatgttctctagcatgaaagaagtaggccgaaaggtgattgataaacagaaacatgctctgcatcgctcaaggaagacccctgattgtaattgccacgcaacagtcaccttgtcattaagtaagcaagatgacctaggtaaaagtgtttctaggaaggcaaagagtgaaatcttcaactcggtatcagatgctacacggagtgaaaagtgcaagcaccggttaccaggcaatgccatttcttgggagatgatccaatgggaaagaacacatcaaggttaaaggtgtaaaggaatacgttgaatactaactgaggacaacctgaagatgataatgggaagtaaactgaatgtaaagaaagtgaatccgagttgcttgttcgtgagagctattcccagttatgaatcaagtgatatgttcgaagataatctacagaggtcagattaaaatcacatctaacaacgaagcctcagatttgacaggataatgattagacaataacaaatccagcagtaaagccatttgggaagacgtcaaagcatatcaagtgggataagttggttctcttgggaagcataattcaaaggcaaagttatcgacccttgcatcaaatagcagaagtagctatcacccggagaccaggaaagctaatatgaggcagttggtggcaagttagaagtaaatgacaagcatggtattctcatgatgacaagcatggtatcttagtaatgacgagctgatctcgacgcatgacatgaagcgggtaacttgtatgaggttgacgccaaagatatgaatgataagaagttctagaaccgaagccccatcctcaaccaccgcagcctagtctgggtcagttagaagttcaaccagggacaagtcgggtgaagagaagattccatctgcaacaggagatcgagccaagcgttccagagtggagaagttttgttaggcaagttggttatagaagacggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattctctaaaaggaataatagaattaattaaaatttgaaaagaaattggcaaacattaaaatacgtacaagaaaaattcaaatgtgacccggagaatttttgttaaattctccttggtctaaaaggagccctcaaattttagtggaattctcagagcacaaataataattattaagaaataaacaaagttaaaatgattttataaaaagaaaaaccctaaaaagtctttcccccccttttcccctcttgggccggctcggcccatccctttatctctctctcctcttccccgcggcccatccggcctcctccccgcgcgcgcgccgctgacgggtgggcccgcccgccaccctcgctgacgggtggggcccacctgtcatccctgtcctcccgccgctcccgccgcctcgcccgtgccctagcgccgccgccgccgcgaatcccgccgcctcccgccgtccacgcgcacaataaagtggggggaaatattccccgtgattccctctctctttccccccatttctccctctctctcccgcgttcaaacgggcggatttgcccccgcaaatctcgccggcgccattgatggcggccgacctcccgcgccggtttcctcccttccccggccaccctctctcgcccccggctctatataaacactccccgtgcctctctccaccgtttccgccactcgccgctctctttccccgtcggaatcgagctcgcgccgtcgtcctctctctccgccgtcaccgccgagctccggttcgccgccgtcgttgccccggaccatctcccgcttcggcaccgcctccttcggcttcgccgcatcctcgccgacctcgtccacctctccgtttcggtcgccgaccgccggaacgccgccgtccccgtcgacccgagccgcgccgccgcctctctccgctccggtcgccgttcccgtcgtcgccatcgatccggggtgagccatggaccgcccatttcgtttcccccttccctcccctctctcggccgccgctccgccgtgcctatggccgccgccggcgaccataggggcgcgggcgcgccgcctcccgtcggccgtgccggcgaggccgccttcgggcgcgccccgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaacccgattttttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttccttcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttatcaaattattttgatttaaattactgcattattgctttatttaaattcccgcgttatcactgttttatttagccatgcctatttacctttgttaatacattattattgttattgttattattaccttgttcaccctaggaaaataaaaaccccaactagtgggtactctattcctggttccactagtatgaatttaggtagatgcctcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgtgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaatggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagctttggagaagatgtcttagggggagtcctggcttataccccagttgagcgcttgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacaggcgtgttccacgtcgtccccgtctccgtgcagccactgctggctgtccctcgtcgccccctcgccggccccggtcgtcgtcgtcctcgtcctctcgtcgttcccgatcgtcgtggcgttcgtccctccgtcgagccgttctcgtccgtcgtccgcgttcgtcaagcgagccgctgcagccccgtcctcgtcttcgtcctcggctccgcgtcgtcaagccttgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccgcgtgatttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatgcgagctccgaatcgacccgttcaagtctcttaatgtttgatataacctaaagaaccctgtgctttctttttatgtattgttattgcttctttataggcttgtagctttgcttgtgtgcttcgcgtagctttcgtcgttccggaggttcccgaagcgtggttcgtggttgtcgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctaggataaacaaaaccccaactagtgggtactctattcatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacatgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggctgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcataggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtactcccttgcattaatcatgcatctgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattattacactagcgttcgggaaaaggcaattttctcggtcgcgacaactcccttgcatagtgcccttgctcatcacacataaaacaaatgatacttgcttcttttgagtcaacatgtggcacgtcaccatgggtccttcgggatgctggcggcatgctgactcgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaaatggtgtctggtgcttcattcactcgggagcttgaggtaccgatgtcctgacttctgaccttattgcctttctcattgtcagccatctgttgcaaaggtttggagagggagagagggaaaacaaaggggagagacagattagaaactaagaataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgactaacaactctaccctagagggtggcttaggttctgtgacgggttctcaagatcttcactcctgcttcacagctggcttcagtgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttagaaaatatgtccttaggttttatccacttggcttatcctacagtcgagatggctctgataccagcttgtcgcgaccgagaaaattaccttttcccgaacgctagtgtattaatccccgtcccaggaaaagccggggtacaccgaacaaacatgatacaaaaggcacatctttattatatcgataatatttacattattacaaaggcacttaaggcctgacaatcaaaaataaacagcagcggactagcgggcctacggctacatcttcacaggcgctcaactggggtataagccaggactccacctaagacttcttctccaaagcttctcttactgaagagggaaaagattgagcaagaatgagtacatccacagtactcagcgagccacaccggcagatgcatgattaatgcaaagggggtacaaggggtaataatataggggttaagctttgcagaaaacagcatttaaaagtcacttagttgcccaaagccattttataagacgatcctagagctacacaatattattaatcaaggccgtgaaccctcacgaacctgccttaacccaaggcctacgatgattcagaccgaactggcaacccgaccctgagtcccagctcgtcccaagccaacccaggccaaccattccacattttagttgttgagcaaattttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggattcaatatgttcaaggatgatgtgacttgccttgctcgctttcccaaacgccggcttcaacttccacgaagagcggatcttccgagctgcagcgtctacacgaccaacggaaaagaaacggcttttactctactaaactccatataacaagcagaaacaaagcacaaaaatgggttcttgacttcttaaggaaaaattaga

SEQ ID NO: 74643 - DNA, 676 bp, Oryza sativa
accccccacgtctcctcctcctccacgtcaaaccacaatccaaccaaagcaaagcaaaggagagagatcccggagaagaagtttgcgtgcaaggcgatcgatccatgagcctgaggcacatgacccgagtgggcgcgcgcgcggcgcaggccgtgcgggagggcgcggggaggtctgtgaaggacaaggcgcagtcggcgacgacgtcgacgtcgtcggcggcggcgaggagcagcggcggcggcagcagggcacccgccgcggggtcggtggaaaagggcagggtgagcgcggcggcggcggctagggcggcggaagagaagcggaggcgggcggagcagtcgctgcgcaccgtcatgttcctctccgtctggggtcccaacacctgatgaagactagtactagtagatgtgtaggctagcgatagcttatctgcatacggtggtgtgaaggttttgttctgcgtctgtgaaaatctcagatgtgaatgaagatgtaattaagtatgtgaatcatcgtctatggatgccgaaaatactgtttattcttggatctcgcttgtgttgttaatccttctttgttgacttcttgttaatactgtctgtctgttcatctatggtacagaaaatactagtactgtttattcttgtacctcggttgtgttgttaagcctctt

SEQ ID NO: 74644 - DNA, 534 bp, Oryza sativa
cttgttgtaatgagtacctccgactattgttgtactagtagtattgcgaactattccgtgttgtatcgtaatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaactgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactcc

SEQ ID NO: 74645 - DNA, 1700 bp, Oryza sativa
  unsure (1)..(1700): unsure at all n locations
ccgtaggcccgctagtccgctgctgtttatttttgattgtcaggccttaagtgcctttgtaataatgtaaatattatcgatataataaagatgtgccttttgtatcatgtttgttcggtgtaccccggcttttcctgggacggagattaatacactagcgttcgggaaaaggtaaatttctcggtcgcgacaatgtggataccccaagacaacgcacatgccccgcagctccaaaacgaagccagtcaagtccagtccacgacgggtgatgctgccggccatctacaaacaaaacaaaatagaaaagcaacattttaaagattagattttgacaataaatgaagcagcaggacagagaaagactagaggattttcacaaataagaaaggatttttatttcgaaaatatcgctaaggcttgggatctacggctcgtcctagggtcaagggggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttatttattacatgggcagcgacggcccagcacactcaaagacaacgaaaaacagcagaagactaaggcgacgaccacaggcgcttgacggcaggcacgagctagacaccaaagccttcatcctccaggggctcctctgctgggtttgggaaaaattaaacaagactgagtacaactaccgtactcaacaagacacacccacaagtgcagcataattgcaaaggagtacaatggagttataatataggggttaggttttgcaataaacagcatttaaaagacccatagttgctcaaagctaaatttaaaacacgatcctagaactatttaatattattaatcaaggccgtgaacccacacgaacctgccttaacccaaggcctacgatgattcagaccgaactggcaacccgaccttgggtcccagctcgtcncaagccaacccaggccaaccattccacattttagttgttgagcaaattttaagaattagaacactgacttgggtacattgctcggcttgcccataaccgagggcgcggctattcgaatagattatactctgatcagaggtgttcctcacgtgtaaccacgtgccacataccaccacggtatacggacggaagacgtgacatagtttccaacccatcctagccatagacaagagtaccgacccaatcctgcctacggccggaacccccgggacaggcaggcaggactgagccccaagcagcagcgcaccaaccctctgccacgacatctcgactaccgggccgcagctcgtgtagccttcatttgccctggagaatgtccatcgacccccgacttcatccatctccaatccgtgtacttttgtttaaaaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttat

SEQ ID NO: 74646 - DNA, 1703 bp, Oryza sativa
ggatttttgatctaaaggaaaaggatttatttaaatcctttttgagaaaagaaaagaaaataaagagggaggggaattagacttccctcgggcggctagggcgcggcccgagagaaaggggcggctcggccgaacttaacgggtcggccggccagagaaggcggcccaaggcgcgcgcgcgggcggggaggagagagggagctggtgggccgggtccatctcgcgtggtcccgagtgggacctgcttttcggtggctcggctcaccgtgcggagggagcacgctgcgtgcgctagggttcggggaaagagacgcggtgcacgcgcgcggttcgcagaggacgcggatacggctggcccacgcgcagcctcacggctcgcggtggaccgcgcgcgtgagcggggccggagggagcggctgaccagggtcggctcgacccggtcgcggccgaggtggcaccgacgtggtgccttcatggcagccacgcgggccggcgagaggaagacgaaggcgccggccgcgaatagacggcgggcggcggcggtttctccgggatgccgtgcgacgacgaggggcgacggggtgtacaccggaatgacgagggagaacgagagggagcgagccaacggcttggattcgccggagggagttcgtcggcggcagattgcggtggcggcaaccggcggcgagaaaagggggaaacggcgacgaggtcacgaggggctgattcccggcggtgagagcatctacacggctacggtaatgcattcctagcaccggattaggaggaaacacgccgtgggaggccggcgacgagaggtggttaccggactcgggcggcgacggcggcgagcccactgtgagtgatggcagcagtcggggcggcgcaagtttgctacggggaggctacacatgccactaaccgagtctaaggggaggagatggatcgaggagggagaacggggagatgcactaccgtgcgggacggggcgcagtgacgatgggccgacggcacgggagtgatctcttcggcctcaggccgaggaagcggaggaagacgatgtgcccgaagtccccttcacgcgtcctttgcacgcaccggctctcccgatgcttggcgatgaacggcggaggcgagacagaggggcggcaatggtgtggtggtggcgagcgaaacgggaggaggaatcgatgggagggcgccttggttaaataggaggcgatgtcgatttgggaaccgacctagggcggtcaagggagcgagctagcgctcggcggtcgcggccaaaacggcgacagggggggtgacgccggcggaagagaaaagggaaaaggaggagagaaaggggggcttgcccgttgccactttgggaaaaggaggagggagagagggcgacgcggcagagggaggaggagctctgcctccatcccttggaagctagcgtgcggagtggcggggccaggtcgtgacgacggcgatgacggcgggggcggtgtggagcggaacagcgacacgggcggcaggcgcgggcaggcgtggcagatgctgacggcggcggcgaccaggcggtcggccaccacggcgagcgcgcgcgggaagcaacggcgcgcggcgatttgagcggcgcggctcgggcacgcgtgctggctcgcggggtcgagcggctgcgctgctacaggcgtggcagggcagcggggccgggc

SEQ ID NO: 74647 - DNA, 18078 bp, Oryza sativa
ggagtgggcgcggggaacccggcgctcgtgcgggcgtggtcgacgtggcccgaaggaggcggagacgtgggcgcggcgacggttgcgggcgcggcggcgcggcgggaacggcgggaggtgggggaaggacccgacaggtgggccccacctgtcggtgaccccaggagaggagggcggcggggcggcctggctgggcctcggcctgcggccggcccgggaggaaaggagagaatgggccagcggcccattcgaaaaaaggaggaaaaagggaggaaaaagaaaaagaaaaaggaaaaaggattttccctggaattaaaatattgcttgctcaattttaattggttaaaattatttctagagctctgaaaattccactaaaaatcctgttagtgaatttcggcatgtagaagtcaagaaaaattccacatgccaattccgattattatttgcattgatttaaaagggtttactcgtgctttgcacctgtattttcttggggtcatttataaattaaattttaggcttgggaggagaacttcggggtgtgacaaacctaccccccttaaacggaatctcggccccgagattcggaggagctggtgaagaggtgcggatgggcggctttcaactcatcctccctttcccaggttgcttcctcttctgaatgatgactccactgaactcggcaaaacctggtgaccttgtttctggttcttctttcactggtatcaagtatacgaaccggcttctccacgtaggttaggtccttcctggatatcaatgtgttccgaatcagcctgttcttcgggtacccttaagcacttctttaattgggacacgtggaacacgtcatggatgccgatcatattggatggaagttctaactgataagcaacttctccccttcgttccaagattttgtatggtcccacgaagcgtggtgccaacttgcctttgttttgaaaacggtgcactcctcggagcggagtgacacgaagatacacgtaatctcccgcctcaaaagtgagctcccttcggcggttatccgcgtagctcttctgtcgagactgtgcaatcctcaacctttccctgatgattctgactttctcttctgcttccgctaatacctctgtcccgaacagttgacgctcgcctgtctgatcccagaagagaggtgtgcggcacttccggccgtataaagcttcaaacggtgccatctgtagactagcctggtagctgttgttgtacgagaattccgcatatggcaagcttttgtcccaagctccaccaaaatcgagagcgcaagctctcaacatatcttccaagatttgattgactcgctcggtctgaccatcagtttgcgggtgataggccgtgctgaaatttaaacgggtccccaattcttcctgcagcttctaccagaattttgaggtgaactgactccctcggtcagatacaatctttttgggtactccatgtagacacatgattctcgagaggtagagctccgccaaccttttgcccgtatacgtggtatgtactggtatgaagtgagcaaccttagtgagtcgatccacgactacccagatggaatcatgacccgatgatgtccggggcagtcctgttataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccatgctcatcttcatggaaatcccgggcttttccgactctcatgttctttttcagctctgctatttcagaatcatttactctgctctgacttgatccacgagcgtaggccgtgcctccagagcggctacgaacccgtgttcaacaattcccacgttgagatgctcaaactcctgccgcaattcctcacacatgccctcgatgcatagggcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaaacatgaaccactgctgccaattccaggtcatgagttggataatttccttcgtgtggacgcaactgccgcgaggcatacgcaaccaccctgccctcttgcattaggacacatccaagtccatggcgggatgcatcgcaatagacttggaagtctttcatctggtcgggcagaatcaaaactggtgcggatactaatttctttttgagctcctcaaaactcttatcgcactcagctgtccatttaaacttctcatctttcttaagcaactgagtcatgggtcgggcgatcctggagaagttttcgatgaatcggcggtaatatcccgcaagtccaagaaaacttcgaatctgcgacacggtcttcggtggggtccatttggtaactgactctacgttcgacagatcaactaccacaccctgagctgtaatgacatggcccagaaatttgacttccatcaaccagaagtcacacttgctgaacatggcgttagctggtgctccttcaacttcttgagtactagacggagatgttgctcatgttcttcttcggactttgaatagataagaatgtcgtcgatgaacaccacaacaaatttgtccagaaattccatgaacactttgttcatcagattcatgaagaatgcgggtgcgttggtaagtccgaaagacataaccgtgcactcatatagcccgtaccgagtggtgaaggccgtctttggaatatcctcttcccgaattctcaactggtggtagcctgatcgcaggtctatcttagaaaacactttagctcctttcagttgatcaaattcgaacaaatcatcgattcgcggcaaaggatatttgttcttgattgtgacctcgttgagtgcgcgataatcaacgcacatcctcttcgtcttatcctttttctccacaaaaatgatcggagcaccccaaggtgaagtacttggtcgaatgtaccctttctgcagctgctcatccacctgcttcttgacctcggctaattcattggccgccattctgtacggtctcttgtaaattggagcggttcccggtgccaagtcaatccggaattcaatctctctcttgggtggcatggtagtaaggtcttcggggaacacttctggatactcgcagactatggggatatcttccaatttccgcaagttcttctccacggtgtcctctgggattttcgtctcaatctgattcaaagagacccctcgctttggtgagtctggtgatttgtacactaccgtttctcccttctcgttggtcaaggtgacggtacgattcgcacaatcgatgactcccttaaacttggtcagccaatccatcccaagaatgacatctaggtctttagattcgagaagaatgaggttagctagaaatggtgatctttgaatttctattagcactgaagggctaaaactgactgaggttgaactatttcccggggtatgaaccctcattggtgtgctaagctcttctttccttaacccatgcatcccgacaaacttctttgaaatgaacgaatgcgttgcaccagaatcaaaaagtattgttgcagggattgagttaacaggaaacgtacccagtacaacctctggtgttgcttgtgcctcctccgcagatgcgtggttgacacgagcctggataaaccttggcccggcacgcctaggctttgggcatttgtcggcgaagtggccaagctcgccacagttgaagcaggaccctggttttgctccagtctccttcttggcttgcgcgggcgggcctgactgtgctggtgccactggtgggcgtggagctgcaccgcggctgggctgacctccatgatggttctgactgccactggcgccctggggaaagttgctagggttgaacgggcggtactggcggacgatcatggtggtaggtccaccctgctgcccgggggtgaagcgcggcctctggtgacttccctgaggtgccctgaacagagcggccttcctcttcctgtccatcttgttgcattaatcctcctgacggattgccttgtcaaccagcctttcgaaatcggcgtaatctccagatatcaactggttggttagctcgtcatccagacctgccatgaacttttcctgcttctcggcgtcggtacggacatcctctggtgcatatcgcgctaggccattgaactcatggagatactccgtcaccgtcctgttgccctgatggagtgctcggaattccctcttcttttgtgccacgaccccatctggcacctgcgccttcctgaagctacggcagaactcttcccaagtgacttcagtacctggtgggcgggtggccatgtgattgtcccaccaagccgacgcagggccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctgatgctgctgttcggcgtgctgcagcatcctctggtgcatctgctggtgctgctgctgcatctgctgcatcatggctgctatcatctgtgtctgatgtgccatcacttgggctagcgtcggattctcgggaagtggtggcggaccattgccggaattgctgttgggatgcacaccctcagtgcgctcttcgccgttgctgccctcacccgttgcgcggctaccattcctggtgtaaaccatctggaggaaaagcatacggggaaaagaagaaaaacagatgctcaggaactaagctttattatttaaactgcaattgttctgatctgaattaaaacacttaaagagcaagcaaaaatccttattaagacagccatatcataggcacatgatatcgaccgtcgactgaccccaaacaagcaacctaaacacacaaactaacaaacaaatgctagacagtcgataaactaatggaaaacgagcctaatgctcggaacggctcctgcggtcggtggagtcgaaggcgtcctcctgctcgtcaccaggtctctctgagcgactcctggagcctggcagataagtctcgccgctgcccgactctgagccactggagctgctgctgctgagatcgcggctgccactgggagtagcagacaaccaacctccgttgccactggctggacccctggcggctgatgctggagcgaaggagagagcggacgcgggagctaacacgtgaacgggagctggagctggagctgcaggaactgccggagctgcgggcggaggtgggttcctgggcgcaagctggatgcgcacgggtttcgtcgtcgtcttgcggggtgtagtgcggatccggactcctcctggcgcgggaagaccctttaactgagcattctccctcttcaggcgcgctatctcatccttcaaagcgacgatcctcatgagcttcccatcattcaaggccttggtcgccttgtgcagatccgagtgcatcctatccaatcccctcatcacagcacacatgtgaccaaaggtggtgtcgttctcgccagctgtcggacggaaggtactgacatcatcaccactggctcgacgagggtgaaatcggtacgccgtgtcatggaagatgtagttgtggcgctcccgtagtctggccatcatcaggtatgctgcctcctgacaggcgtgatctgctgtgcctccagatgcctcaaccaccatgttagctaggcaggtacccacgtagccgtggacctccaggcgaacacggtgaggaagctcgccactgagcggtggaaccgtcgtgtactctggcgcattggggtagcccaccaccagcgtcatacgtgccaactctgccacaaagtcgatcatgccttctccacagtggttgggtgggtgtccggccatctagagaagacaaaggagtaggatcaatgcatgctcaaatccaaatttaaaaaaagcaataaaagactcaaataagagaatcgaataagagcgaaattttatgcatagatcattttgcatgagagcgaataaataagacagactcacataacgataaaataatggggaaattagatacatactaataataacactaagagcataaataccttgcaacccatgttcctgagctaggacctaatgcatttcacccatcaaatcccaactgactggcgaataaatctcaatagttttactaaaaccctggactgacttgttttgacaaatctcacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccgaatagaatttcaagcagaatgtgcattaaaatccccgtccaggaccagctggggtacacaaacgacaatgttgacattcagatccacgtcttacaaatatcataaaagtcttacataaatgcagcggaagaaaggaaagacaacaggagctaagccttgactagaactgcagcgggaacaccactccacaggcatcctcgacagcacggacgaagcctactcctcagagacaccttcttccaacacatactcgtgctctgaggttgggaaaaatagagcaagactgagtactacccactgtactcagcaagtcataccggaatagaggcatgatgcagggaatcatcaaagaagagctagagtggttcatttgcataaagcgagcatttataaacagaagttgaaagattaaacagttataatacttaattaatattaactatccactgtccaatgctatcccatgttgcaacaggcccaaccatccacctaaactatccaatttcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccattcgcataacccccctctaaccaagcacaccacacctcaggtttcacccccactcctcgcaaggcagcgggcagtcccctctcgtgcctaggtgaatccggaagccgcataggccgtcgcagggcccatccaaactccatcacgtccacccttgcctggatgcgtcggctagaggaaagctacgctacaagcccagccgttgcccacgctggcttgtggtaagtacgataagttcttctagggcatcccgcgaaccggtccttaactgccatgggtgcgaccagcaaaaccatacacccacagcccaccatgtgatttattttaattaaccaacaccaaagcggtggcactaatccaacaaaaccattagaaccaacagtctaaacattaataagatcttccccattgtgaactagttgaactaagcatggctaagcaatccctagtccaaactctaatcatgttataaccccaagctgacaaagagacatggttcaacaacagcatggctatgacaataggtaaacatcccatagtaacattataaaataatgcaatatttgaaagaaaacaacagagcatttgcaatataggatcaacatgttcaagtgacaagcatgacttgccttgctctgctgctggaggaacctcggcgactatttcgaagtacaccggagcgtcggaggaaccggaatctagcgacatacaagacaaacattgcaaacaggctataagactactgaaacagggaacaaaaccatttttaatggattctacatatttttcttgatttactgagacttgaatgggcttaaacggagctcggatgaattaattatgaattttagaagattcactgtgtttattactataacaaaaatccttaaatattttattgcgcaatattttctagggttgacgtcagcacgggggaggtgcggcgccgacatgcggggcccactggtcagcggctcaggggagagcggttcaccgtggaccgggaccacgcgggtggtccaccgccggtccacggaaccgacggcccagatcgccctcggggccgatcggacgggcggcgatagaggcggccgccgggctcggctcggcatcaaagccgaccggccggccagggctaatggcggcggcacgcgcgcgtcgcgttgccggcaacggcatccggcggcggaggcgacggcgcaaaagcgacgcgaaagcggcggcagcggacggtggcaacgaccgaaggcgacggcgagcgcgggcggcggcgacgcacggggaattgggaaagaaaaggaaaggggagggagtcctcaccggaggggacggcggcgtccggcgacgaggagcgacggagggaggtcaacacgcggcggacggcgaccgggacgacctaaagaacgaaaagaaagagattagagaggaagagaggggccataggagacgggaatgccggccgaaagcggcggacatggcgaccctcaccgtcgcacgatgggaatggcgctccggcggcgaacctcgacgaaggcggggtggacggggtggatctcggccacgcgaacccgacggcggcgacggcgcggtgcggcggcgaccccagcggcggctagcagcggccggagtagcggaaacagcggcggcaagaggttgcacggcgcgggagcgatgggaggctcgggagagttcggcgaaatggggaaaaagcgagagggggcgacggagaagcttaaatagggagagagggggccggacgtggccaagagaggcgggaatcgccggccgacatggggaagtggggaaggagagagaggcgggattcgaaaatcgaatcccggccatctcgggcgcgggcgcgggcgggagagagaggggagtgggcgcggggaacgcggcgcacgcgcgggcgtggtcgacgtggcccgaaggaggcggagacgtgggcgcggcgacggttgcgggcgcggcggcgcggcgggagcggcgggaggtgggggaaggacccgacaggtgggccccacctgtcggtgaccccaggagaggagggcggcggggcggcctggctgggcctcggcctgcggccggcctgggaggaaaggagagaatgggccagcggcccattcgaaaaaaggaggaaaaagggaggaaaaagaaaaaagaaaaaggaaaaaggattttccctggaattaaaatattgcatgctcaattttaattggttaaaattatttctagagctctgaaaattccactaaaaatcctgttagtgaatttcggcatgtagaactcaagaaaaattccacatgccaattccgattattatttgcattgatttaaaagggtttactcttgctttgcacctgtattttcttggggtcatttataaattaaattttaggcttgggaggagaacttcggggtgtgacaagctccacctggaaaaggcgaaggatctcaggcaacagtacgttgcacggaaaccgaagccctgccttgaagaacatggcgaatacaaccgtccggttgtcgccgggcttcggcaccacggccttccccggggcgaaagcttgcccctccaccaccgcgccagagctgaccaactttgccaactcgtccttatccacaagtgaaacccctaaaaaggcggtgttgtcattgtcgatctggccgggatcgcggcccgtcgcggaggccggattcggtttgcggggagccatggcgagaagcatgcgctgtggcaaaaagggtgaacgggcgaacgacctagcgactctaagggcgctgtgaagaaaagagagagaaagagagtgatcttgcggtgaaaatgacgggggagcggcggtgaaaaaggggaaggggagatatatatagcccacccaggcaacagttcaccttccacccaaccacgagccgccgcgtgtcataagggtaggcgaaatggtaaattcccattgaccaggccgcacagtgacaagcccacgaaggaaagcccatcactgttcaacccggcccagcgaaagaataataccaacttcgccgattcgcagagtgtgaaagctgtaacacattactaaccacaggaataatgtatgcgcagtgcacacatcctttacaggattccaagacaggtttcggtaggagcatcggtcaaaagggggcgtctcataccataccacatagtttgcatggtctcggccgaagctcctatctcacccttgcccgtgaggggcttgttggcagtatgtcatgagacccttcgaccagacctgccgaaaccgtgcgaccagtcaggattcaggctcaaggtgttaagttcatcggggcgaagccccatggtgaaagcggtgaagccacatggcgaagacaatggaacgaggacggcaaaagatggagccccatggcgaagactgtacatcctgggcgaagggtgcccgccgaaggagggtgacttcgccatcctggccgctttggccggcctttgggccggcattcgccaaccaggcccattagaggcccatgtatgccaatgacactgtatacccatgtaaatgtccctttcacaagggcaaccatgtaaattcccctgtaaaacctaaaccctaataggggggcctgtaacaaggatataaatagacccctagggccatgtaaaggggatcccaagaaaaattctcaatctaatacactttactgttttccaaccatcgttgagtaaccacatccttcgacgtatacagttgttatttcgacaacactctataaataccatctgcgggtatagcccatcatataaaaacactatttatcatatatataaaaaaaggttatcatgagcaaatattcgtttgaacaaattcaacacaatataataatagatttaacatggtcacgcccatacaaaaccgaagcatccacgctagttcaatatatattactaagctaacatgttcacaggtccatgataacattttttttagatataataaataatatatttttcatatgtttgtatataatttctctcatattctaacgaatatttgcccataataatttctcccatatgataaatagtattactttgatttgacctaggggtaaaagagtcatattaagtctcatttcatacttgcaaagctgacatttcattttaattaggtaaatttggtaatttataaagagtagctctctctgctgtggcatttatataaagaaatttggaagagtgtcttagtgtctttccgtaagagcggtgaatacttaaaaacccctggggggggcagcatgaaccctgccctcccaggctactgctaccttgctgacgcaaaaggatggagatattttgatgatttaatcaacaaatagggacaaaactattttaattgaaagaaaataatattacggttaagtccccagttgagtgatattcgtggcgaagtctcattttgataatagtagaatgtcaattctctccatcaaagcgagggttgatgagaagacactcgtaagaaaattaccctcttcaaatatttgaacgtatcattgtgatttgtgaatgtcacggcaaaaaatccataatggtgattttgtttccattcttattatcggcaataaatgtaggtgaacagtagtatgagaaataaaatccatgagatagaatatagtctcggattacaggtttcatctaatgctaaataagttaaccacaagactattcgaaattacactgtattccatatagtattccgaatattccaaattgtgcctactaatgcggaaatgtttttggcagaggcaatgattatatgaaaccaaacatttcattcccattagtaattacactctattccgtagagtattctgaatatccctaattgtacccactaatgcagaaatgtttctggcagtaagatgatatgaaagtgaacaattcatccccaccagttctccattcttgttgatcaccggagtcccgaactctgccgaaacactcaccgcgcagttgtgcgagaactcatgtccattcaatgtcctgagcacaaacaaaatcagcattttattattatatagacgactattgctgtagcttatttacttgattatatggataataaatcaaatattttgaaaaataaacttaacaaatattagtttaaaacaagtggttaagcaatgaaatagaagttttttttgagagaacgtatttttcaaagcacgaagcaaataatctgctgattaagctgaaaatgacagggatgatatacatacatatgtgtgacatttcctggaattagttgcccatataagccattatatacatacactgcttcggacatctgaagcggctgattgcacatttcgaccctcttaaaaagatcggtattgaacttttcatcacccggacagcaatagattccaaccaatccatttgtaatattacagtgcttgggaaggggttttatgcattgttcccccggaaagtcaaccgtgattttatcagctgcaatatttccctcaaacgcacgagcatctgctacaatatatgcataggtcggatcacactccacaataataccattttgccgaatagttctttctggagttttttcgatggcaatgttcaccacacttctataaatgccattatacacctggggcacaaacagacaatttatgtacttatgtagtgacccgtcaaattagataatacggtactgtagtaggcactagttgctcaggatgctcagttctctgtgtgtttgtgtgtgtgtgtgtgttggggggggggggtagccaaggcaccatagaaacacttgccgattccgtgattctgggatccacctgacttaagcataaatctactaatctaaagccgacagttttgctggcatcctatttgtccatttggcactacaaattgcaagagatttggtgaaatcatgtctctcgcacttggtcactctagatcaatccggaaggtggaacgacatattgaccattggaaaaaaaaacatagagagaaagaaggcaggccctggctgctctctctactaggaccgtatggcccaatatacacatatgggcttattgcgcatggacggaaaaagaagaaaaaacaaaagaacataacgcataaaatcattcgacaaataagatatactacaggtaaagatggtagataaatacgatataatatgggttaatttcagaaattgagacaagtatgatgactatatttataatatactacgctctccgtccctaaatatagcaacttctactaatgtatttggacatggccaatgtgctatattttgggaaggagagagtatatttctagaaagaaacaataaacaacaaaattaaatgatataaattatgtaacaatattgtatcaaactttgcattcctaaaaatccttttttaagaatatttagtttccgatagattctcatacatatagaaaagtacaaatcacagcaatttcgagataccatatccttccttttatttttactaatagtatatatagttatttgtcaaacttaaagagactcaatccaacaaaattaatggcaagcatatattattattactatgttattttgatttacaatccattaacacgtctttttagtgtatactttctgtaggaattaaactaagttagatagtaacaaaaataactaacccatgtaaaaattatacaaattattttctgtgctatagaagagctctaaataatatgcaagggccataaactaaccggcgccaactggggcgtctatttttctagtaaatgagtaaacactcaccggatctggcgccggatccataggaggcgggctagaggcggaggtgctggaagcgcaagggaacgacggcgtggagcgagagacttcgttggaggcggtaggggcccagcgcctccgccgcgcagccagtcactaggccgcaccagatccagacatggatggatggagacgaatgaggagggaacagttgacgagcgcgtgcccagactccgccttggcctgcgcccactctgggctgggcaccgccgaccggccgcctgctcgccgcgaggggggagctagcaaagggagacgacgagacgagagaagaggcggcggcgctcggttcaggggcgagggagagagtgtagtgtgcgtgtgcgtgtgcgtgtgcgctggtctggtgggcttcgaggagggagggtaccacggactgtttagggcttgtgggctggtcgtttagtgctacttactaggaataagtctattttgcctcccacaagtcttgctcttggatgaatctcacccctcaaccgtaaaaccgggtataacgcatcccccaacttctaaaaccgatgcaaatagagtcccttggtgattttaatagcggtgtcatcatacgtggcacttacgtggcgggttgacttaatctttatcccatgtagtattgacgtgacactaaaaataaaaaacctagatagcatccacatgttagtgagtaaaacaataaaaataaatatcagacccacgtatcagttaccctttctttctctcaggtcttcgcctcttccctgcgagtgacaggggatagatgccaggagggagcaccgtcttggcgttgtccgtcccgtcgagagggcggcatataacacacggccacggcgctcctcgaagtccagccggcggcgacgttcccgtggactgcgggatgagctggcgtctcagaaggtggtgctcgccgagatggcgcaggaagtgggccttcccaccagtgagtgcatctagtgtatcatctcgacggttattgtcgggaggtcctccttggggatgctagtgtgctccccaacattattgtattcaacaccttgctcatgggctttctcgaggacaacaaacactaagccgttttctgacgttgttagcaaactgagctcacaaacactaaaccattcccgaatcttttttctgctagctcaagaacagtaaaagaaaacgattttttaatctgcatcttggggttcttgcagattcttgggatgacggagcgacgcaaggcccgggagggcaccgccacctacttgtcgtcgcaccactggatcaggagagggctatcgccaaacattgcctatgcccatcgcctcattgccgctgccaccaaatctgcttcgctgcccttgctgcgggcctgcgtcgtagtgacgagcatgccaccacttagagtcaatgacgcataggccatcatgtatatgtgacatatatgagtacagcggtaaattattaattaccacttataggagtgacaaataattaaatatctcaaatttaagagttaaaactctatcaaacatactcttatctcattacgttttgttccgtacctagacaaggcacggccaatcctgtccatccgatcttcgaatcaaatagaccagatctcctcgacgcaatccccttgatccgtgcctccacgcctctcccgagggtacgcctaatgggcgatcgatcgccctggggatggggtagcgatcagattcgctccccacctccccctctctcccttcacctggttttctttttttggcaccgcattacttttctattttagtaaatttatatacctaaagtttatacacctcaagtttacacatctaaactttagagaccaaaagtttataagtcaaaagtttatatatccgatttaaatttgaatttgaattcaaatattttttatatatagtatttctatacatctaaagtttatacacctaaaatttatagacctaaagtttatatacccgatttaaatttgaatttgaattgaaatattttctatatatagtatttctatacatctaaagtttatactcctaaagtttatagacctaaagtttatatacctgtttcaaatttgaatttgaattatatccgattcaaatttgaatttgaattcaaatattttctatatatagtatttctatacatataaagtttatagacccaaagtttacatatccgattcaaatttgaatttgaattcaatttttttatatatagtatttctatacataaatttttctaactttttgtttttttaaaaaaaattgtggagatgtgtaaacttgaggtgtacaaactttagatgcataaatttactaaaataggaaagtaatgcggtgctaaaaaaaaaaaaagaaaactaggtggagaaagagaatcagatctgatcgcccctagcgaggtagcattctcgctcccccgaggccccgacgcgcatcgctccgcatccggactttgtccccagtccccatcccacacactctcatcccgccgcctccgccactttcgcgacgcaccgactacgcgtcccctccatgtcgcgcccacgcctccgtagcgtccctggcggcccctccacacgccggcgtgcgcccccgccttctccaccaccgtctccgcgctcaaggagttcatcctcgctcggtggccgcaaggtcaggcaggagattcttgatagagtagatggattttgtcacctgatctgctgcatatttgatttgatgaaaacactagggcttgtgacctgatctgccgtcgtttttctcgcctggtgtttgtgtgggcgtttctttccctccctgttcctaccctctcctgtggttttgctcgtgtccgatgactgttaaatcggtaatttatccttctctgaatggacattctgaccaactgagtagcgcgcaattagtccttctccccgtagcttcaacagtgttctagaacttgataattccccttctgagtgtacttgcatcatccataaaaaaaaccttgacctcgcgaatttggatattgtattgtgggaagaatatatgtggcagagaaccggaaagacacattttaggcaatgattcggaatttcagatcataaataagtgcgatgatgggccaaacaagaaacaatgtcgtcttcctttgccctatgtagagtaaagacgaattaaatttgaaaatatactgttcatactttttttttcagaaatattcgtgatgaaaatctttttgcagaaatataccgtcgatctcacataaccattgagcatgacgtcgtgggcggtatcgtgcagggaaagccggtctcgctgattgaaatagcgataccggactgccaccgattcaattagtgattaattatcatgattagcgattaattaattaattattaatcactaatcaggataattagtcactaaatattattagttaatagttaattaggtaattaatcactaattaaaaagtggagatcattgcatcagtgagacagtgtcgctgtttcaatcagcgagaccgctcttccgttccgcgagactgcgcggtctcgcccttttgcgcaacggttgtgcgagatcgatggtatatttctgcaaaacaatttgcatcctgaatatttcgaaaaaaaatgaatgaacagtatattttcaaatttaattcgagtaaagactcaaagaagatggcacaatgccatgttttataacagtattatgcgcttttcgtgt

SEQ ID NO: 74648 - DNA, 14677 bp, Oryza sativa
aaatagacttttgcggaggaattcgatttgggaaggaattggattcgggatttgaattcgacgatggatcggggattcgagatccggaatggcacagagactgactgcaagcgaagaaacaattttcgcaattagggtttttagaatttaaattttcccgctaggcgccacgacggaacgggcgctacacaacgtcttagcggcggaggaggagcgaggtagcggtggtgctcgaggcccctcactccacttgcggcagcaactgaggagaggagaacggggagacgtcgcccaaagcaggaggcgcaccggcggcgagggacgatagtgctacgtggcagcgggaggaggaaaactcgttgccgaggtcattgcatgtgcccacgtccatggccaccgccttgtctgctgtgcgcgggggctggcccttccccggtgtagtctcactcaccggcagctgtcacgcacccctccgcaacaccgacgtccacgccatttccaccgtccgctgcccgcgtccatggccgccgccttgtccgccgcgcgccaggaggcggtggccccttcctcggggcagcctagcttgtcggcggctgctgcccgtacctccgcaacaccgactttcgcgccgtttccacaacgacatcaatgccgctatcttcccctacttcgcgcggtggcgccaagcgtttggcaagagaggaatagaggtggtaactagtgaggagaggggaagtagtcattgacgcgtgaacatgctgactcagctgccacatcaactaaaaccagagacaataccaccgaaaatgctgcacgccgggcgcctgagcgtccgaacaaaaaatcggacactcggaccacatactaagtattttaaatagctttaaaatgatttttctcctaaattaattatccaatctatgatccgatcacgccgttgtattcgttgcaattaaatctttataacaagaccacacatgattatatttcgacaaaaaaatattttagcttttttattgatatttttttagaatgctgcatatggttcttttgatgtttcaatcaatagttttacgatgttttagctagtgtactcactatgtacggatcaaatgttgcagtggattttgatattatggaacgcgtcattgcaacaaatcacccatatattttgaaaactctctattaagggaatttgttttctttttttggttccacaaaaaatgtttcacctagtgtactcacaatgtttcactatatatagatctaatgttgcagtgaactaaaacattccattgcaacaaaaaaaagcccacatattttagaaaccccatattaaggaaattcgttttattttttgttccaccaaaaaatgtttcacctagtgtcctcacaatgtttcactatgtatagatcaaatgttgtagtgaactgaaatattctttcgctatttgctgaaacattatttttatataatgtgaaacaacacccgatttaaacgagtaaaacattttcgctctacttagttaaacaattccgatatacctggtggaacatcgtgttacatttaaaaataattcaataataagctaatttttttttcgtcggaatatatccatgtgtagtcttgttttgaagatttaatttcaacgaatttaatggtgcaatcggatcatgatttggataagtaatttaagagaaaaattagttttaaagtagttttgtacgtaaatcgggcgctgacatcagcgcccgatttccctagcccggatcgggcgactgatccgtaggcgcgtcccaatgccaccgagggattagtttgcactgattttataagttgagagatatattgtatgtggtttttcggttgagggatgattttgtaattcggtaacaagatgagggatcttcggtgtacttttccgaacaaaattgaccatgcttatgggcagcgggccatgtccaggcccagttctttccggaaaggtggggagagcccatgtaacgttccccataatctcatccgcgacgcggcccgtatgcccaaaaggcccaagaaacagagttttggtgtgggaaaaagtacaccgaaggtccctcaacttgttagcgagatacaaaatcgtcccctaactgtaaaaccggacatccggtgtccctcaatttacaaaaccggtcacaatagatctctcggcggttttgaccccgatttggtcccacgtggcgcctgactcaacgtgggacccatgtgggccccacatgtcagatagaccacgtcaccaccctttctctttttcccctgttctctcccttcctctctcctttttcctcaaggcatggatggcggcagcatcttcgacgcggcgtggaggagggccgacgtggccggcagctgacggggaaggtgcggtgtggagaggagggccgatgggacgggcggagccgccgatggctgccgtcgcgcggggaggagagcggtggtcgtcgtcagggtgaggcggcgatgcatggtggcgcgggcggcgtggcggaggggagggccggcggctagcgaagaaggagcatgacggagaggaggtccgagggccgatgcagcggtagcagcttcatcggcgcggcgaacaagagggtcgacgcagccgacggcggagaggagatctagctgtcgccgtagccgctgatggagatggcgaggcggccaccagcagctccggcgggcggtgggggttctcccactgccagtagccggtccggggcttcactcgatccactaccagctgcatgcacaaagctaaccacatgcatgctccactcgatccaaccgacttgctccaactagctcatgcacacatgcacgtactagcatagcacaaagccttggctaactaactaactaattaatcatgcatgctgttagagtgcgcagcccggcccatcaaccgtgggccacccaagtcacattgggcctgctccaccacaggcccaatcggagccacaactttaggtcctgggcctacacaacccaaaagactagtctattgggtgaggatcgcccccaccttttaagtcgtgctcccccatcatcaattactgatgtgggactaaacccaacaatctcccccgtcacacatcgggcccaacaatctcccccgtcacattaaccccatgtgatcccgaagacttgttacctggcctctctaccatgtgacccatgggaattgtttcgggttccaaaccttgggctctgataccacttgttagagtgcgcagcccggcctatcaaccgtgggccacccaggtcacattgggcctgctccaccacaggcccaatcggagtcacgactttaggtcctgggcctacacaacccaaaaaactagtctattgggtaaggaccgcccccaccttttaagtcgtgctcccccatcatcaattaccgatgtgggactaaacccaacacatgcagcgttggcgatgccgtcgtgcgtgacggtcagcctgatggcgtcgtcgttcttggcgaggcagcacgcgaatgccaccgactcccggtcgttggggccgccgaggaagacggcgacgatctgggtccccaccttctagtcgccttggttcctcgccgccgtcgtctcttcgcttgttgatatcttggtcggcaactggaagctggcgccgcccctccagaacgggcggtcggtgaagatgccgacggtgcacggggcaagctctagcaccttgtggttgagctcgcagcaatggtgctcgcgggcaccccgtcgaacccgggtgcttcggtaagttgtcgacgaaggagacggcgacgagcagcagcaccagccatcggcttcgtcaccggcgacaacctcactgtcccgctccgctgcgcctgcccctagctaccgcaggtcgcagtagtggtggccgcggcactcgatgcgcgtcacggcatgacctgcccaagaggagagaagtgagagagggagagagaggaggaagggagggatgacgtggcatcctgacatgtggggcccacgttgagtcagccaccacgtaagataaaaccggggtcaaaaccatcgaaaaaccaattgtgaccggttttgtaagttgggggacgccggatgtccggttttacggttgagggacgattttgtatctggctaacaagttgagggaccttgcgtgcactttttcctttggtgtgtgccacccccgccacaccgtcacccgtgcatgtgcgtcgcgatcgcagccatgcagaatgcaacgcccccggctatgtaaccccggggccggggctacgtgcctacgtggccgcgtgctcgacgctagccgccgaaccagaaggaagggagggacgaaagggtggtgtggtaagcgctgcatatgccccagcgagctaggcagcgagtgatacggggatcggtcccaagacgagatcatgtcgtcacgagtgagatttgacagggaaagctttggaccagctatagcctgcctgccgtgtctcgtactctcggtacgtacgtcgagtgtgcataccgtgacgaatcacaacttcacaagtactgctgctgatactgaggtatgatgggtatttcggagatgatcgtcgtctcatcgcatctgctccgatgtatgcattgattatcttgtgaatgatcacctgattaattatctgtatgcaaacaaactctctaactaggtgaaacctcgcgcattgctgcgggaatttagtatgttaaaaaaataacgtgcaagatagctagataacatcagattaagtaaattaatgtgatttatgataatttaaacttaaatagtagaatggtgattcaaacgtaaaaagtaaggtggtatgactttatggaagaagaaaagtagggagatagtttggaccgtagattaatcatctaaaggttaaaaacaattgatgtgatacgacttaattagaggaaaaaaggagaaagataatttggaccatagattaatcatttaagcattaactaaatgaggatgaactatataagtatataggatatcataaaatataataaagatatacattgaaatattatgtaaattatgttgtatgataatttaacatgtttgtatttgaaaagctcctaaattataaaaactataaagatatagcatgtttgcatgatatttaaacatgatgattgttagtggatgatgatgtggcatcttgttaattagtggatgatgatgtggcatcttgttaattagtggatgatgatgtggcatcttgttagtggatgatgatgtggcatctttgcatgttaagcttagtgagttagtgggggataactttataataagataggattaacataattatttaaaatcatcgcatgcgggaatattgtatgacatgtcaaataaaatttaagatgtgtttcatttgtatctaaatgactttgacaattatttattttttactataagtaatttgcaccatagagagctttttatggcttgaggaaaaaaaagacataaaaaccttaattatctgctatcgatatagataaggcataaactctcaaatgcttttaagaagactaatcatcaacccatgtgttgcatagatattacacctatattataaatattaaaatttcaaattcatatgctaaatacgctgggcattttttttaatcacatcggttagattataaagaagaggccgcatcagctacaacatggttaattgttaattacaaatttttttattttaaattgtcataaaatttctgaacttcatagttaataaatatcgagatgtaccctgttaggagtcataataatatttttttcatgtttttataaattcaaaagtcaaaattaatcactaccgtatattagagtattgtcaagtgtaaattagttttaagagaaaattgtatcttgggcctgtttttattaccgtagttacaacttggactaggtgtaaaccaaacttttcattttgggccaggtttctctatatgttggttcaatttggaccctcttcttcttcctcaaagactctctctctctctatagctcaaagcacggtagtgtagctcgagcaggagcaacacgcaaagagcaaaagcttggctcatatgtaattgaggttgagcataagtgcatgactcatctcctttcaaattccttcacattactgatcaagcaactcaaccttccaaaagaactcgaaggatagtttgtatttctaattttcaaccagcacattgaattggcgagaagctcaagctcaatgatagtgtcggatgactagagctttaggatgggaatggttagggttgatccatttatccactaaatctattcgtaaatttgtcctaatggatttttagggccgctccaaaaatataaatggatcgaacagatcaaaacattagaacctaggtttaaggggttcaacccaaaatacttcacatgcataaatgtttcaaaaatttgtacaaagttgcttctctatataataattcattcctacaaaattcaactaaatttaacaagttttcatagtgtgaacgcgagtttaaaaattttgggtccgagttttacacacatgtaactagaatttttgggtatcagtaatgcatcgtgggccccacatgtataaagggctcaaaatttacacaaagttgcttctctgtgcaataaattatcccaccgaaattcgactgaattcgataagttgttatagtgtgaacgcgagttaaaaattttgggtccaagttttacatacatgtaataagagttttttttttctactagtaatgtagccgatccatttagatatccatggataacctattgatataatagactcgtgatggattgatcctattaaatcatggatcaacgaactcacttaaaacggtttaggttcaatccatatcctaaccattcccatcctggctcgagctagcatgcctccgcatgcgttgcctgcactcgagctccacctccacgcgtgctgcctacactcagagctcaagctcagctttgatgggcggctgcgctgggatggcttgcacttctcttctgaatgcgctactcctgattgagaagaggtcttgagctgtccgcaacagagaaatggagctggaggaagaatagagctcaaattgaaacattgtgtaaatatacccggtccaaagtgaaaaaggttaatttaccctcggtctaagttgcaacattggtaagaaagatgacccaagatgcaataaaaatatcgagatgtactttcaatagcctgacaatcttctggcacatatgtctaacaatcttcttgtcatgtcagcgatacaggtgcaggttctataaaacaacctacatctatattaggagatatatgtgccagttgtttcctctatgcggtatctaaaatcagacccaccacacccagtggtcaggtgcctgttggtgggacccagtttaatgtagttagtttatatacagaaccggcacatataacttctcaaatgtgccgattctataatttgattgctcacgtggataaaaaagacatatgcttatgacggagcgtggggctcctcaccgagagaccgcgcaggtccccctttgccggttcggccgggggcgctaagtgaggttcttagccctcgatctgtggaataatcgcgagagagcaaatgcacgaaacacgggcgatgtagacaggttcgggccgctgagaagcgtaataccctactcctgtgttctggtggatctgtgtatgaagaagttacaaagagctggggagccagagaattcaggctctagaacccctctattctccttctggatctggatccgggatcccctcctcggtgggcaaggtcctccttttatatctcaaggggataccacatgcaccacttttacctactcttcttttgggtggggacccatcctatcttgaccaaaacttggctcgcgccttcgcctggaagctaaatcatagcttgtccttgagtgagggccagcgccgtcactcgcctgacacaggggatacccctgtcatttcttcattaatgggtggagatttgcaatggatgctgtccgaatgaccctccgatgggatgggccatacctacccccactctgccggaagcagatgtaacgtgggagcacagttgtctgccgatgacgtgaccggcgtcagactagtcacagaccggtcactcttgtccaccacgcgtcagtttagcataccgcacgtctgcccttcttcatgcaatgacttccccgccatggttgcgatgaagcctgtaatgtatctggccgggactgacgtgttaactccaggagttaacacgccggctccggctagggacgagtgcctggaggctctcatcattccgacgggacgggtcgaggcgtgagagaggccgcctgttgccacctaacccgcgatctgaccggtctgtgaccggtcacacactgcgaccggtcacggaccggataagcgagcgcgctgcgctgcattaaatgcggcgtggcgcgctcgtccaacccgcaataaatgcggttaggtgagcgccgctgtgctcacctaacccacacacgtggcgccaacaccacagggggtcggggcgccccagccctcggggccgaaacgggagcggcccgacccctcggggagacagagggaggggtggccacgtcaccctcgggcccgacccccccgagggggttaggccacgtggatgaccgtggctgcccaagcctctaatcacgatactcccggtcccatgtcaccgacagtagtccccggcattatgccagggcgaccgcccccctcgagggaagcgctcgggcgtgacgccactccttaggcctggtgacaggtggggccggtctctacaggcgggcagaaacccagcgatcgcaaatcgcgcgcgtcggcaaggaaaaaacgaccgacaataatgagcggcctctttaagaccgctacattactggagtagcgcacgaatcgggacgagccggttcgtttcgcctggagacatgatgatggcgcttcggcgagcgtagttaacgcgcgcacgatatgtcccatctcgactgccacggccgcacatccgcctcgtgcgccgtaaacgggcgagtgggattagcggaggcgtgggtacgagaaacgagggggcgagatagtgggcgcgggaaacgaggagccgggcatagcgttggcaagggtataaagacgcggaggaagagattcgtttccttcctctcgccattattccccttgccttcgccgcttgcgctctaactcttcgtttcctgtgcccttcccttgccgcactcactcgctctcaagctcctcctccgccggcgtcatggcacggggctccgcaccgctcgaaggtagcgtgctgccgccttcccgcatcgtgagcgagaggcaggccgggctgccgcgccgattcatgccggaatctgttaccggccgggaggtggtcgcgctgggcgagggacgcccggcgccacactacccggggcgatccgtcttcttcctctctttcgcaatggcagggctggtcccgccattctcttctttcttcatggatgttctggagctttacgatctccagatggcgcacctcactcccaacgcggtaatgatgttggccatcttcgcgcacctgtgcgagatgttcatcggggtgcgcccatctctccggctgctccagtggttcttcaccgtacagccggtgtcgccgccgatggtagtcgatggctgctacttccagccgcgggggcaggtgctgcaccgctacattccctgcatccttcgcaagaagtgggacgactggaagagcgattggttctatactcccctcgccgacaaagcgcgcctccgacttccgagccagcccccagcgcaggcctccagctggcgagccccggtagatctgggagacggctacgacgccgttcttgaccgcctggcgggtctgcgatcccaggggctcacgggggccatggtgttcggcgactaccttcgtcgccggatcgtgccgctccagcggcgcgcccggggcgcctgggagtacaccgggtccgaggactacatgaggacccaccaggggagcaaatgggactgggtccctgaagacttcaagatggtggtccaacgggtgctgaatctcagctccgtggaggcatccctcatcccccaaggtatcctccccttctgcagcgattcagagcgcgccaacatcctgaccatcatgcagacggtcggggcgtcgggggagcgggcccctcgaggccacgatggcgcgggcgggagccgcaggggggaacaatctaccccaggagggggtcgtgcttctgggccccgcgacgggggcccggggggcagccgccctgccgacgccagggggaagaggaagcagcagggtaccccttccccatctcctccccgagggggtggggcggcgcgtgctagtcagcaggcgcccggagggtgccgtgccgtcgtcgcagcccgaggggagcgaaagaagaagtggctccgcaagatggggggaccgaaccatgccggggaaacctcatctcccccccaaggtggtcgtttagccgacctcctcgcaggttcatccccgcgcccactgcggccgtattcattctcccatctcccaaggcaagttttcactcacccgtttctttttgtcttctggtttttcttctgcctcagcgagatcccgtcgctcccccttcgccattccaagtccggccggtctgaggccgaggagacagcgaccgcggaggcccggaggcgggaagctgaccggcgagaagccgcggaccgccttcgggaagccgaggaagctgcccaggaggccgtccgggctcgccaggctgaggaaaacgctcgggaggaggccaggctccgccgggctgaggagtccatccgggaggcagaggcggcgcgcgcacgccaggcggcctgccaagcccccgacccgactccgcccgaggcgacgacaacttccgaggccacccacgacgaggctacgggcgcaccgctcgggcccgacccttcgggcgacgctcaggacgagccagcttcggggggcgtccccgagtccggcacgtcgatcggcgggccgagccgtgcggcaacctcaccaaggcggctctcccctatgccttccactgccccactgagcgcggagccccttctgcaggccttggctgccgcgaacaccacggtgttggacgggttaagtgcccagatggaggtcctgcaggcagagcggacggagctcgacgcggcgtgggcacgcgtcgaagaggggcgacgctcggtggaggcaatggtggaggcgggccgcaaggcacaccgccggcacacctcagagctcgaggcccgtcggagggagctggcggagatcgccagggaggtggaggaggagcgggagagtgccctcctcgccgccgccgtgctgaacgaggcgcgggacgacctccgcctccaatacgggagccgggcggcggagctagagaagaagctcgacgccgcccggggagtccttgacgccgccgctgcccgggaacggcgggcggcggagagcgaggcggcatcccggcggcgcgaagaggcccttgaggctcgcgccacggcgctggaggagcgcgcccgcgtgaaggagcgggacctggcggaccgcgaggccgtcgtcgccatccgggaggcaacactggcggcgcacgaggccgcctgcgccgaagaggagtccgcactccgcctccgcgaggacgcgctcaccgagcgggagcgagctctcgaggaggccgaggccacggcgcagcggctggcggacagcctgttccaccgcgaggcagcgcgggaggagcaggcgcgccgtaatctggaaggcgcccgggccgagagggccgcactggatcaggggccgctgagctcgaggcgcgggcgaaggagctggacgcgagggcgcgcagcggcggggcggccgcgggcgacggcgacctagccgcccgcctcgcatctgccgaacacaccatcgccgagctgcagggcgcgctggactcgtccgcttggcgggcgaagtagggcccggcatgcttcgggatgccgtctcccatctagaccgcgccgggcggcaggcgggcctctggggcgggcggactgcgaagtacgctgccaaccaagggggcctcgcccagcgcctctcagagatggccgggaccctccctcggctccccgaggaactcgaggagacgatcaagtcatcctcgagagacctcgccctgggggcagtggagctcgtactggcaagctaccaggccagggaccccgacttctccccgtgggcagcgctggacgagttccctcccggaaccgaggacggcgcgcgcacgcaggttcgggacgccaccgaccacatcgtccacagttttgagggtacgacccctcggctcgcgttcgcccttgactccgacgaggagggcggtgatggtggtgcggacgccagcggcgacgaggccggcgacccgggcgcgtcggaatgagcccctaggccctcgccaatcttatatagctttttctttttcttccgaggccttcgggcccccttcttgtatagactgatttaatctgtaatcaaataaagaggaaatttcggtgtcaattctatttgttgtgtgtatgagacgaggatggcctgtgccgcggtccttctgtgtcttggcttgaataagggctcgtgcctaggtcccagcctcaaacggcgcgggtcggagctagtgcctggggagatccacgtgacgagactggccaggccgggagcgtggtgaccgagggttatggatgacccgattgtgggcctttgccgattcccccccggagttcaccacgccccggggcacggctcggttctgggccccttttggcgattttagccggcccgggccaccgagggcaggatcgagcacgagcgtgctaattcaagccaagattcttcaaaaggaaacagtggcacagacacattccttaggaaaacgaaaatgcttttattgaaatacggaagagaaaaaagataagtattatgcatgtggtagcccccggccaacactgcacgcccgggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacatcggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcaatacatggtggcccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccatgcttcttgaggatgttgaaggtcttggttttaaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccgaaccgagcagtgatgcccctgatgaatttaagcgcggagtgcttatcgatcttgatgaccggataagcctcaggccacttagtgaacttgtcgatggcgacatacagatactcgaacccgcccggggcccgcctgaacggacccaggatatcgagcccccagacagcaaacggccacgaaagaggtatggtctgcagggcctgggccggctgatgggtttgcttggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgtttgccgcgcgccgatagagggtcccttccaccagcacgtagcgtttggagatgcgctggacgcgttcactcccttcgcggtcctcgggtagagttttatctgcgaggtacgcctggatctcagcgatccaagcaatcaatctaagggagctgggagcgctcccctcgggtcccgaggcctggactccgacgggcctcgggggccgttcaggcgcgtccgactcccctagggggtcgggtcgcgccgacggctgggcaagcctttcttcaaaggcacccggtggggtctgggctcgcgaggaagcgagccttgagagttcgtcggcgaccgcgttatcctgtctgggcacgtgccgaagctctatcccgtcgaa

SEQ ID NO: 74649 - DNA, 614 bp, Oryza sativa
  unsure (1)..(614): unsure at all n locations
ggcaatacaagtcctttggtagcctcccctgtttttgagttggttgtaaaaagtacttctgaaactctttttagtggttaaataattctttttcttctttccatgcaccttttatactgttgagaatcttgaatacaattgttcatacctgcaggtttagtgaatttgggactgatggtggaccagcagcaaaggccttgaagccaaaattcaatctatttacgcagcaagtgtccaagagcttaggaatggcagtgccacatattgatgtatgaatatttatttgatttggctgccccattctacctaatattgtttcatttacttataccattctacctctttttctacagataaagactgtcattgctgctaccatgtttcttaaaggctttggtggtcttctgttcatcatcagcagctcatttggagcattcctacnnnnnnnnnnnnnnnnnnnnnnnnnnnnnnnncacctaatgtgttttctttatgcattctgcaccatgcctacccaaagtaaaatattatgtgtatttactattgtatgatatatgtagttcttattgttttaccatataaattggcaattttagctttatttctgatttggc

SEQ ID NO: 74650 - DNA, 2076 bp, Oryza sativa
tatatcaattaagttagagatatgattattagttcagttagagataagattagatcagcccatatcaattaagttagagataagattattagttcagttagatataagattagattgaatccttacttaggggtcaagctataccatctatataaggatgggattgtgtctattagcattaaacaacgaatatcaattagtctaatctctccctctcaacagtgttcttctccctagcctaaatctacatcccttctccaggagccgacgctgcccggctatcttcccggcagtgtttatcccgtcatgtactcatgtcctcgggtcatgacagtctggctgatgttttgccaaaaaaagatgctgattataaatgggtgtctgtttacattgatatcattggaccactgattttctgtataactgaggaaatgtatagatcaacaattgtcagagaaaaaaaactgactatcacacttagacatgggttcttttcttgatgtgcaatgcttgggtgaggtgctcctgcctgagtaaactagacaagtatctgcaaacaagatattcctcctgcagtacttttgccctcattgactgcacacacactgaattacaactggaagtttgaaaatggtgcaatttctgtttttctgagacactcgattgattatgaatgagaattaatgttttctggaggtcctcagattgacctgcattcaagggatcttttgtaattttgtaaagatttcacttaatcataattcatacttgttatccttattggattccaaatttattttattcaagggattgttcttgccatttttatgacagacaaggaaataactccaaaaactgtcaatgacctgaagctcattaatgccggaaggatattggagaataaccggacacttgtggagtcccgtgttcgagtagaagttccaggaggtgtaattacaatgcatgtggtagtccaccctccacaatccgacaaaaacagtggtattgccgccaatttgatctgtctttttttacattgttttctttttgcactgggtcaatcaaatcaaaggattggttaaaatttacatttacaagatgtttagatgtgatctctctgaattttgccaataaaatagattgtagtttgtcttgctcatgtgaatgacaatactatacctgagcactaatctaggattttttttcttgacatacccatgtctttttttgattgactttcattcatacatctaggagcagtaaatctaaggactggagaaacacatgttttgctagaaaaaaaatatttactgtcgtggagttatgatgatcaaaagagcacattgtgttctttttgtaaatatcaacaaatgctaattgttttgagaaggctggaacacataacctttatagtgaccagttgtttgttaataaataatttgaccctttcctccgatcatgacacatgcatctacatttgactacttattattctccaggatggatgattttgagtgagtcaatcaattcataggattggttgaagagtgatccttgcagttgcaagtaagtttgggaaatatctaggacccatgctttccctacacttaggggaatgcggctgttggtagttggtactcaaatccattgtagctgtttgtactcagatccgttgtagtaacgaggtaattcatgcatttttgcagcatttcaagtcaagcttgcaaaatctgtagtcatgttcaagtagtgagtgataatgagattctttttcgttgacctagagtgatttcttcacaccctggctaaaccagagatcaaacctggccaccaaagtgccatatcatttttctgcggtcaataaaaatcatcactccctgctttgatgatttctctcgctggcactaccctgctatgatgggaacccattgttgataaatctgatgcaaccaaactacttccgacattcctctcttgttcgatattaggttagtggggctaacctagctctccctggttttccatgcagagaggagaagaaataagaaccagagaacattatgggcagagtgaaca

SEQ ID NO: 74651 - DNA, 4846 bp, Oryza sativa
gacaacccctctccctccctccgccggcgacgaggccgccggaatcgaggaggaagaggggtcgggagaggggaaaaaactgtagcaagcgagggttcgagagatataaccaatatgtctaaacactattaggcatcacactttcaagtaggacgtgttcttcttggcccacttgttggctgatgcaatttccttattccagacgctaggtgtactcatgtgggtgtccctagcaatatactctgctttgcttttccttgactttccccaaagctttcatggattccatgggaacactcctctgtccccagaaaaagtcagaggagatagaaacaaaaccaaggaaaaaaatactaacaccaaaaaatatttttaaaaaagatttgaccctttcaatcatcctcctccagcagagcaagcagccaaaccaccaagctccattcacacacagcaacagcaaccacacacacaaatctagaatgaggaaaaaagaacatcatatcaacaaccaaaaaaggcactaaccatcaatagttggggatgcaagaagagtgatgagtgatgagaattgagatcccaatcctgaaaaacaaaaagtttggatttttttttgccattagagggagcttctttctctcttcttcaagcttacaaacatcccaagggagctacatgcagaaaggttaggttgttgaacagagaaaggaagagccaagaagagcaaagcacccctgctgcatccatgcagagagatagtactacatgatacacaccatcatctttttttccccttttgtttcatctccttttgttggttcatcatctaccactttctatttacaaatgtaaaaaaaaaaaaccagacacctaaggtgaagaaaagaaaaaaaaaagaaagaaaagaagagatgcaaagtctctctcaagcttgcctaggaaatataaaaagagagagaaaaaaagggttgttttgatcagccaagaactggaaggatttgatgctctcctactgctaccattgctaaacaactaatttttagtatgctgctgctgatggtgatgatgacgatgattaatggcggattaattggatgctctaatctcttcctccctcttcctttccctttcctttttcttgcgagctgatgagctaaaaaaagctaagaacggcgcggcgatctgtgcgagctagctgccggcggcggtgggctccgtccatggcgagggcaagaagggctcgtcggcgatgtcgaagagggaggacatgggggtgccatccaatgcggcgttgtcgtcgccgccgttgaggaagaggagctcgtcctcgccggccatctccatgtcctccacgagcagctcttcctcctcctcctcctcctcgtcctcctccatggacggcgtccgcagcggtgtggtcggggagagccccgccgcctcggctccaccacccccggcgccgaccaccaccaccgacggcggcggcggctggggctgcgcggaggcggcggaggcggcggaggaggaagggagcttgttgcgggtggtgccggcgagcgagttgcggtgggtgggcgccgagtggttgtgctcgccggtgtaggtgaggatgaaggtgttggggtcggagcggctcctctccacctgcttcctcgccgggcaccccttcgagctactgcaccggtagtaccccctgttgcaacaaaaccatagctccggtgagcttttccttccatttcacggcggcgccggcgagagagagaaagaggggactgaccttgggtagggtgagcccttgatgggcttctgtccgtacttccgccacgcccacacgtcggccgacacgccgtccgccggcacgtgccgcaccaccttcttctgctggttcttcctggagcaacgagagcagagtttagcaactcggaattaatagaattaatcttttttgtcggattgattaggaaggagatgaggagttcagctgctgccatttctggcgaggtgaaaaagagaagctcgctcacctcctcttggatctaggcacgccgccagctggcacctgcctcgccgccgccggctgcgacgccctcgccggagccgtcgtcggagccggtagattctcctgcaccgtcaccggtttctgctgctctggctgcggctgcgtcggaggaggaggaggaggcgtcggcagaggcgacgacttcgacgaggaagaagaaggaaaggcggcgcagaacgccttgaggagctcgtcggcgtcgcggccgagcccgccgccgccgccgtccctgaccgtcagctccgggaagctccacgcagcctccaccccgacctccttctccgccgcaacctccatcgccaccccctgctgcaagaacgacgcgaacggatccacctgctgcgccaccgccgccggagagatcctccgtcggcagcagccgaggcggacgacggcgtcgaggtcccagttgttgccgcagagctcctcctccatggccgtcgagaagaaatcaagaaaatcctcaagaggaggaggtggtggtggtggtttcttgggctctagagaggagataagagggaggcgctgacttttgctagtttattgattgatttggaagagagaaggagactatgggaaagggtaaaaggagagagagagagagaggaggaatggtggtgatggcattggatcctgccctaaaaaggagtgagggctactggtctattttcttgggtttttttttctttttcttcttggagggaggctggttttataggggtgtgggggcagcacaccccccacttgactctgcagcatgtcaaaggggtgagaaaggggatactccatgggtgggaggggtataatgggaaaagctcactgtgattttttttggacttttcttggagaaaatgtatacctcctgtattggatttaagaaaatgggaggtgatcagtatatttgggaatgtgttttgttctgaggtacaaataggcacataaagaaaagcacacttgtatggtattttttgtcgcttttcacatatgcaaaactggattttatatgcacactagaattaaagctcaaatgattcctggcttctaaagcatgggagtagttgcttcttcttttttttttgttgaaggtgcatttctatgtacctatggcttattttggattttgttccgatacaccgtgagagcgtgtggagtcaatattaggaataaactcgagctgccttgctagttattgccagctgagtaaattctgattctccaaatctgttttgttttgctctattaattagctaggctggattttttatacgagctacctaggctgaataaaaaatgtgttctactaactaaatacaatctatgtgagatatatgtagatttacatctatgcgcaaatgaacccgcactagaattttataaggcccgactcgaatgggttggacttgactctaaaggtaacccatctcgaaggatgtccccggaaaaagaattacatattagtatcaggactaataataatgtaagttaacaaaaatggtactatttgattgaaaaggaggggtgcgcttgtttgctgacgagaacacattgatgtcggtcagttttttgcaactaatttttatttggttcatgtcgtattgtatatacaaaaatagactgtctatacacaccttacctaaaaattgttataatacatgcaaatgctggatatattggctatttgattggctagctattttttctccttagttatgatctgatcaataataactactgtttggttcacaaaacatgcccatgatattctcaatttctggtaaaatgcattggcaaatggaatgagctagacaagaggggtctaacaggacactacaccttccatgctacattaattagaaaatttgatttgggtgtacacaccttcacagtcggcgaatgtactagaagcacgttatctaaaaatgggacatgccacatgagattgttttgcaaatcagtgctccagttcataatattaattaaccaatatacatacaccatcaacacattaacatagttaaactagtcatgtcccatttattatagagtttaattaaaactaggaaggtagcccgcgcatacgcgcaggcgtgttgtttaatcttgtttgcacttttattacgaatgtttacgtgtggatcatatttttgaaatatttttttgactctattttaaacgtatgttcaataactggtttgggcgtattacttgaaaatgtatatcctcaaatttattaaaaaaatgtcacaataatggagttagttcatatctatttgtattatgtgtgattcttccttttaaatttttggagtttcccaactttatataacattttttattgtgtatgttatagatgactttaagtaacattttaattttactatatattaatgaaagatattttctattaaaaatatagctaataatactacttcatctaatcaaacataaacttatattacttatattaccaccgtcacgtaaatcgaaggagttaacttttatcccaaaataatagaagaatttatatgtaactaagagaaagtgattttttttaaatactatcacgataatccaaagtacggtatcatactttgacaaatatctatagggtagtgcatgttagttcagtgtctgttttgtttataacacctattgttctaatcacatgagacacctttagtaatttggttaatacatatatatacttaaattagcgtatatattcgtcaagtggtttcttacactaaaatgtgatgtgaaattattatcataacattaattattacatgt

SEQ ID NO: 74652 - DNA, 646 bp, Oryza sativa
ccattgctacgttgtactagttcgagaaccagcgagcgagtagaattatctctcgaacaccaatggaagttgcggtgcgagagattgctacgtactggttcgaggaccagcgagcgagtagaattatctctcaaacaccagtggaagttgcggtgtgagagattgctacatactggttcgagaaccagtgagcgagtagaatcatctctcgaacaccaatggaggttgcggtgcgagagcttgctacgcactggttcgaggaccagcgaacgtgtagagttatctctcgaacaccaatggaagttgcggtgcgagagattgctacatactggttcgaggacaagcgagcgagtagaatcatctctcgaacaccaatggaggttgcggtgcgagatattgctacatactggttcgagaaccagcgagcgagtagaattatctctcgaacaccaatggaagtttgcggtgcgagagattgctacgtactggttttcgagaaccagcgagcgagtagagttatctctcgaacaccaatggaagtttgcggtgcgagaggttgctatgtactggttcgagaaccagcgaacgtgtggagttatctctcgaacaccaatggagggtgcggtgcgagagattgctacccact

SEQ ID NO: 74653 - DNA, 5142 bp, Oryza sativa
tagggacggagggagtatagcttttttaaaatctcatttcctctcgcctctccataatgttacctttttttattgttgaatgaccaccccttaatccttctacgcagtggcggagtcaggaatttaatcctgtcgggttagttactagcactggtttgtatttaagcgaggtcatttctttaatttttctagatatatacatgaaaaatcaaggtctacaggggtattgtttaaaatgctgtgggtcagcggatcccacaatttatacatagattcgccactgcttttacgtagtcatcttacttgatcatcggccgatcacgttctctcacctcaatttcctatgttttattcccgttgcgacgcgcatacacgttgctagtcctatttaatattgaagctaagaaggtggtgaatatttatatatggacgtaaggaaatccttagtacttctacttaccaatagagttagacgaagcttccacactcaagcttaaaaattacaataatgctcttaatcggagaaccgatcctaggcggaaatttaaatgtccacactactcaatcactcactcatttttttatgggcttctaaattaagagaaaagtacaaagaatcccttgagaaacacataatagggataaactcaaagttgttttctatcatatatcattataagagcaagttttatagtggagatggcaactatatctccagttttagttgcatcatccactcactgattaagaggcaacatgtaaaacaatttaccttctacacacaaactccaataatttttattggttcactctcacattatctcactttatttttggtgtttgtataaaggttgctctgtgcatgagtggtgtctcaccctctcttctcacttctcttctccatcttatcacataattctttatggcatttctagaggtggcatttttagaggtagcacaaaaatctgatctagtagtacttgctctaagtgttccttcttattattaaaatttaaatggtaaactagaatttctgtagtggtatggtcagactttttttttttaccgagaaagataatactccctctgttttaggttataagacgttttgactttgatcaaagttaaactacttcaagtttaactaagtttatagacaaatataataatatttataataccaaattagtttcattaaatcaataattgaatatattttcataataaatttgtcttgggttgaaaatgctattattgtttctataaacttagtcaaaattaaagtagtttgactttgaccaaattcaaaacgtcttataacctgaaacggagggagtagctaggaggagccgaggagctaataatctttaaattatttaagtttacgagtataagaaatttaaatatttaaattaaggtgctaagaaatctctacgaaaacaggcttggttctaggttcaaacctaggatcatcattaaccgacacacaccaaactatagtttccatgtggtatgactgacaggtgctttgtcccgtactttcctattcatatttatgcatgtgaggttgatgcctgccatgagcatcaaattcaaccgggggtgcaatgcatgttcgaaggttgttgggtgcaatgcatgttggaaggttgttggattctgcatgcacatcccatcaaacctacaaccccctgttgttaccaaagggattaattagaaaggtgatgtgcctgccctcttggtatattatttgaggcacaaattaagtgctcaatagctcgttctatcatgcggcttcctgttcctcctactcccaataatttgtgcaatgtcatgtcacgaataacacaaggttggccggcctttttgtgtggaggcggccagcgccgtaattcacaagtggtaccatcgtcttatccgtgtcattatcgttacggacctggttcataaatcttgtagttacaaattactttctctaatatagtagtataattggatgcacccgacactttgatatcctttttaagtgtgaacaaatatttctcaattttgaaagtgaatgcgagtgatattgaaaaaatgatggatcgaatttgtctaaataaaacttttattgcatttcaaattaaaccttgggattactatcaatgtcaaagcaaggatttagatatatagggaaagagtctaaataaagactattctttccgtcacaaaatataataacttgtgaacatttttagatacataacataaaaattactatattttaagataaaggtattatttcttaacttaattacttgattaattggataaccgtaaatgaaaaaagttggcggagggggctagccgtctgacggtccctccgcgctccatttcctgtttttttatagagaaatctacaaaccacttaatgacttgactcgcgaggtcgtggtcagtaaacataacatatggttctttcttatcaccagaaactcgatcaatcgagatgtgatgagagcacttggagtgaagaggataatgacagtctctgcatctctctctctctctctctctctctcctgatcaactgtccatcattataattaattatttgcatcatacccaaatcccaacagtggcctccaacgcatctgtctccctcgcttcggtcgctcgaccaccaaaattgccctgcactgcactgtgcggtgcgcctgcctgttcatcacagctttacaatgattgtgtagtgcaccatcctctgttcccgttctagattcagatgcatatatagcaaaggagtgtgacaaggttagggagctgtttgaatgccaaggtttcaaaaatcgtttgccgatcgaataccgctcccaaggggtttcttctgttttcgcagtaaccgactgaatttatcgaataaaataatctttgtttgattttttaaaaaaaacttgaccagtttatcgagtggcttctcaatgtgggagcgattcaactaattaccattgttttcaattataattgttggttttgtgaaccatgttgaatatggtattcactttgacaaaactttgaaatgctaaagagaaattaatctcattatattttctcagcagagcacaagttctgcaaaattccaatatgaaagttgattctacaaacgcttaacttattttcctctctctgttagccttagccaacctcctttttcaatgactaaaatactctccacattttcctttttagaattcttgacgaatgatatgtggcgcatgtgtttgactattgacgaatgatatgtggcggcagcccatgtggtaacctggcccagtgtcttgtggctttgtgcatgctggccctgcaaatttgatgggcctgtacttagttagcttcagtgctctacagtagttttggcccttcggcgagtcatttcacggtaaccactacagtatattctttattgatactacagtagtagtaagaaatactcctactaagtgataccccgtgcttcacagtatgtatggataaatttgtattaaatattatagaaattatagataaatatatgttaaaatattataaaaattacgtgaggatgatgattggaaatatttatgtgtaccatgtttgagtaagatgagatttaaatcgctatagaataataattgctattgaacgatgatatgacatatttagatgatgatcggaaatatttatgtgtaccatgtttgagtaagagataatagttgtgagcgagtgtcaactataagggttatcgtcaattggatttcgcttacctttcgagaagagaaaagaaaatagaggaaaagaatgtagaagccattgttataagacgtttttacttaggtaaaagtcaaactactctaagtcaaactactctaagtttaactaattatataaaaaatagtaatatttacaacactagcatagtttcattaaatctaaaattaaacaattttttataatatatttgtcttggattaaaaatactagtactacctttttcctataaaattagtccaacatagagtagtttgactttgaccaaagttaaaatgtcttgtaacctaaaacggagggagtaaatatttttttcaaatacatataaaaaatcacatacacatacataactatgcgcatatattattgaacgcgcaaagatatagtctagaaggggggggggtgaatagactttactgaaattcacaaacaaatcgcggcggaaaaattcagcaggaccggaacttccgggtgtagaacaccgaaacttctggtctgctcagactgtccggaacttccggtgttctaaataccggaacttccgagcaacagaaaaactgtaaaactagcggacacttaaattaaattgcacgaaatgaactataggaggacagagtagatacacattcacaacaacatgcacagaatcatcacagagaagacaaaggcgattttttcccgaagttcggatctttcgatcctactctccgttgaggtgctccaaagagccgggtctcgattaaccccttgcctcacctatgcaaagaactcagaagaagtccaaggtcttcaactcaacactcctaggtcattttctagaatttgagtgaccaccagatccaactcacaaatccttctagaaaagaccacaagtgcaagttgctctaccgaggagaacctctgaaatctcagcacaagaatctttactcacttacctcgtttccttgtggaggtgaggaaaaccttcacaaactttcccgagacatccacaagatctttgaaagctcgcgggcgacacctaaccgtctatgagatgatctccacgagtaataagcctcaagtgacagcccacaagatatccaaagtactcaaccacaccagtattcaaagcttctccaaatcactcctacactctcatctattctcacaatctcacaagaaagactctagatttgagtggaggaagcaaagggatcttgggagaggctagaacaacctagggtgtggaagaactgaagtgaaatggccaaaaggtgtgctgggtgtgatttggatatatataacggctaggtgatgtcatctagccgttactcacaattttgaactggaagaagtccggaagttcctgaccct

SEQ ID NO: 74654 - DNA, 2394 bp, Oryza sativa
agaggatccccagcgttaaaccgtagttgatttaacatcggggacacttgcacagtagatattgtataaaaaacatatctaggtagatataataaactaatgatctgacaatactgtatgatctgaatatgtacggtaaattgcatataagatattgcgtacctttgtagatatatgccggatatatctacgaaattagtagatcaatttaaaaattaatcttactaactaccttgggagacatggagtatgtgtcatggaaacacatataagagctctgtacggccaatatgcatgcacgtgcgcacatgggtgttggcccggtacagggacatgcagagtgacgtcgggctgtcgactgactagaaatcgtgttctagttagaaaactgtagtactaatccagcggtagatttttagctcctcgacgcgcttgcttggttggtagggatcggtgtcgggttcgacttggactcggcccgccgatgcctcacaccagttgatgtcgcacacgtcgacggatcaagctgccgccgacatcatggttctccacggcggtgattagtctcgatcttgtcggaagatatgctccgttcgggttagatctcccacggccgaagtcgtcgagtagcttgttgttggaaaatccatcttttaaacccttctcgtcgaaatcctgaaacaccaaaatctctctacctggcgcgccactgtcgacgtttgatgtctcgactacggtatttgcatagcatggggatcgttggtactaggatatacacgagactgagataaaagagatggagacaaggatttttatactggttcgggcccctgaattgtcaggtaataaccctacatcttgttggccaagccggtattgctcttattcatgataatcacaacagtacaatatttggggtagcctatcttactgttgtcgacatggcggtctgacgatctgactcatagtcgacaacagggtagccttcctcctcgaatccgtgcccggcgagatcagagatagcgcttttgtctctcctgacagtatccggagacaccgtagggtactagccgtgcttatccctgaagtcaatatccggcggcgtgtcttgccgtatgtaggcttctatattatggcttctgtgtcgattatgttgggtgttgatcctcccccctctccttctaggggggtttgtatttatacccataggtgtcaccttgtctaagtagaactagggaaaccaatatggatacaattcgagtagtcctttttcgtctccatgtagaactctggttgtctttccttatccggaactcctatatccgaaggttgcttccgtataggacatggtatgtagtgggtcctgccgagatttagtcaactactattaggtatatgggtatctataaccctgacagatctctgtccaggaaaattgtttgtgtagtagtggatgatagtcctgctttatccagagaaacagtacttgtcaacttagcacattactattctgttgggtaaggtaaaaaaaggctataccgttatgaattgaggagaaggaaatattaaatttcagaaaacaattctggaagaagtgtgtaagtttggatcctgttaatacaggtagtatcatttgctatacatgatatgttttgtaacttcttagcttaggatcttatctttttcgtttttgcttatacttatcagttaaaatttaaattttcaaccttaaatttgaagctgattttaaggttttttcatcgaagtttacttttcatcatttatttttagattgctgagaacacgtatataaaaattttatacacagatcgcttttggttttgtaaatatgccgagatggggctgttagtatgcctcgacctttcgtgaggctgtatatgtaacatgtgtacgaatctcccgacaatgtgaatatcatgataatatctcatttgacagttgaaagtttattttattttggtgcacttcctatgaaaagtttcgttttgtatgcttatttctttggcggttagctctttagagcaattttaatgatatagccaactactaactccaaaaattaaaacatcatctataactaatatagcagggtattgtatagtttgttgtagatatatacttcattactaatacctaacatatctatctctctcacatagtttattagagctcgtgctgcacatagtttcttctctcatctcctctctctcctctggaaatataaatatgatcactgggggagaagtggtttttactcccggttcgtaacccccctttagtcccggtttttcaaccgggactacgaatccgggactaaagatcgctatctttagtcccgggtgaaataaccgggagtaaaaaacgatctctagt

SEQ ID NO: 74655 - DNA, 29981 bp, Oryza sativa
ctccccccccaaaaaaaaccacgtcctatacgccgggtcgcgccgctcgtgggggcaggtacgcacgcacgcactgtcccgcaacacgatccaatccacctcgttggcacatgcacgaaccgcaccgcgcgcgcgggtgccgtgagctcaccccggacgccaccagttttgtcccggcccgatcgcgcgcgcgcgcgatcccgcgacagcgatgcgcgtttccttggagccgcacccgcgtgtgtacgtactccactactccagtccagcggcaacgcgcggcgcgcggagaggcctcggttaataccaccaggccaccaccacctctgcgctatcctctcgtttgcggccggcgcgcaacgagccgacgagcacgcacagcggaatctgccacatccgcgcgcgcgacgccggagcgaacaagcaggaatgtcctggcgccggtgatacaggacgacagggatggcgcgtcgtatcatcaccgaatactaagggtgtgtttagttgaggaaatgaaaatttttgggtgtcacatcggacgtttgaccagatgtcgaaaggggttttaagacacgaataaaaaactaatttcataactcacctggaaaccgcgagacgaatcttttgagcctaattaacccgtcattagcacatgtgggttactgtagcacttatagctaatcatggactaattagactcaaaagattcgtctcgcgattttctccataactgtgtaattagtttttttatttatctacatctaatgcttaatatatgtgtccaaagattcgatgtgatgtttttgaaaaaaaaatttaggaactaaacggggctaactgcaggcgccagtgcgctcgacgcttgtaaagcgaagcgagcctcaatgattgagagctctagcggtagccggccgtatcgccttgtcgctgtcgggatcgagcctgctgtgacgcactaggcaaatgctgcattgctgttagctataggatactgactgctttgatcggtaatttggagttttggacatgagcgctgcaccttcatcgatacagacatggatttatcatagctaggtgctggtgaatgattgcctgattagccgactagccgtgtgcagactaagaaccatgttcggataggttaatagtataataatacttgaagaagatattgtcgatacagacaggacgctaattaagcatgctttaaggtagaagatgaaatcagatgcccctttgccgcgcgatgctttgcattgccagatttctccgggatatctggtctgaatgaagtagtgcgaaggtcaaattatggtccagttgctgacgaccatgcatggttctcgtgtcgtgagattgaccttcctaccccggagcatcagaacatggctgagctatcggcaccgatcgagcaaagcagcaaattcagcttgatcgaccggtcgagcagaacagcaaattagctcgatggcacgtccgcacggagttgcggcagggggatagttacatgttcagagatttgactaattgacgaaaacttagctgaaacgcaacacggattaattctacttgatgcgaatgaaacgctgatgagatttattcaaggttggctgcctcctcgcaaaaaaagaaaaaaaagaaaaaaaagaaaagagagagagagagagagagagagagagagagagagagagagagagagagagagagagagagagagagagagagagagagagaggtgtcttcctaatgcagcttgatttgttgaacatggagccatcagccatggagtgattgcaatgctcagccagtcattacaggtagcgaaaagaaccacctggcctattagaaacagagcacaagcacaagcacaaagacacaaaatgctagtgtgaacaaacaaacaaacgcgagtgaaagcggatacattggattcatacatctgatctctagagttggtaaagaaaaatacatgcattagtaggatatatttaaacgtacgtcgcaggattaagactgtcgatcgagatttgcaagccaatacattcgcatgattcagggcagccggtacaggatcgtcttgtccgtattcaattggattcagaaacagaaactgtacagttccatttgtgtctttaacaagtcggctggctttctcgtgatgattcatcagtcaatattgtcatactgtctgtgataattatctttttataacctgacaacactgatattgtcgccacatgcagaaatgccagtgctgtgcggatacgtgcaattgaacttaccatccattccttttccttttctttgaaggaccaatggaacttatctgcaatctttttattcggaaaccgataaacaatctgcaggttgctgaccacagaaaacgtactgaaatgaaatgcattgttgataacaccgacggtttttctatttttcaaggaacattatcaaacattgttgctgctgcccctggccggcaagactatccattttacggtttacggattagtgcacaaaacacgccatgtgataaaacggataaactgttctttgccggccactaaactaatcatcagtgatggtaacacggtacatttctgggacaccgcttggatagaagggcaaaaaccataaacataatgccactagtttatacaataaaaaaaggaggaaaaatctctgcgtgaatgcatgaagaagatctaaatggcaaaacccacctcgcagtggatctgatcaaccaactcgtatccctgtggaacgcaacacagggcatccacctagaacaaacgaggttgaccaaattgtttggaagctaacgaaccatgagaaatatttgactttatcggcataaaagacgcaatgtctgggaattataggcaccaatttcaataccttaatgatctggagagcatggaccctgcaaaaagcaaattctatcaaaatagcgtatggatctcggatcgactcacaaccagaagctggccaaacaaacaacgggcactgccccctctgccaccgaatctagagcctaatagcctcttagatggcatatcaacaactggaccgagccaatgggaaccaagccaaaacgttaagcttgatgggaaatgttggccaacaaaaaggaagtacccaagaaatacccgcgcaccctaatcccgctagtcatttgggagatctggaaagaaagaaaccaacgagttttcaagcacaaagagaccacgacacctagcctattgacaaaaataaaggagaaagcaagaacttgggctttggcatgtgcaaagcagcttcgggagtttctaccaaactgcataagccacacgtaaaacattgtacggaacatttttcccttactcttaggggctatatttttttcacccctatatatattcaatgaaatagcacaatctcgtgctaattctattttaaaaaaaatattagtgcacagaacgaaatggtccatcatgctgggttgttgtttctgtgtttcttttgaaccacaaggaggaattggaatggtaatttgagattttttttttatgaaaaatgaatcgatttaccatcttttcctgcattgccattttgccagatttctttggagatcaatacaattcacatttggattataccctccacatagtatatctcatatgtttgggaattggcttgtgggtgttaataaaaagaccaaggaacttatttttgttggagcttccgctatatgttaggctctctggcttagtagaaatgaaatggtttttgatagaccacctttaaaatcttatttgcgggttcttttcagggcaacatattggctccggaaatgggctcaattacaaaggcatgatgatcatatcaagctaataaaagatgtgtatcgtaaacttaagtcgatgatcatgcagatctttgtcaatttcaggtggaaattcaccaatataatttagtagttgtggggtctttagcttatttggtttttattagtttgcttctacttttggttttgttacttcagctacatacttaccgtgtgagtttgcttttgtgaacattacaataactagcatggtggcccgcgcagattacgcggctagcatcattatattttctctcatataatagcatatatatttttttattatattgttaaaatatattacaatgacaacataattttaaattttgcaataactttacgaaactacaaatgtgtaatattcatactgtattttatatacgtgttagttattaattatttttaatatcaaattttagttatttataaattatatatattcctatatggactctatacttgtcttttaataatttttttaattctgaatttttattatttctaattgtatttctatgtgcactctaaactcatctttcaatattctttaattttaaattttaaatttcagttacttctaaattgtattcctatattgactttaaactcttcttcccatgtttttcttaattttgaattttagttatttgtaaattgtatttttgtacggactctaaacactgcttttcattttactatgtttattctgaattttagttagttttaaattcctatatggactctatactctacttctaatattccttttttttaattctgaatttctatttttttcttaattgtatttctatatggactctgtactctacttctaatattccttatttttaattccgaatttctattatttcctaattgtatttctatatggactctatactctacttctaatattccttatttttaattccaaatttcagttattttctaattgtatttctatatggactctaatctcctcttctaatattccttatttttttaattccaaatttgaactatttctaaattgtatttttgtatggactctagtctcctcttctaatattccttattttttaattccgaatttcagttatttctaaattgtatttctatataaactcatatttcaatattctttaatttttaatttcaaattttagttacttctaaattgtattcctatattgactttaaactcttcttcccatgtttttcttaatttagaattttagttatttggaaattttatttttatacggactctaaactctacttttagttttattatgtttatttagaattttagttagttttaaatttttgtatggactctattctctacttctaacattccttattttttaattctgaatttctattttttttcttaattgtatttctatatggactctatactctacttctaatattctttatttttaattctgaattctgttattttctaattgtatttctatatgaactctatactctacttctaataattcttatttttaattccgaatttcaggtatttcctaattgtatttctatatggactctagtctcctattctaatattccttattttttaattctgaatttcaactatttctaaattgtatttatatatggactctaatttcctcttctaatattccttattttttaattctgaatttcaactatttctaaattgtatttctatatggactctatactctacttctaatattccttatttttaattccgaatttcagttatttcctaattgtatttctatatggactctagtcttctattctaatattccttatttttaatttcgaatttcaactttttctaaattgcatttctatatgaactctattctcctcttctaatatttcttattttttaattctgaatttcaactatttctaaattgtatttctatataaactctgttttttctttttctccgattaatatgagaatttctaggccatgagagcgaacgtggaaactcatttttctattactttaacaatataatagattgactatagctcttgagcggtcaggatgtttcatttcattatcataaaaaagcgggtaggaaagaatttcaaggattagttcatgacttgctatgactgtgagagacatagaagaccagaaatcacttacgtcactcctcgcttgttaattacagtcttacttgcatatatgatctctggtttgtgtttaaaggctccaggtcggttcattcttaaatagcaagagagttcctctcatggaacgtcccacatgatgtagccacctgacatgtcggcccgtgagtggttgaccccatatgtcagtgaccgtcctaaatagcatggcgacaaccgggcctatcaaacgctgattttagtggccctaacttagattagggtctattggacctatgcagcgtactcactgtacagtatgactcaggactcggtcggcgtcggtcggtcctaaccaactggccaccggccgtatagacgccatggcatgtggccgccgagtcgccgtggtgccacttgccactagtaccatgaacagcagcagcttatcaggctctcatgggatagcctaatcagctaaagaataagctaaattttaaattttcaaacttaattttaagatatttttaacgtagtttttttttcaacattgacttttaagtcaccaaaaacacatatataaaagttttacctataaatttatttttattccttaataaaccgttttggtttattagggaaaaagccaaacaatggggacctcacctagtagccctgatttcggaaggctcgtgtcaaatccttgctaccctctcacgtgacacggcctcgctctcctctcaccggagacgcgtaactgcgtcagagactcagaaataacacaccagccgtgcccgtgccgtgtgtttccacccatagatcatgtgctccctccctatcttgaggtcgacgcgtcccgtacgttgtagatcgatgcacacgctgatacgcattgccatttcggttttacctcttcgggtgtacgttcatcgatcgatcgctgcaaatccttggagaggattgatgcggcaaaagctttcgtccggtgttaattcagccggtgaaagaaaaggtaatggccgctgtgtcggatgacagagatggccgcgtgcaattgttcagggtgaacttgacggggaggatcattaggccctgcccgctcggtcacggctaagccctgtcaacttatgtttagggctggtcttgggcttaggagtggatgtgttgagctcggttccaggttctaacctaatcacctatgctcttttgcatgctctaatctttcaaaagtgggtggcaaaaagcctatggaagtactaatactaaatgttcaaaaaaaagtactaatactatgttagtggggtatggggagaattaattgtgctttgcaatttatcactctaccaaaaaggatcatatagaataagatttcgaaatggcatgtctagaggtttctcgaagctcttttccaagctcgatacaatcaagcactgaaaagaacctagccatggataacgttgacttgctgcctaccactatgcgtctacggcggattgttgtttttgttttcgttttgtcgatgttctcgtctctcttatttttctttttcctttttttggcaaaagccggatttattgatttacctgagagcccttctccattttcttatgtttactttaacctgttaataaaaccataccatacgctaggtgagccattagcgcatgattaattgtgtattaactattttaaattttaaaaatagattaatatgattttttaaagtaactttcctatagaaaatttttgcaaaaaaaaacgtaccgtttaatagtttaaaaaacgtgcacgcgtaaaacgagtcacaatctcccctatctcccctaaagaacgcagccaagttggtttgaattatacctctcattatatgcttattacctgtaagtctaactaaaatttaaattttaaaactttattttctttctagtattggtttttaagatagctaataatatatatagaaatgctttatctataagttatttttagttgcttcgttaattgtagctgaaacaatcatgctctgaactaacagtaacaatgtacggtgacgatcatgggtggtcggcgtcagccacgccgtgactctcttgggctttattagctctccctgcagtctcggtgtgttatatatacatggctccatcccggtacatgtaggggcatgtgaaggacagtagcatctggccaccccgctcttcttgagctagcgactccgtgcttgagtagcaaaggagcgagtgagcatttggttctctgccatggcgaccacaacggcagaaagggatggagttgaggaggagcagaagaagaggaagcagggaggcttcaggaccatgccattcatactgggtgagtatttattgtaggattcacttatatgagaaatttttggtgaaatgatctttcggttcacttttagatagatgctgctcttgctcagtagcatctgctagctgctctgcttgtagattgagccggcaaattaagcaaacaagatagcatagtgcgcagtttctgggagagtgagttgcaatctgaatatctgatatagatgcccaagctgggcggtaatcccgtccaaaactactgcacatctttgcccgtggtttgcattttatttttttttatgcacgaaaacgtacggttcgcagttctcggaaatctggatctgatgccttgccgatgccagtaactttggtaggtttgtttgtttctagttcttttattcatcttttctttctgacggcaagagagagtgatgttaattaactgttaactgcacccatcagtaacaaaataacgccttcctatgttgttttgggaattaaaaagacataacttttgctactttattactccctccttcctataatacaagggattttaagtttttgcttgcactgtttaaccactcgtttcattcaaaaagatttgtgcaaatataaaaaacaaaaatttgtgcttaaagtattttggataataaagtaagtaaaaataaataaataataattttaaaattttttgaataagacgagtggttaaacaatataaacaaaaacttaaaatctcttataatatggaacggagggagtattggattacataaataaaacgtatacatgtgtgataatgtgatgaaagcacttatcatgacaaacttggcttacgccaatttttgtatgtccagaatgaacctatgcttcaatgcttgtatcacattctcttctatccaaagggagtatatcgttcacttcccgatttctattcagtctagtcacaccgtgtaacaagaagtcatacctccgtattttaatatatgacgcccgccgttgactttttgtctaacgtttgaccattcgtcttatttaaaaaaataatataattaccatttattctattgtgacttgattcatcaacaaatgttatttaaatatgacataaatatttttcatatttacacaaaaaatttaaataaaacaaatggtcaaacgttgttcaaaaagtcaatggcgtcatacattagaataaggagggagtaactgataataaatttgatcgataatattaaccataattaacgatgtaattaacggtcgagttgcagctgatgtgtataatcatcggtgtatatccatggttgtcgccgagaaaatctcatgagttgtctccgttgcagcgaacgagatctgcgaccggttcgccacggcggggttcggcgcgaacctgatcacgtacctgacgcagcagctgcacctgccgctggtggaggcgtccaacacgctgaccaacttcaacggcacgtccagcctcaccccgatcctgggcgcgctcgccgccgacgccttcgccggccgcttctggaccatcatcgccggatccgtcttctaccagctcggcatgctcgccctcgtcgcgtccgcgctgctcccttcgctccgccccgcgccgtgcgcgccgacgcacggcgccgcgtcgtgccgccgcgccaccgggtggcagctcgccgggctctacctcgccctgctctgcacgtccctcggctccggcggcatccgcccctgcgtggtggcgttcggcgccgaccagttcgacggccagcagcagaagcagcggcagaagggtggcggtggcgcggcggcggcggcggcggggaggaagcggagctacttcgacctctacttcttcacgatggggctcgcggtgctgctcgccctgacggtggtggtgtacatccaggagaacgtggggtgggggtgggggttcgggatcccggccatcgccatgttcgtctccatcgtggtgttcgtggcagggtacccgctctacgtcaggctgaagcctgggggcagcccgttcacgcggctggcgcaggtggtcgccgccgcgttccggaagcgccgcgccgccgtgccggaggaccccggcatgctgtaccaggacaaggagctcgacgcgctcatctccaccaatggcaggctgctccacacaaaccagctcacgtaagctttttttttattattttctttcctactgcacgtccatttcccgtgtcattgtcttcacttgggcagtaaaacaatttagcatagcgtgcacgtgacggccttggtgtctgtggtagctactttttggcggtagatacattgtcagggcagaaaggagaaagccaagcgagagtgcgctttcctttgaaagtgcttcctctttcttacctagtcacacaagcactgcccctaaagtttagatttggtgtcacatctctatctctagctattgtatcttgtgaccgggagaaaactagattaggttgaatacttattttttcgacgttagagtaggttgaatactaaattaaacacacccactattttagtttcctcccttccgatacatagcatttcctttctgaacagttcgttgccttgcgagttttaattggaataaaagaatatttgcatatacaataaacgggtttgctaaaaataagacgccatatttttcacttaatttcagtcacttttccataagtgatttttctcgctcctgtatgtaagtatgcttccatctctcatatttcctcttctaagtagataataaattacttttaatccctattctcctatatattgtgtattagaaaattacaatgtaataaggaaacatacaatgtacaatgtaattacagtgtaagttttaaaatttacagtgtgattacaatttaaatgcgagtaatttgcaatgtaaaaatgatttgattatttttatggaaaatatagctacatccgattttgcagtgtttttgtctatccgatgttcattttttgaatggaaattaaagataaggtcgaaatgtttacgttttttttggtttttttggagtgaaatgaattagcttagtagtttttgtttctattttgaaatggaaatataaatagaaataatatgctctatttgtaaatggaaatgaacataattaaacaagcatgccctttgtcaggtcgtcattattaacaattatttcaatataaacagtgattattttttaccaagatatattataaaaacatccattgcacgtgcacaattattagtgttttttttacttcataagataagtgtaaatttaaaaggtaatatttaaagcactttaaagcaatcttagtatttgttttgatgtctaagtttaaaagtttcggctgtaattttcaataatcaaagtatgtttctcaacgttgttttcaaccatgtgtatttttgaaatatcgttttcacccatgtgtaaagagaattttttgagccacatcaaaaggactgagcccgatatgttcagatttctttttgacatttctagttgttttttactttaaacccgtatcattatgagaaggggcaatatatatgtatcaacataaaagatagatatatatgtattgaaggataagtattgataaaattcttgaaaaaacatatcgcaagaaaatatttgatttgtattctaggtcaacatagatttacgtccacattttctcaagaattaaaatgatttatctccacattcatgacataagcagctggtttaaatataacaatgttgtaaaacacatattttctccgaggagtgtacactcctacataaaaggggtaaaaaaaactcaacagtaggtgtttcatgaatcacgaggaactatatatgattaattgatcattaataattttcaaagataattcaaatccgcttataatgccgtactggaatgctagtttctttttcctcaatacgggtctaagatacaagcccgaaggggaatatactatgaaacgtactgtagaataaatgcttgcgtgcgtcataacgaaataaatttgccaccattttaagcagtctattgtgatctaacaagacaattgatttttcgacttaattaactgaacgactattatagacggttccatcaaaaatacttgtgagccgtttgtgattaaccccttctgctgtagtaaccgtcccgtgccgtgctaattcgttcaggttctttgaccgagctgcgatcgtgacgccgggtgacatcgccggctccggcgagccggacctgtggcggctgtcgacggtgcaccgcgtggaggagctcaagtccatcgtccggctgctgcccatctggtcggccggcatcctgctcgccaccgccgcgtcgcacaacggcaccttcaccatccagcaggcgcgcaccatggaccgccacctcacccctcgcttggagatcccgccggcgaccatgtccatcttcacgacggtggcgatgctcgccggcctcgccctctacgaccgcgccttcgtgcccctggcgcgccgcgtcacgggcctcccctccgggatcacctacttccagcgcatggccatcgggctgggcatctccatcctcggcgtcgcgtcggcagcgctcgtcgaggtgaggcgccgcggcgccgccgcggaccacggcctcctcgacagccccgccgccgtcgtgcccatcagcgtgttctggctggtgccgcagtacgccgtccacggcgtggcggaggcgttctcgtcggtggcgcacatggagttcctgtacgaccaggcgccggagagcatgcgcagcagcgccgccgcgctcttctggctctccagctccctcggcaactacatgggcacggtgctcgtcacggcggtgcagcgcgccacgcgcggcggcggcgagtggctccaggacaacatcaaccggggcaggctggactgctactactggctcgtcaccaccctcatggtgctcaaccttggatactacctcgtctgcttccacttctacaccatgaagccattagaggtggcagaggaagacgatgacgagaaggagtgtgagctctcctccgtccacaaaaatggcggccccggcgggttggtgtgacgaggtagattaggataattttatcagggtggataatgttgttaattacggagtacgaagtaattagctgtgcatgtgcatgccaaatataatggttgcaaaatacagcctttagggcatgtacaaaaatagagtcagatatgagtctctatattatttagagactagcatcttacaacagttagagacaatatggtttctaatcattaatgtatccaaatactttttcttactcttctttcctttttttcactatcatgcaacaaaatttgctctaataaatgctaagagtcgactctgagccattgtcatgcattacaaccatacttctttctctttcttccatatcatcaaatttacttgcatggcaacagagagagaccactaatgaagaccgttgtacatgagataaaattagtatatttagatactgaggtaggatccaaatttggcaatcatgaattcatgatcatgatcatgcagcaaaaggtaaccttgataaataaacatgatatatatcgtagccatgtggagagataatcgcagaccactttatttgttggagtacactagtcactgatccccacaaccggctcaatcaaagagccacatgcccacatggacacatggtacaatgtttacacgtaattcgtgcgtaagattgaattattaggcatctccagactagaaaatatcaactagttttcatacttgctatgttatatagatactatgtataaaaactatatatacaatggattgaatcttcaaattaaattctcatccaatcatctctcatctctctccatctctttttatctatatatccccttattttcatttttgttgagttgtttcttgtgtaaagaaggtgtcttcatctttttacctctctcctcattaactctcttaccacatcagatttttcttatgtgacagtgtatttaatgctacactacatgatatgaagggttagggatggccttagagagagggagatatttagtgcgcattatgatatatgtaaaaataacgatacaatcataataaattgctagctttatgcaccatccagatagacgtggccatgttgttggtttagtaagctactagtggaaaaactctgagtacagtcatgattcataaatttttgaaaggtaaaatgaaatctaaaaaaagaccaacaaaataaaccatcttatcatctcaaacataatactccctccggttcaaattacatatcattctacgtttgttctaagtcaaacatatctatctttaaccattactttttaaaaatccatgtataatttaacatgtaaataatatattatgaaattaatattttggtgaaacttaaaaatataaatcctatgatgctaaattatataaagtttataaaaattatggttaaagataaaatgtttgatttagaacaaataagtaatttgtaacataggaatacagttatatttttggagggacagagtactctcaattgacaaacctataactaggtaaggcaattttgcccataggtctacccggcccgatgggtatgagaatgggtgcaatattttacccgtggacacgcctgctcgagacctgacgatgtggtgggtagcagctgggtctcatttattacccacggataacccatgcctgatccggtgtatgtattattgattttggcccatgcttgcattctcataccacttcctcttggcccattaaccccacacacacacacacacacacacacacacacacacacacacacacacacacacacacacacacacacacacacacatatatatatatatatatatatatatatcccaacatcaaaccctaacctaatttccatcccacctcacatggcggaggtggcgactcaaggcacgtgcgggtaagcgacgacgacattggctcaaggcagcgcgtgggcaagcagcgacagcggcggcacgagcaagtggcggtggcaggcaatggttccagtggagtcggcggcgggtggcgctacagagtaagcggtgcaacgacgggtgccctccgggtatgcacgtgcccattgggcacgtgtatgggcacaaagttttgtccactaaaattattgggtatgattcaagtgagtattgtttttctctgcccatgcctgacccgacccgttgccacaatcttctctcagcaaaaccaaaatccattcaacaccaaaacatgaacttcatctgacgccagtgggatatggtggacgccaactatttgcctttcatcagccttggtggtcccctcttcatccatagccaatggcggcgctgctgtagtggacggagctctccatcctcaattccccttgatgtccaagggcgttgttcctcggcagcttttcttctcttccattgacgttcgattgctactcctggtccagacgccaaggcgcgtattgttcatcgcacttactctctggttggaggggatgacattgaggccaataattatattgtcataacaaaacaaatttacaaacttactggtcagactcatcatttggctctcattcaagctgctcgccgttcgtcgttcaagctactcaccgcgcacctgccagagacctctcctcggacgctcaccgtccaggtcttctcctctgatgagggcgggtgggaccctcctctcgcctgcgccattctccaggaatgcgagctccacagctacttacgccaagcccgtcgtcctgcgcggcgccgtccactggctctgcctcacatactcgcgtcaccgaatcctcgtcctcaagtgggaacatcctccacgcggacgctgcgacgtcgcttcgccgccgctgaaggcgtcgctgatgagactcccgacgccgtgccacacgacatgtgcctcgtgctatcgcaggcaacaaacgacgtcggcaggacgagccatcgcgctgcagcgtccctgagtgtggtcgccctcccaggcaaccgcatcgccgtctaggtgcgcatcaccgccgtccggcgagggaggttagtcgacatctgggagcgacgccatgtgatctgtgaggactagctaggagagcattgcacggccataggcagccgcatcaccagttttttaattattttctgttgtaactatcacgtagatgccacatcaatggcatcgtgtgacaaagattagtcaaaggaggtacgttggcatcatattagccaaaatcagggacattactattgaaggaacttgtttgcacttgttttgtaagttgagggacctattttatctggtatttcggttcaagaacgaaaatcgaacccactataaatttaagttaagatacctaaaatgaactttattcctttcagaacgaaagaaaaagctcactcatgtaacaacaccaattctgaatccagaccgtgtcaatgaatcgttcccatagcacgcgagacatctacattactgaaaaggaaagctaatcccatgatcccaccaaaatgagccaagtaatcaacaaaacaaaataatgaccattcgattcacgtggagacaaaatagcttgaaaaaatctaagcagttggataaaggaagtagcgatcttcttcttttttttcactactataaaacatcaaataggtgttgccactgtaggtgctggtagtactaaaaccggcatctacaggcctttttccacctccacgggttgaaatcgtaaaaaactagcacctttaagtaagtaattataggtgtcagttctaaacaaaaaccaacacctattatattttgtgtcttttttaaaaaaaacccggcatctataatatattataggtgtcggttaattaaaaactgacaccccaaaaatcgagccaaatagagccgagccaagccaagctggagccaagccggcgggccccaccacgacgaggcgataaggtctcgctctctcgctctcttcttcccgcctcttctcctcttctttgtctcgctctcttctctcgtctctctccctcccgttgccggctactagccggcggaggcggcagcggcgaccgcgccctcccctccaccagattcagcgggaggggaggcggctgcgacaggaggggaggcattagcggcaggcatagtcggcggtaggaggggccgacggggtcggtagcgggcggggtgtctagatctagcgtcggcggcggacggggtggctggatcctgcttcgacagcgagcggagttgctcgaggaggggaagcggcgggctcgatgaggggaggtgacaaagggcttgctggcggggaggagccctcccatccgccagatctggtaggaggggaggcagcggcaggggcggcaggctcgcggaggagacacagcggcgggcgacatcgtgacggctcgaagacaaccgaccgtgcgatgacgacttcattcggcggccagatcttcttcaacaaggcaagccaccaagccaagcaaatccctctctctaccattcccctctcgcttctccggtggtggtgtgatttttttcattgaataaatttgtgttgtgggatgaatccatctttgaatgttgtgggatgaatgttgtagactgctcggctcgatgtgtcggctcgatcgagccggctttttttttattcgtcgaacctaaaaggtgtcggttctaaggaaccgacacctttttaattttcaaatcagtaccacctcccttgtgccggttggaaaaaccggcaccgaaagaggtttcccaaccagcactaaaacctttttctgtggtagtgtttttagaaaaaacatggagagtctagaaggctcatgagcctactaagaaaaaggtattaaggttgtggatactaatatcacttcagctatgtacctgtcaatggtgttctcatgattaattattattacaaaattaagcttagtgttatttaaacaacctataaatgtatctaaagtattgaaagcaaaatggtttcaaagcacctcattggtccatagtggcaaaaaaatatggatcatcagattgataaaaagacaaaacaagaaaagcaaatgtgggccatcagatcaaggaagtagaaaaccaggtcaactgataatgatgagcaatctaggtacttcatgcttgattattttttcgggtgcaatgctgaaagatggtgaatgctaaggaagaaaagatgaagtagaattaggggtgtttagatgggactaaaactttttaaactttttagtccctgttatattggatgtttagacgttaatttggagtattaaacatagactaataataaaactaattcataaatgagagctaattcacgaaacgaattttttaagcctaattaatccataattattaatggattaattagacttaaaaaattcatctcgcgaattagctctcatttatgaattaattttattattagtctatatttaatactctaaatatgtgtctaaatatccgatgtgacagtgactagtccctgtttcccaacaccatgcttgtctgagttaccagttaaacataatatcaataatatcaatggtgattttaatcattgctttttatatataaagcaaataggctcatatattactgattctaatggtcgggttaaagttgtgcgaatccacaactccactggctagaacaactggaaatttctttcctgatttaataagcatgtactccctctgtagcctaatataaggattatttattttaaaaattaagaaattagcaaaagtacaaataatggtacaaaatatgataggatatagaataaattagtacaaaactgggcagtcgaaggaataaactgtacaaaagcggatatatgtgagagaataaataattattttgggatcataaaatttcttatattttgatacaaatttgaagaccaaaataccaaataccttacattatatggcggatagagtaattaaagatttaaatgcacatgcaaatatgcaatgccaccctttatcattggacactccacacactcgacctatcaacttcaagtcttcaactagtccactgttcgggaatgatccaattatttatttgtaactactcaaacgcgtacctaaacactgatgcgtacatgatatcggcttgacatggacagcaagccacacacaaggtcaagctcaggccaacgtatggcggacagtcatgacacgagacgagaaacaatcacaacctggaaggtgctacacgtacggtggagaagatgcgcttctctgatctccacgtctagtggcggtcgacgaagctcttgatggcgtcgacgagctcccgggtcctctcgccggtggccgggtccatgtcgacggcgtacttgttgaggtagaaggagtggctcatgccgcggttgaccagcacctccacgtccttgccggcggtgcgcagcgcgtcgcagtactcgaggttggtgtcccggatgaggtcgtgctcggcgacggcgaccagcagcggcggcagcgggacggactccagcggcggcgcgttcggccccatcgggcacgtgtacgggtggtccttggtggcgccctcggggagcgccatggcgaggaacttgtcgagcatgtcgagggtgaagaacaccgagtcgggcctcggctccagctccgacttgctccgggtggcgtgcacgaaccccgggtggagcgggatgcctccggcgacgcggaggggcgcccagctgtccgccccgtcctcgccgacgcgcgcgccgacgtggtggacgaggttgccgcccgagctgtccccgatgaggaacacccgcgagaagtcggcggccgtccggaggagctccgccgccgggtcgccgagagcggcggcgtcggacagcgcgatggagcggagccggcggagcccgtcgacgccggtgtcgatgtgcgccggcaggcggcgctcgggcgccaagggcagctcgacggcgaccaccacggccgggagcgcgcacgcgaggcgcgcgtagaagtggtggtacatgagccaggacgggtgggagatgcagaagccgccaccgtggagctgcacgacgacggggaggcgccgctcggcgagggcgacctcggggaggtacacgcggaggttgggctcgccggggaggtcgtgcagcgtgtggccgtcgcgcggctcggcgtaggcgggcaccggctgcatcagcgggagcacctcggggggacccgtccacgtgcggtcgacggtgccgtcgtcgaacacgcgcagccagccggacacctcgtccaccaccttgcgcccgaccgccgccgccgcgacggcgtcggtggcggcggcttgcacctgcgcctgctgcgactcggtggcgatggccattgctgccgtacgtacgtcaggctagtggcgttgcttccgccgtgtgtgcgatgcgattcgatgtgcgcggtgcgagagatggatgaagtggcgagggttttattgccggtgaccgagtggctccgtgttgcagttgccgattgtactactgggaagtttcgcacggaatatcacggcgattgccaagcaaaattttcccggattcgcaagcagagttgctgcagagtggtggagacttgacaggttaggagtagggtcgtgtgtggacttgtagagcgactagaccaaccgaatagcgagtgttctttttttattgcgaaaattatattgactttggtggttatagacgagattgcaagaaatgatcaggtcgtcctcaagtttcatactactacatgtggcctgtggccatgtggatacagcaagaagccaagaagtatatcactaatccgttcgtgaatctgaatcttaatccgtatgaactagggcgttcatgaccaaggacttcagtgttttgcaggttaggtcgatcggagaataacaacagggaacatttactatgctgagttataatcgaactccaaacaacaattttctcgttttctgtttaaacttaccgaactaaaaaaaaatgatgtctcttattaaaaaatgtctatatatatatatataataaatctattttttataataattattccctcgtcccgaaataaatgtaaccctcttgttacttattttattttagaatgaaagaggtaatacttaattaattatatgctaatgagttttcctgtatcatgtacctccaaatctcctccccaacctgttgtttgaaaagctatttttttttcagttcgtgcgaaagacaaagtaatttctgtagaattcgtacggtaagttccaaacaggacgcaagtacttacatctggagtacgaatttttctctccataaaaaataaaaaccaatcctaattacaaacctaggtttatctttttttaaggacgaaatagtaaagaatgaataaaaaatttgaaggtagagaatgaacaacatccttatatccgttggatctaatatggatgggtcggaccagatcgtttgttaccgttctaatgctacagtaccgttccacatttttgaaaccgggcacagtgatgatatggacgtggaccagacctttctactactgttctaatcacattttttgaaccggacacagtattgccacactgatctgcattttcaccgctgtgcgccacagttgctccacgactttgcttcttcttcttcatcaggtcagaagttcagtcaggcaagtctttctgtgcgcgtgcgtgactcgtgcggccctttttgtgcaaaccgtggggacggatcgcgcgataaggtgaattattcgaatcgtctttagcactccaaattcgatcaggcagcaggtgcagggtcgtatggatttggagctttggacggaccagaggagggacaggattagtggggctacagtaaagcatcagagtaatcgccatcagcctatctagtagtactactgtatgttgggtctcttgaataagtcggtcagtcgttgtggtcaccattcaccaatgtacaaattaagcaggagattaaaatactactgtaccattcattaatgtagaatgaaaacgagaagtgggtattactgattcgatgactaaaacgagaagaaaaggatgtaatagtaaagagatttagggtgtgtttgagtagaacgggattgaggagattgagaagatacgtaaaacgaggtgagctattagctcatgattaattaagtattaactattttaaatttcaaaaatagattaatatgattttttaaagcaacttttctatagaaattttttgcaaaaaacacatcgtttagtagtttgaaaagcgtgcgcgcgaaaaacgagactcaatctcccctatcaccttgaaacgaacagagccttagtgaacttcactttaaaaatatagttttttggataaatttttggactagaactttagtctttagggtgaaggacagaggggaataatgtttatgcatgataacttgggttgggcttgggcacacggattacacctctcgtcaactggactaagttatacccctgactactttaatggaagcaaagtggaaaattggcaggttagtagtcagaaagacacattcagcgcttctgctaaagctagtaaagtctcttgaagcgaagacaagcattcctaatattttaggaagtattcccaatattttaggtgtagtactatatggagggcgtgaagacgtcaacgattatccacgggccttactttactgttttttttttgagaacattactttacagctatgatgctatatctgtttatatatacgagaatatatatattttttactatatgcacctacactcttcttcttctttttcgttcacaaaagatattgcttatagcggtggtggaaaatttaacactcagtctttaccatttatttcttttaaagctatttattttttctaaagtggtatagatatcataccctaatacaaacataaaacacagttcctactacccgactcgtgtgtcacattgttgtatgagttaactttgttttgaacgacttacaccgaatagagtaggaaaaaaattacaagattgcaactctggaaggtcgtaactaggaaaaagaaaaatatatcatcacccacacaccgacaacgccaatacacaggtccgggagaaggctagcaccggaccagtcgccgttaagcgtgaccgaccgccactaggccaataaaggaatatagacaagatcgtccaaaaaaacgcctttacaaccaacacaaagcccaactctatctagagcgcgcttgcaccaatcgttcaagaggtttcggcaaggggatgcctagacgacatcttaagggagagaagcgacgggaaaaccgccaccgccgtccgttagggtctcaaaagagccaaggttgggctttcacccggcaaccccccttaaggagtgagacgacacgacaatgccctcaggagggggaatgaaccatcgttgttggcccggccaaggccgagctgggttttcacccgctgctcaccacctgcgagtccacgctgatgcaccgatgctccaccactgttcaaactctgccgacatgtggggccactgcaccggtgccccctgccggccagccttcacgcgccaaagactgcgccacacccgccagcagctccttgcaccgtggtcgcctccttcaccaccggccgcgcctcatcgcgttgcgccggtctcctccaccggatgcacctctcgcgtcaatctggcctccagcccacggccgcgcctttcgtgccaagccggcctccgtcgcccccagcagcgcctctcacgccgtgccgacctcctccaccggacgcgcctctcgcgccaatccggcctcccgccatcgactgcgtcaagccgacctccgaccttcctacaatcgctgtcgcgccggccagatgcggccgtcttccttgccgccggctagccgtccgagaccgccatgcctcctccaaccgcagccatggtcacgcctccacttgccgccgctagcgatcgtctcaccaccgctgccggccgcacctccatccattgatgtcaccggccacccgctgactccaccagccatctaccgacctgcagccaccggccgccgctcggcagtgagctccacgccgctgtcccacgcgctccgtactgccgccgcgacggtcgctcgatctggccgtcggatccacctccgactctgccggatccgccacgctgacgccaaaccgtcgccgttgccaaccctgccgtcgtcgccatccccgccgccaccgccatctccaccgccgtcgtcgccattctggccgtcgtcgcccacaccccccttgcccctaccgttgccgtctccagccctgcgctgtcgctgtccccaccgccagccgccaccccgctagatccggccacagtggcgcggacttggcggtcaccgtcgccgccgcactagaggctccccttgctgctcgcgcaaggagaggcgtgaagccccgctgccgccgtccttgcggccacgcggctttgccggcggccactcgggcagcggcgaggcggaggaggaaggtgggggaggggaggagggggtgaccgggttggtctcgcgagtcgcccctgggggagagcgacacgggggagaagatgctgtactttatgagttaaactttataacactaatggatggagtatattataaagctaacaaatactgcatccatccaaaaatatttgacaccagtgcagctttgtcagtttaatacacaaactgcccaaaagctgaattagcgcaactctacgattccaaactcgtcaaaagatggaagttgtgaagaagtataaaggaaattgcatagatgcggaatacttgcaccatcttttcttaacggcctgtttggtaacctgagggaaagggattgggagtttacatgagggaattgatgatgagattaagatgggaatttgatttttaatcccaatatcttgtttggtagaggcgatgaaaattgatagggagtttagttggagattggatcattaaaaaaaacggatggatgagatttgcttagacaaagtaaaaaaggaattccctcccaattacctgcccctacccaggtattgaaaaggagagagttccttcctcaattccccatctccatcctaccaaaatttccatgtttcccaaccaaacaaaacacttaatagccttatccctctaactaaacaggccgtaagggaaaaggtggggaaaggagcaaaatgattggcgcctgtggtcactgcacacaaaatatggacaccgcaaaagaaaaaaatgtggcgacgtcgtttatgtgataaaaaaacataatttatgattttcaattaaaaggcaagagggaaaattgtccatgattttcaaactaataaagggaataaaaaaactaataagaggaaaaaacctgcactacagtacataatttactcagtgtcacaaaatgtcattttcctataacttgttcgtggcagtagtgcatggacgtctgtttgtggcagtgcactccctcaatcgattcatcccaaattcccaatctcggactctacagaaggtgaaaggtgcttaccacctgacaggcaaacagcatatatagtattaacacctacaagtgcagtagtctgctacacgagtacagagtagtagtttaaagtttaaaaccaagattttgcagcaaatattctgttgtaagtagtctacctaattatgaatatagacatgaaagggatcttctatctgccatgttcctttcctttccgtttgaaaactgtcttgaccaggccacacactttgtggctgggaaaaatatttcagaactccattggaaatttcgcggaatatgtaggagaattggatgggaacccaaggtaagctgtgttagtattttcttcaataatgctatgtacaggaaattagaaaagcagacagactacttgtcttaagtcgggtacttacatggttggcagcatatcctatggaaaccaaccatactgtgcaaactttggaaactcccatcaagatctctggatgggcatccgatggataggggtggaggtgggacaattttgtaaataaccgcccgcaattagccttgctaatctccttttttgcaaatcaacccccgcagtaaccctgttcggcgccctaggacgcgtcatccgcgtcgcttcctttcgactccgcctcccgtgattcaagacgacgacgacaccgcccagtgaatcgccggacgccgcgaacgcgatggagcccggcaatgccatggactctgcgatcgagtatgctcgcgtgtccagcgacgccatggattccggcgcgcgcgtcgacgccgcctaccagtgcgttttccaggaatacgacagggacgcgctcaaggccaacatcacggcatggggcccctggtgctgcccacctgggatgagctgctgttcgtgctcctccttcctcctcttgcttgtctgctgaagctcatcacggccatgaagctgaagctctgctgttgtttgttttctgctgttaaatgtactcttaagatgaattgagcaatgtactcttgtgcggcgcccgccatggaatgcttcttgtaaacacttttttttactagtgacatcattcagcttattgctcctaattttcagatcaattgtgctgcatgtacttgccaggtcaattttgagttaatcacattccattttgagttatttgaatatctgcacaatcgtctctgtccagctcggcgcccgcggcatctccactcggccaatggccaccttctcttcaccaccgttcacagtcccggccttgctacactccatcgccaccgctcacgcgacggtgccaggggccgttgccggagaaggactgcgccgccaactcacgggcgggcgggcgcgggcgactcgcgaaggaacgacgacgcagcgagaaacgaaggggcggcgggcgtcggcggcatcatgtgaggcccgcgaccccggcggcgtctggcgattcattgggcggcgacggcgtcgtcttgaatcgcgggaggcggagtcgaaacgaagcgacgcggacaacgcgtccagggcaccgggaaaaatttgataatttgacatttttttcgttgcctaattgctttaattgacacttgtgaagatgacatgtgggaccatccgagtgaataaaagtgggccaggatgtcaaataatcgaaacccatttaaaggagtgttaaattatcaaatctctcggggttgatctgcaaaaaatgaggttaagcataccacttcggaaaagtagaaaggcacggtgttaaaccacaggcctttaatggaactcgatcactccatctctttggacatgcatgtgttaaggacatagcaaggctaattgcgggcagttatttgcaaaattgtcccacttccacccctacccatcggatgccgagctctgctatacatacgataaacatcgtacgattagtgtacgatgccttctaacctctaatgcatgcagcaaatatagggtccacaatgtttccatggcccaatcatttattatgcatgactggatcgtaacaagtttatcgtatatacagcaatttccatcggatgcccatccagagatcttgattggagttttcaaagtttgcacaggatgtctggtttccataggatacgctgcctacatagttatagggtaaggaagacgacgtcatgacgctaactgtgagatatggtcaacgtgcaaacatgctagcctcgtctttccgcttatacttatgtttatcagccaaaatttaaattttcaaccttaaatttgaagttgatttttgaggtttttttcaatcgaagtttatttttcagccttagatatggtcaacgtgcaaacatgctagcctcgtctttccgcttatacttatgtttatcagccaaaatttaaattttcaaccttaaatttgaagttgatttttgaggtttttttcaatcgaagtttatttttcagcctttaattttagatcgttaagaacacgtatataaaatttttatttacagattaattttcgtttgtaaatatatcgtttggctttttcagttttgtgttttacctgtggtgaaaagaatagtataaacatcatgcacatattctgttagtctggttagccttgtgttctgtttgttctgcctttctggtttttaagagaagttgctcagtaaaatcatgactaacagactagtgctgcaatcaacatatataccatcaagtagaacaaagatgcgggaaggcacttgatttacactgatggatagagcactggcatgaatagatgaatgaaatgtttgcaagtcgagttcaattacgtacctgttggatgttggctaatcatgtagagatctaaccatttgcacaagagtactcttcattcttcacagatcaaggactgtaaaattgagcaactaaaggttgtcgtctcatagaattgtagtatttaagaatcacataactctttgaacagcagcacagttttaacctaccacagtgtccagtagtgaccaaatccataactaacagtcaatagaatccataactaatatttcctatctccagttcccttccatcagaccacgggcagaaaactgaattaatggataaactctaccattttctacattcccaatgagtatactcacttaagggcaatgatgatgagtacatgagatagctcaacttaaattggagaccatcttgttcagaagtttcagtctttcacccacactggtaacttgacaaacaagagccacacatagtggactgtttctctccatactcctaactccttagtgacatgcaggagtactgcatgtttctaatatgtgatcatcattttccttttttcatcaacctattgtccttatcagcttgagaagtggcttatttcatgtcagcactaacacagtagctcaaacgtactttcatgtataaagggcttccattaagtcatgatgttgatattttgagttgcaaacatgtcccatttgctcttcctttcattaagcacctatatttaccttcaaattatatattgcactgagtgtatatcaccagacacacttaactgctaagcaatacaaaatctgcatccattatatgaaattgatcatccagatcttggttcagagacattaacatcaaattcaactgaactatatccaggaagcttgtcaacttttacttccttcatgaagcctcttattctctctgcatcactatacctcccagcatctgaatatatgtttgccaagctcatgaagtaaccactctttgaaggtgacatgcccatcaacttctttgaaattcgttcagcagcttccatttccccatgcactcggcaggctgctaatacacctccaagcatggcctcatcaggctcgaaaggcatttcctctatgagcttaactgcagcaacaacacggccatcccttcctagcgcatcagccatgcaagagtagtgtttgagctcaggtttcacgccatgccgtttcatcccctcgaatattgcat

SEQ ID NO: 74656 - DNA, 3661 bp, Oryza sativa
cttccggccaacacttaggaaaatttcagccaatgcagggtccagaagttccgggtccagggaccggaacttcctgccagccttctctgttcggtctggacccatttgaaaaaatggctctcaaaaatattttatcactaggaacccactaagagcacttttttatatctcagaacaacacttggaaccccctcttaatagtacggtttttactaaaactcgattttaaaaattaaactatcctattgaccttcgagcttcaaatccgcttgaatgagtgttgttgggggtctccaagcatctcttgatcacctaagttaactatgggactaattaccttaaagtctcaataaacacattagtcccttaaccttattcatcattaatcaccaaaacacattaggggataaatgcaacttcaattatatgtgcacatacatgagtacaccttgtaacacagtggggattgtctgtagtattgctgatgcagtagcagacaccgatgcgtgggtccggaggccatcgctgaatcccttccctcgtattaaaatgcacatcgacgtgtactccatgaactcgctgaaatccgatcaaaattgacgcacccgctttgtaatcactggccagactaacacctgtttaaaacatacttgtgtatacgtaatattaattagcaacataatttaaaccttagcgattagtgcatgccccaacacttctactactacgcaattcagttcttttccaaattagtgcatactcatacaactacgcgtacacgaactcacaaagtaagccttatgatacagatgttggaattaatgaatgggccttagcccactcaaagattaattctttgaaaaatcacaaaagcccacctcatgggatggcatgcatgtggagtttagtaccaccttgcttattctaggaaagggagacctccttaaaagggaggatgccctcctagccacttgaagcatgtgtggtggagagaagagggggaacacacacgcgcgctcgctcgcctggctgttttgttttgctgcctctatataaaccgagccgccgccttcacgcaacacacgcgaaatcaatctagggtttgcctcctactctgtgctgcgccgtcgctcgtaggttactccatcctgctcgccggtgtgcacctgcgatcgggagagcaggtctccggaacctctgccttcgatgtcctgcaccgggagaaggcggcaataaggtttttgggaagcgctttgcgcgactgctccctgttcgtccacgacggctcgtcttcctcttcgctcgcgcgttgcgtgccttcgtagacacctgcgaaaagtttcgaccgagtagccggtctttccgccacctcggtacgtgttcaatatgttgcgcatgtttgatctgttcatgttatactgtgtagtttacatatatagatctaatgatgcgttcatgctagttttcatctgtaatgtcatgatttatttatggaatatattaaatcattatatgcctataatctcaacaatccaaaaaccttattataggcactgtgattttactatggctggttttgccgatgcactgaggccggataaattcaccggtgcattttaagagatggcagatcagagtcactctgtggctgacagctatgaaatgcttctgggtgagtactggcaaacctgaaggagttcttactgctgaacagcagaagcaattcgaggaagccactactctctttgtgggatgcattcttagcgttcttggcgatcatctggtcgaggtgtatatgcatatgaccgacgctaaggagttgtgggatgcactgaatactaaattcggtgctactgatgctagcaatgatctgtatatcatggagcaatttcatgactacaagatggctgacaaccgttctatagtcgaacaggctcatgatatacaaaccatggctaaggaactcgaactccttaagtgtgtcttacccgacaaatttgtggtcgggtgtattattgcgaaactacctccatcttggagaagtttcggtactgcactcaaacacaagagacaggaatactccgttgaggggttgatagcgtctcttgatgttgaggagaaagctcgggaaaaagatgctgcgtctaagggcgatggtggccagtccagtgccaatgttgtgcacaaggcccagaacaagagcaaggggaaatacaaagctcagcagaccaccaacttcaagaagcagaagaagaacaacaataatcctaatcaggatgagaggacttgctttgtgtgtggtcaacctggtcatctggctaggaagtgtccacagcgcaaggggatgaaggcacctgcagggcagatttctaagtctgctaatgtgaccattggcaacactggagatggaagcgggtatggtaatttacctactgttttttcagttaatcagtctactaattggtgggttgatactggggccaatgtacatgtttgtgctgatatctcattgttttcttcttattaggtcgcacggggttccaccgtcctaatgaggaatgggtcacatgcttctgttcatggtgttggcatggtagatctgaagtttacttcgggaaagatcgtgcagctgaagaacgtgcagcatgtcccttctatcgacaggaatcttgttagtggctcccgtctgactagagacggatttaagttggtttttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactgcagcgggaacaccactgcacaggcatcctagacggcacggacgaagcctacttctcggggaaaccttcatctgacataaactcatcctctggggttgggaaaaggagagcaagactgagtactacccactgtactcagcaagtcatcccggaataggggtatgatgcagggaattaacaaagaagagctagagtggttcatttgcataaatactggcatttataaacaggaattgaatacgaaaacggttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcgcggctattcgaatagctttactctgatcagaggtgtacaactgtacccacaagacacagccccacgacacgtttccgtgcgccgacatgccaccacgacatcccggaaagaggctgtgacaggaccattcgcataaccccctctaaccaagcacaccacacctcaggtttcacccccactccttgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataag

SEQ ID NO: 74657 - DNA, 7673 bp, Oryza sativa
ttaaagatagcgatctttagttccggaatcttagtcccgctttgcaacccgggattaaagggggttgcaaaccggggttaaagagggtttccgcagcagtgacatgactagtatataggggtaaaaatggagcagattcggatggatagtggtcataccatatcctaaaccatattttctaaacggattcagagcggctgagcggattgtttcagatgttggaaatggtgcggactcggttcagaaacggattaaatttgttggatgttatgtgtgtatgcaagcaatataccatcgagttaacaatgcaagggacaacaatgcaacaatcaatgaacgacccattgtaataattatgtgcttaagtactaaacaaacatcatgaatacatgatatccataatataaaaatatagctaagcaagtgtgagatagacggtgaaagcctcggactaaggaatctaggttaattgatgaattgggccattagatgtgctagctcatgttatatgtaacagattgagtggttgcatgggttgataattttggattatccaacaaacgacttataggataatttgacagaaatgtcggataatctgcatccgccagattttagagagaccatattcgctagatttttagaaacccataccatatccttctttcggacggatttggaatggagcagagtggataatatccgatctgttttcacccctactagcgtatccagtgataattatttgaaaccagagaaaatacaacactgggccatctttgtagcacaggtgttaaaagataaattatgttgagaacacgaatatgaattttgtttgaagatacattaataggaattagatactgaaggttgagaaacatgtatactccccaatcagccaagaattcttcagggcgaatctttaggccctgctgccatgcatgcatatatcaataccatttgcatcagtaatctggtccataacatttttgtctgctttacatttgttgtctacttttcttgtccagctctgactgcaagattgactgctgaggctgagcacccaagagttgttgttggtgagatcagtgatcctcatgtgccaagtggttcacaccaacaacagagctcttacatggacaaactgcagcagctgcttacacagaggcaaccatcacaaacccaacaaaatcagccacaataatatgtggaacttttagggtgatttctcattagagacttttgaaaggcttattgattttttttttgctaaatgttgagtaatacatgtgtggagactttcaatgtacaactagaagataccccgtgcgttgctgcaggattacagaaggtttattcagaaaaagaagtatagtttataaactatattcagttattcaccagcaagaagtgtgttaccttcagtattttaggttcagaattaggcttgattggaaaacggaaatctaacatagcctacatttcatagtagaaaacgatcatgccaataaggaccaggccagtattcccatgtgtggaatttgttcttggtcaacacaaacaaaaaactctacactggaagacaaggacagtggcaaggtatcctctatactacttctattatttgtctgcagacaagatcatcaaattgcgcacatccccatagttgatagttgcgtaccttagaaaatcaaacttcgcagaaagtggatcatcaaagtctttaacatggccggttttatttgtatgcatagagaaaagttcaggcatgcaatcaatgctaatttttgcaaggaatcactatatacaattactaccaagaaaatttaaacattatttacccattattcacgcaccaagctagggacaaagaaagccagttgggatcactacgggtcccacaccgcagtgttagtggcaggcgtcatcacacagaggaacaataaacaagtgtaccgtttgagagtcaaaacagagaaaatttggcatattacccgttttctctctccgtatttaccctcttactacgccgtcccatcaaagggtagttggcttgccttgttgtcgaacccgagaaaggcaacatggggcagcgagagaagtgacgggtggcagaaagtgtgatgatggctgtaaaggtgaagaaagttaaggatagaagaaagcacagaagagttgagacatacatgataaacatctaagaagaaagagaagatcgtagagacgtatatctccaaagaagaatagggacacgtgcccagctcgtagccgtccgtaggccggttgcctgagaggtgataggtggcaagccacctcgggtggagtaggcctagcataagtagttgggcattgatgtgtggcagtgtgatcagctcaggaccatccaccgcctcactcccagcaggtgacaaatggcggcccttgaggtcatcgccgttatcaacccgattacgtactagacatggcatttgttaccctccaagccataggcaggggagagcttaggaggccccgtgcactgacctctaacctatacgacatgctaaggagagtagagttgcaactatggtatatgaaatcgtcatgattaattgtttgcagtgtccctattgcttgtctctctagaagtccattaagctttggagagtatataagcaggagggggttccccagtgtgggggtggaaaaattttcaaaggatccaagacacatcggagttggagtgtgagttgtacatttttttgcttgatattccaaaaagggcagcagtagggtcatttcggattaggtcatatccctaaacccaccaagaaacaccgggttcgctggatttggttctgttgggcatcgcccgtcaacaccatgtaaaaaaataaggcatgccacacataaactagatggagaaattgatggatgcacaaaacagatacatagatacaatgtttgcaaaggaacgtgcgatgtggaaaataagccaaaatcgccaaagaaaaagagcatacaaaaccaaacgttttatagggagtgcaccgaaataataaaaactttgaactatcaaataggatattatcatgatagtcacatcgttgggagattcatacacatgttacatatacaatcatcatgaaaggtcaaggcataataagctaagaagttacaaaactcataatgtatagcaaatgatactacctgtatcaacagggtccaaacagacacttcttccagaattgttttctgaaagtaattatcttttctactctattcataaccgaaaatcatttatagcctttttgggacctaacccgatagagtagtaatgttctacataatctttgactagtgtttctctatacaaagcaggactatcatcggacagtagctccttgatcgggccgaacatccttgttgacgctagattgttgggaaaacacgcgatggatactcttggccttgaactttgtgccaccaccctatgttccacgcttctgaacttgtcatttgagattatctggacattggttatatatattcagaaatgaaatgacgcacatgcgttttgtgggttatcaaaaatatatgtccaacaatataaggtaaatcaagttgagttttcatgttctctcaaaataaaaaaatgttgatatttttatgtccattatgtgttgtgaagattcttgttacaaaaccgacccaaaatcaccatcgataaccaaacgtggaagagacaccattggagatccaacttccaaggacattgaggcataatatttgttaacgaggttccgctgaagcctgtgtccctgggacacggattacggtagatccccggccgaacaccaccggaagccattccctctcgcctatgctaagtcatcatacggttacaataggcatgcctctctaactaagagagcctaggatagagtctgactcttattttattcctatacctagtacaacttcaagtgctaaactgtaaccgactttgtacacatattcgaccgtaactgacaattatgaacatgatacctgtaagaggccgcctaaattcattgtgttatgtggattctaaacatgataccagcaagagacaccctaatttcattatgtgttgtggattatggcaatgatatctgcttgattcattgtatttttgtggattctgaacatgatatatgaaaaacactgtttaatttcattatgtgttttatgaacactgaacatgatactgttaacagtgaaatttggtaatcggcaaagacgtcatcggcttagaatcagtatcggctgcagcatctcggaattagccgattggagttatcaagtcgccaatagtcggattcttgctatattcggttaaggaaatcaatctactaaaggaagcttatccctaagtgaccgagtttaaagaggatgtggcatggcagtttatctattaattaggaatagtttgttagtttccttttatctttaggaaagtgtgtttagtgtccgataaggactttatattttccttttatctttaggttagtttctttcttgtccgacaaggacttgtatcaacccatgggtataaatatgtacagccggggtctatgtaatctatcgctacgatcaatacaattcggcgcatcaccagtcctccacaacaaccggtgggtcgatatcacgccattacctggagcattcatcatcaatataggcgatctcatgcaggtacctgttgacgaaaaaatcaaacacaccggcctaggagatcttcttagctccagtgcaggtccaaatatgatgagatgcgggcatgctagtcagtttgatcctgcaactgacaagatatgcaaatagtagatcaaaacagtcaatcggctgacaagccgatggagtagttccagccgatagccgataatagccgatgccgataccagccgatagcgatagggtttaagcaatcggctatctgtccaatgtagataatgatataaaggcaatcggctgatgatgatgtaataaaataacaatataatccaatataagccaatcggctagcaatgatatgataaataagcatcgatccgaaggttaaagcacacatcggctggaggtccgatgtcatgaaatccacaagattagattaaacaatgaaacctttgttgtcatcggctaaatccaacttatatgtatatgcaatcctcatgaaccgatgcaacgtccagataactcaacggctgaaaccccgatgaaacccttattggcaatcaataagcaggctagagattatggttctaagcacgacttagtagatcaaacttaactggtgcagtactaagtatgaaaagaaacataatatctagacaatgaagctgttgactgagttttcagggtggtagatgtgtagctaatctaatctagcaatgcgatttagcctataccggtagaaaccctaaaacgagaagcagccgatagagctaaattgatatgctaagactagattaacagagacatatgataaataggtaggcaaatatatcatccaaaccagagcaatccaagaggccgaatgtactgatgcagccttgaacgacgccgacgtagacaatacaattgcctgggccggcggaacattgaacttaccccttagccggagatcgaacaccgatgcagccccgcgtcaggtgccaagtcccgccggaacgtaaaaacaaaagtagtaaaggtaaaaggtggcgatgcgccgaattgtattgatcgtagcgatagattacatagactccggctgtccctatttatacccatgggttgatacaagtccttgtcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagcaggaatccgactattggcgatttgataactcccatcggctgattccgagatgctgcagccgataatgattctaagccgatgacgtctttgctgattaccaaatttcactgttaacacacacgtagtgatatatccggaatttcagaattttagaaatgggtagttcaacttacatactccctccgtttcagaattttagaaaaattcttacattcatattgatgttaatgaatctagatagatgaatgtagaaaatgctaaaatgacttacattgtgaaacggaggaagtacttttttaaaccgcaaatatagcaaggaccaaatgtgcatcatgatatattaataatggagttttttttctctttccaagagtaatgtttagctatgtatttttttatggtccccggaccactaggaccaccctttggacacatctatcagcacacgtgtttcttttacaaaattaaccatagtgatgagcatcagagattaagaggactgaattttgtactacagtttatgaaaccttgacagacagtcaaataagcttggctcacaaaacttaaaactgatgtgccataacaggaattttgagtacccattttcagatgaacaatatacacatgctttagtagtaatggtcattggattcttgcgattccagtcagtccaggctaattgtggaacaattgagtagtaaaagttatgcaaaatatatggaactcttctactattcttcaaaaaagcaaacgttatttacagccacagatttactggtactaaaaaaataaaaagaatgggggaaaaaaggaaaagaaaagagcggctctcaccggcagtattccggcaggtcaccggcgggcggcgggtcgggtgccatacggaggtagagcatgtcgcgccagttggccgccggcgactggtacaggtcgaagttgcagttgtacttggcggccctcgccgggtcacgcgagtagagccgcgccttgtcgctgccctcgctgccgcgaccgcggcgccggccacctccgccggtacgccgtggcccgtcacctagaggaatgcccactccaccgcggcgcgccggatggtcacgaccactgcctccctgtccccgcccgtgccaccgaggtcaaccaccgggatggacggtggaagcggcggcgattcttggctgctgctcggcggcggcggcggtggttcggggtccgggacgcggaagatgctggggacggcggtgacgcccgaggcgacgaggccgtggactccggacaaggtggcgttgagcgcgcggtgctcggcttcgcggtcgtaggtggcagacatggtgaaaggcttggaggggagcgtggaatcgccgcggcgagacgagaattcaagcggtaggaagaacgcactgacggttggttgagagggagaaaaaggacaatatgctatgccactcttttcgtgtggtttcgacgaaatatcacccattagaatggcaatgataaaatgccacttaataggttatttttaggatattttgccactttaaaaagttttaagaccagaatacctctgctatggacagagaggaatgtgagcgcctgggagaaggctgagctagtgctcgccggtggcgggcggcgagcacgcgggggcggactgcgatgtgc

SEQ ID NO: 74658 - DNA, 585 bp, Oryza sativa
atatgatcctaagcgtatgtttagttcaagggataggatgggtcgggttgggttgattctattttttaggtatttagtttggaggtagatgggattgcacaaagatccaaattgaccttgtctcttaaaaactgaccaaccaatccaaatcacatttctcactagctgacatgtgggccatcccttaagaagtagtaccacgacacaactatagatccagacatccgtgacaagctaatgctactcgttggagatgactcatctctaacaggtcgaaaagtatcacattttaggtatggttatagggataacccaccatagatacaaggtcatttgtgacgggtcacagttgtaacatgtcacatatgacctataacgggtcacaatcatgccccatgaaagataaaggtcatctgtgatgggtgtaatgagatggcccataacagatgagtagtcctaacttccacccatcactaataacattatttgtgattcacacataacaagtctctcaagtttctgcatggccgtggtaaaatcataaacttctggctagtgatgtgtgaggaatgatatagtaatatt

SEQ ID NO: 74659 - DNA, 1493 bp, Oryza sativa
cggactgcgatgtgcggaggagggtggcggctccgaagggggaggacgactgggcgacgaggtggaggtgggtagcggcggagacgacgcatcacaaggaggagccgacgacgtgtagggcggcatcgacggtggaaggaggatggcggcgctcgcaacttgcagcatgtgtgcgcgctcgccgcctccaacgacaacggcagaggaggatagagcgggcaacaccccgtccaccttgtcacccatcttcatcccagcgtggacaccaccatcgtgctgccccgtcgccgttggcaaccctcccccgcgtgctcgcaggccgcaaccgcgctccctcgcatgctcatggcctgccgccggcgagcactggctgccgctcccctctctcccttcctctctatcaacaataggggtattatggtcttaaaacttctcaaagtggcaaaatatcctaaagacaacctattgaatggcattttatccttaccattctaatgggtggcattttaccgaaacctcatgaaaagagtggtataatgtcctttttctaaccgagagggaggaaaatggagtttgactaactgttagagtgttgaaggttgcgttcgctagcttgattggtgatctgaccatggcatcgaagacgcgagcgttccgctccttccaaaccatgcatccaagttatcgaaatgatactgaaggactatgttggttagtaggctgaactatgaaagcttaaaacactgcttgattaagtctcccagagcttgctgggtgtagggacatcgcatgaatagatgcagacaggtcactggcaacaaggtgcacaatggacacgatagttggcttaccagccgagctggttgacgttgtccgatgtcaagcagctttctctggtcgtcaagtacatgaagaactttcagctgtctaaactttttgccttccatacgattttgccgcaagatgcatgccaatgttttgccaatgaagagtattggcaagaaagcaagattccaccgtagggtccttatcatgctgtaaggctatccacggcctctattgttgtgtgtggcgccactatacacatcgcattcgccggtgtgtgagtgtggtgttgcgttgtagtgctgtgcatgcgtgcatatctaccttgtaatcaaattttaagtcaacttgtggttttagatgtcaaaatttcagttttgttttcgacaatgtcaggtagttccagtcctacacatgtgcaacttgctttgtgagagcgggcaatgcaacgaggctgagtgagaagagccgtaccatgattggattaaggtgaaataaatagctatatttgtggtgtcatatttttttttattaaaaacagttaaactttttacaatacaaattacatacatttacaaggtatttatgttataaaatttaagactgtatttttcaaaaattttctactgcacattatataagagaattaggataaaaccattgattac

SEQ ID NO: 74660 - DNA, 11430 bp, Oryza sativa
cataggccctgaattgcctacatacataatcagtttaggacatttatcaacagcagataactaaaaatccttaaacagaaacacaaataaaaaaactaaatgtgaataataaaaatgtgctaatgataatagtacttactagattcagttgtcccgctagcagaaccttcattcatctaaagcagttccatttgttggagcctatgaagatcattgaaaatgattagttgaattgtacttggagcctattacaaagcttcttcatgcaacttactttttgctcagtatcctccatagtttcactctgtttactctcactttttacatccactgtctccagtgaagattgaagttccttttgctgcaactcttcaggagaaacgtcaacaaaggctgcaaacattttgttacaataacatgagatatgcatgacaaaagtatgaagaaaacataagattagacactaatcacaagctccatcccctattcactgatagttggagaagaattctcagagataaacggccaataccaaatttcttctttggctgttcagccacatcagcctcttccaaagttccagttgcttccactttagtagctgaaacatcgacagttgcagattgaggagaggtatctttccttggttgtgagtatgggtaactgctaggagctgcaggagctgcctgtggtggcatggcaaatgggaaaggcgagtttgagccaaaagtgtttggcggtgcctgggtcatcattgacttgaatgcttgttgcattgcatatttctgcatcagaattagcaatgtgtcaaaactggcaagcaagggagagttatacgattttaagttccaacaagacattatacagatcaaacctacaaagagaacattgtattaattaaatcagtgcaacaatggatacatcacgatatactttcgagaaaagaagtggtgcaacaatgttaactctctagtaattaaaagaactagtggaagtgatgatgctgtatcatcctcactttggatcttttatgggtgaatttatgtatacatgtgtgttacttataggttttttttgtaaaatattgcactattttacatgccaatattttgaagctgggtgaggtgatatgatcatattttacatgcagaatttacattagaggacttcctttagtcttttatatataaaaaaatttgatcttagtgagtactccctccggctccataattcttgatgttttggacaatgacacggtcttcaaaatatatctttgactatgtttttctattataatatataataaatatatatatttttacttttattattgtactttataagacaaatctaaatatgctgttctagtacctttaaactaaatatttttaaagttattggtagtcaaagttataaaaatttgacctcaaccttgtccaaaacgtcaagaattatggaatcggagggagtacaccaaattgttttgacatccatcacaatgcatggatattatgctattttatcaatattgaaaagaactagaaattatgtgataagaaaatgaattgtctaacaaaactacaatactccctctgtactcgtaaaggaagtcgttctggacagcgacacggtctccaaaacacaactttgacttcttgtttctataaaaatatttattgaaaagtgatatatgtatacttttatgaaagtatttttcaagacaaatctattcatataatttttacattttcaaactcaacaacttgagagttattcatgatttatattcccaaggtttgacttaaacattgtcctaacatcttcctttacgagtacggagggagtacactgcaacagtaccacctttgctagaacatatgccatgcattgcttcaaactattaagaactagaaaggaaggcatggctcacatgtgggtatgtaggttcatcacaaaaaaagctcactaaaatacctctcttgcttatgtactagtatgcagaggtgaccatgggtcattctcaagatcaagtatgcaattgatagggtacataccatttgaagatgtagaaacagaggaaagttgtgaactcacctttaccatcgaagagacctgatataacagccaacaccaagtattaaaatacaactctaagaacatttaatcacaaaaaagcattacaggtaattgtattcacaccatagaaaatgctgcggacaatgctacaccaactccaatccagaaaacaggcgaaccgctgcacaaaggatttacatgtcatcatgcagtgtaagttgagaaaattgtagccagacaaaagaagggaaactggcgcacatgtatgacgatgggggtggcatgggaggtagggaacccgttccagttgacatattctcactgttggtcgaagacgacatgcttgcaaatccatttgtctttaatccctcgaaacctgttgttacaactaaacaatcagaataatggagatcctccggcagcataagattaaaatgggggaaatcctaagctgattgggattgtctattcgtcggctattactacaaacaaggacagatatgctgaccattttgtactcatcatttgccacactaccaatactggataaggtggccattactaactcaccaactgccaccatactacgaaaataaagacagtattccatcacggatgcatgacttaaggtcactaaattcgcaaggataacacactcaattccactaacgaagcccatggcacagcgatggatccagctgatacacagagtataataaaattcctgacaatcccacaaaaaaaaacactatagcacggacacttgaagcgagcgcatacgagagctttcagcgcgcacctacccaaagagcgcatccggctcgcatctaacgaacaaacctaaaacggaagcacacccacacagaagcacaccacccccctcaccgttcccggacccgcgggccgcggcggcggcggcggcgacgacgacgagcttggacctcccagctcccctccgcccggacgccgcagccgtcgccgggagagtctgcgaggaggggcggcggcggcgggccgcggagaggggaggcaggcggggagaagcggagcaggaggaggcgaggaccaggctctccatgccgcctgctgcgcgcgcggggggagggaaaaccctagcttagctctactgctgctgctactacaactaccaccccctcgcccctccccactcgcgctagggttttgggtgggtgggtgcgcgcgtgagtcgacgagagacctcgggctcgtgttgtgtaggctacgttcccccttttacccctgcggtgagtgataggaagctgaaacggaggggagtcatcgccttccgctgcgtggggctagtatccatcgctatcgggacattcagagtttcagactgtcagcggctcatttcaggcactaattgcagacagcaacatttaaccactgatgaaaaaaaataatactactactaattaagatgcgatgtttcaaaattcgaatatctcaaaatgcaattcgggccagttcaaaaaatgaaaagggaaatccagtaaagtcgaataaacaacttttatgccttgttattaactgacaaagttcaatgttttggttctgaatttgagagaagagagaaaattaaagtaatcccgttcaccatggaatggagtgtaactagtagtagtaatttgtgccattgcagaaatcatatcgcgttcaatcactcaagttacaaaagtacaacggtatacatgaatgagaacatatgcatacaaccttcagttcactgtgctaagttatttcccatcttacagcagaacaaatgttcagaaaagccgaacgagatattctaacgttgaagggttgcctgcacatatattttgatcaagcaaggtagagcatcatgcagatcaaaccaaggggattatctcctggaaatgctagaagggtgaaaccatccatcattttacagtcttcccgaaacctcaaacaagaatatgatgaccttagcctataagaaaaaactcggtgagtatctctgcctcgtacttcatatctgctgcgctttggctttcttccgcgccagagctctttctctggcagcagcaagtgcatcagcatttctcttatagtgttcatccgtgatctgtgctggttgagtattctgtggattctgggtctgaggagctggttgggtattttctggtgtctgggtctgaggagcatccaaggaaacatctgcatttttctcggtagatctagcagcagctgaatcccttgattgagttgtagcaggttcttccacacttctactttcattggccgtctctgctccttcaccggagtcccttttgtgcttaggagagcgatcggatacttcagcaccaaccttgctagttttagcatcttgaactttctcgtctaacttttcaggtttagcatgttttgtattgtcatgtgtctgtgcaccgaaagcaacattcttactaagaccaaagtaaaaatcactcaagtctttcttcttagtaacctgtacaaaaatagacgaaggaaacgtaatcagttacagtgagccaaaagaattttttgttgtgaaccattagaagtaattttatcttagcaaatactccctctatcccataatataaggcgcggtcaaagttggcacggtcttcaaaacgaatgtttagcttataatttctcatataccataaggtttgtagtaacaaaattataaccatatgaatgtaaatttaaatctcgatctaatggtataatttttaacaaataaaattcattttatattatactaagtgttggtcaaatgtttgaaatgttgaaacttcaaatgcatgcgcgccttatattatgagatggagggagtatctgatttggagataaacaaaactattgcattaatttggtgatcaacaaacatatttcagattcccgaaaggttgcttgtgtaagcagcaaccagaagatagtgtttttcgtaaccagcaaaaagcaaagtgaagacagtcctttaaaaagaatgctaaaaacatataaaaaaaggtaggtttacaattttgcatagcaatataacataaaaataagtgaaaaggtcctctcttttctctctcgtactcttctagcaagacagatggggcatgcagcacactagtgtgaatttgaagattgtgaactcaaactaaagagtttgactataaacattacaacaattcaattaatatcaagtttaatgcataattttgttatgaccaacctcacaagagacaacacaagaagcattggtagaaataaattatggagataaacatgcacataatcaagagtcatgaaaaaaaattgagaaaagcttacatcttccttttcttcttgaagctgccgccgcttctcttcctccagccatttccgctcctcctcaagtttcttcctgtaggcagatgtaacaaatttgtctttgtcaccatataggtggtcttccttactcctctctttttgaagcttcctctcataaataatgtcctgctctcgtttacgttgttcggctttctccttaagtgccgcaatgtattttgactgagagaagcatagcattcaaacgatgagtagccatttacatactctctgtgctagtgcacatttgggagaaccaaacaattccttgtaaaaatagcaaatcacaaacttgcactaccgacaatcaaccatgaaggtagatttcagttagccctgaagtatgctccaatatacatctagcaaacataccagctggcagctgctaatccccaaaaatgaaactccctatgctcaagcaacaactactgctttttttttatcaaacagcacaaaatctctaagcttcagcaacaaaagtaaaacccgactgcctcacatccatcattaaatcagtaccacgaggggaaataatacaaccccttcactaaaaattaataatgtatactctttggaacatcccggtgaccataaacaaagcaccaagagaattaagtaatcaaatcagagggagacttacctcgcgaactaccctgtcctgcatcttggggagggcggccttctgcttcatgtcgtcataaacctcgtcgtaggcgaacaccgagggatcctcttccatcgccttcttctgctgctcttccaccttcagcacgcaacgcaaaccccaaacaagggtaataagtaagtcaatctactcgtgacccgcacggcccagccggcgacggtggaggggttggggggaggggattcgagctagttaccttctgctgggatcgcttcttgtacgactgccggaggatgtcggcctccacgtcatcgtcgccatcgtcggcgaaggccgccagggggcgggccggcggcggcggcggcgcccgcgacgacgaggacgccgccggcttcgtgcggagctgcagcccgtacctctgcatcgcggcggcggcgtccaggtggtgcgcggattcgacgcggagcaaaccctagtctcgggcaaggggaggaggcctcctgacgcggagaaatccctaggattcggcaagggggaggagacccgtgatgaggcgggcagcgagcgaaggaagcaggggcgacgagccggcgaccgacggcgacggcggtgagggtcgccggcggcgacctcgtccagcgactcgcgaggaagaggagcgaagggcccgagactccgagaggagttaacggcgaaatccagatgggtattttaggttggatccactgatactaaaatccagcgcgacccatacagcccacctccgcgaattgggctgcgataccagatttcgaggcccaatacatgagatacaaactggccccgtacgttttcgtgagattaaaatcccgaaaactatagcttaatgagcacactaatattgagatctttctttcctagctattgtcatatcgaatgcaatgaaaattttactgaactgcgagatagtaacaatttaaacacttgatagtgttgaatatatttggtttccaagcttaaacaaatttcggttgtgtttttaagagtagaagctttcaaaattaataattttcaacaggttagcattggcaatggtatgtagtttgaacactgctccctccgtttcacgatataagttattctagcatttctagcatttcttatattcatatagatgttatatatatctagattctttaacatctatataaatgtagaaaatgctagaatgacttacattgtgcaatgaaggtagtaccaaattttggtagtgttaaaagtagcaaaaactgaacaggccatagctccacaagaacaactgctcttttcctagcaggagaaaaatacattcagaaagaagagattaaggcacccaacgaattgttaacaatcacatttcatagaagcacgacaacttgctcaagattaaaacagcaagcacctttgatgctgtacatcatatcatcattcttaacaatacccccataattatctggtgaaacattaacaggaagacgcacaccatcaacatccacatgtcaaaacaataccacatcccgttactcagggggggcaggggcacaaaaccaaaatgagatgccactttgcactctagggtaacttctgttggtgaccacggtcgcagccgcctaaacagtggattctcataatctatcaactaattcacttttatttagcaaaccaggcagtctgataacttttttttatctcttttgtagatacatggcaccgctaacctgcgaacagaagtcagaaccagacctcttctttctctagagatatgtacacccatctctgattagttgaggtcgtgtatattctccaggggtctcagaaatatgtgaccactgtcacgagggtaatgatgccaacctaaatccttccattgctccagaatagcaaccttgggcccaaatcaagtctcacccaaagcaatcaagagctacctaaagtgggttatgttaattcactattgctgtgaatcaaatcatataagctcccttttcagctaaagctgagatttcgattgacaaatctgagattgcacttcatggaagcatatgatcgggggcattttgttaacagtacttcacaggatcaagctgcaaaatccagaactccacaacttgcaatatttgttttgatgagtatctgcaaaagagcaaataaattagcgtgtatttggtgacacacttctagtaattctttttcttgtggtgcatgtgttttgataaccaaagaccaaaacaaaatttctggaccacaaatagtttaccatcattggacaagatcacgtcgccgagcttgatttttgaacccacacttgcctctacatataacattcatatattataagaaatctagtgaataaaaatcatttcacgcaaaacataggcccttgaaatgtcaaaggcagaataaaaaactatattctgatcacacctcatgagcaccatattggcagaggctctctttgaaggctttccatcagatgtgcttgcagaaatttccatctccttcagaccacgtggaggaccacggcggttagcatgtctatgtcctgaattgaagattgacagtattaaccatagtacagaaaatgatctggagaacagtttgcatcatttttcatggtcataattgcaacaactaaatatacaaaccattttccacagggcctccgcgaataccaccatgaccccttgggtctatttttctctctccatggcctgctttgcatcatcaagtcacataattaataatagggtgaataaccaacatgatccttgaactttcacttaaggatcaatttagtccttgacatttcatattggccaaaataagtccccaaactttatagtgtgatttaatataatccttggacccataaaaatgccacgtgtacatgccacatcacatgtgcatgcaaattcaacatttaaaatgtccattctacccttatacattctccataggaaataaataaaaagaattaagaaaaagatgttgcattggtaactaaagaatgtgtcatttttcttttgttttaagattgctttcttcatgttttccttttttttttcttttttctatagaaaatgtaagggtaaaatggatatttaattgttgactgtacatgcatgaatgatgtggcatgtccatgtggcgttttaagccacatgataatctttagggatttgtttggacaacgtaaaacatcaaggactaatttgacccatgagcaaaagtttaaggactgaattggctattcaccctcaataatacaataactcaagaactcaaatgaacagtactaaaatcgcttcaaaaggaatcttaccatctgcttgctgacagaaattttcaccagaatgttgctgcattggtgagaactcagatgacgaggaatgcgtcccacctgatgcagatttgtcatagcgacgaggggcccatacaccacgatcaggcctatctctatttctagcatgtctttcagtcttttcactgatgagcccagaaccatggagatgactatgtttgtcatccaaatggtttttctcagcattttcaactacctgatctttaacaacggaacgtgggtttggaatccgtggtgggcgcttctcagctgtaattatgtgaccttcctgatcatgttgagacgtaaccacatgccgtccttccttgtttgaaagtatagtcttaataattctgccactgccctcaagccgcggatcttgcctagaactagattgtgcagcatttttcataggggtccctgactgctgctgagatgtgacatcagatgtctggaaaaaacatatcaaatgacagtcagtacagttaccaacaaaatggtcaaactattcgtggagcttatatacttacattagaatcgacccttgctcttcctttcaaaagcacaattttctcttttttgttttccgcgacatgagcagaaccagaaatcccgccacttgtagcatctacgagacaattgaacgaaacagcaatattaacaactaaaaaggaactttcatcaagacatatgggcagaaagtgcaaaaatagcatacatcaacaatttacaaattggaaggatagaggctaacagaagacgacaagaataatactatacacttcttggaaaggtaactgactaatagaactccatgcaaagacaaaatgatggaagttcaaaatgaaatccattttctataggataggacattgacgtagtgtagcaaaagtagatgtcacccaacaaggtacgccattgccataattggatggcaggtagccatacaaatgtccacaggcctatctcaacacaatagctattatgccaaataagtaaacaagcccaaactaaacttgtctatgttgatggtgcttttagcattgcagtggttttagtttttgttttggaatagtcataaaaacaactaagatttaacctatttacttaaattgtacaggtttcatatagctagatttcaccatgcaacacagcataataagatcaacttgatcttgcctcagttctcacagaattgaatcaatcagtgtcatcaccctattacctaactcagctcaaactatacattagttgatacaaccttttatcagcatatataggcatggatatgttatagcagagaacagatacttagtaataatcaataaaataaaaggacatgttgatatgaatggttacaacaaagttatagtgattatctatttcttgaatcagtaccacctgaagttccagcagtacctttttccctctgcgcatgctcgtctctctttggcactaagatataagttggcttctccttagcattctctcgtagaacatattgctgaagatcacatgaaaaaaagacaaaaacagtagcttgtcataacctcatggcatagtttttgtgcggaatgaactgggtactttttataacaatgcagcatgaaacccaaaataaccaaactgagacacagtgcactgttcaaaggttgaaaaagaatagatgaaaactcacaacaatagcccagaaataaaatatactccctgcatttcatattataagttgtttaactttttccttagtcaaacttctttagaaaaatataatgatatttttaacacaaaacaaacatattatcaaaatatattcaatgctagatttaatgaatctaatttgatattttagatgttaaatttttctataaacttggtcaaacttaacaaagtttgactagaaaaaagtcaaaacgacttataagatgaaacagagggagtataaaacatataagagcatacaatacacaaacagtagcacaaacagaaatgcacactggggacagga

SEQ ID NO: 74661 - DNA, 4911 bp, Oryza sativa
taagactactgaaacagggaacaaaaccatttttaatggattctacacatttttcttgatttactgagacttgaatgggataaacggagctcggatgaattagttatgaattttagaagattcactgtgtttattactataaccataatccttaaatactttattgcgcaataaattccagggctgacgtcagcacaggtggcgcggcgccgacatgcggggcccaccggtcagcgacacggggaggagagaggaggcgtcggcccgcgggcccaccggtcagcggcacgggaggggaaagaaggggcggcggcacccggcgcgaaccggctcaaggccggccgaccgaccgcggcgacggcgacggcgcgcgcgcgaacgggttgccggcgacggcaaccggcggcggaggcgacgcaaaagcggcggcagcggacggcggcaacgacccaaagcgacggttagcgcgggtggcggcgacgcacggggaaacggggaaggagaggagaggagatgcctcaccgagggtggccggcgcggaggaagacgatggcgaacggcgacggcaggccacgggaggcgacggcgaccggcggacgagcttcggcgtgccctaaggaaggagaagagagggattagagagagggagatagaccccggcgatcggaaaccatggccgaaggcggcggtggagatggcgctcacccgtgcgcgtggggatgagggctccggcgacgaacctcgacggaggaggggtggacgaggtggacctcggccgcgcgaagctaacggcgacgacggcgcaagacggcggcgagcctagcggcggctagtggcggccgaagtagcaaaaacggcggcggcgggtggttgcacggcgcgggagcgatggggagctcgggagaggtcggcgaaatggggaaaaagcgagagggggtgccggcgatgcttaaatagggggagagggaaccggacgtggccgggagcggcgggaatcgccggccgacgcgggggagtggggagaagagagaggcgggattcggttttcgaatcccggccatctcgggcgcgggcgcgagcgggagagagaggggaatgggcgcgggagacgcggcgcacgcgcgggcgtggtcgacgtggcccgaggaaggcggagacgtgggcgcggcgacggttgcgggcgcggcggcgcgccggaatcggcgggaggagggagacgggtccgacaggtgggccccacctgtcggcgaccccgagagaggaggcagcggggcggcctggctgccggctgggcctcggcctgcggccggcccaacagagaggagggggaggaaaaggagaaatgggccgacggcccatttgacaaaaaggaggaaaaagagaggaaaaagaaaaagaaaaaggaaaaaggattttctctggaataaaatattgcttgctcaattttaattggttgaaattatttctagagctctgaaaattccactaaaaatcctgttaatgaattttgacatgtagaactcaagaaaaattccacatgtcaagtccgattattatttgcattactttcttagggttttctcctgatttcacctgcattttcttggggtcatttgtaaattacgattttggcttgggaggaaaacttcggggtgtgacagtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtttcggctttccagcatgtgtttaattcctaagttttccattgtcaaaggttctaagtgccatagttgtgtgcaatcgaagcaacctcgcaagcctcacaaagctgccgaggaaagaaacttggcaccactagaactcctacattcagatctttgtgaaatgaaatgggtgttgacaaagggtggaaaacgatatttcatgactttgattgatgatgctactagattttgctatgtgtacttgttgaaaacgaaagacgaggctctagactattttaaaatttataaggcagaagttgaaaatcaacttgacagaaagataaaaagacttaggtccgatcgtggtggagagtttttctcaaacgagtttgacttattctgtgaagaacatggcttcatacatgagaggacgcctccctattctcccgagtctaatgggattgctgaaaggaagaaccgcacactgactgacttggtgaatgccatgttggacactgcgggactacctaaggcgtggtgaggggaggcattgttgatctcgaatcatgtgttaaacagagttcctaacagaaataaggacgaaaccccatatgagatatggattgggagaaaaccatcactttcttatttgcgcacatgggggtgcttggcgaaagtcaatgtaccagtaacgaagaagcgcaaactgggacctaagactgtggactgtgtctttctgggatatgctcatcacagcattgcctatagatttttaatagtcaaatctgaggtacctgacatgcatgttggtacaattatggagtctcgtgatgctaccttctttgaaagctttttcccaatgaaggatacacatagtagttcgagccaaccatctgaaataattcccggttcaatcacaccaccagaacaaactgaacatacacatgaacatgtcactaaggaggatgacagtgaagctcctcgaaggagtaagagacaaaggacggctaagtcctttggtgatgatttcactgtgtacctcgtggatgacactcctaagtcaatttcagaagcatatgcatctcctgatgcaaactactggaaggaggctgtccgtagtgaaatggattccattatcgctaacgggacttgggaggtgacagagcgaccctatgggtgtaaacctgtgggatgcaagtgggtgttcaagaagaagcttagacctgacggtactattgaaaagtacaaggctcggcttgtcgctaagggctacactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcagcctgatgggtttgtagttgaaggtcaagaaggcaaggtgtgcaaattgttgaagtctttgtatggtctgaaacaagctcctaagcaatggcatgagaaatttgacaagacattgacatctgcaggcttcgcagtcaatgaggcagataaatgtgtgtactatcgccatggtgggggtgagggagttattttatgcttgtatgttgatgacatactgatatttgggacaaaccttgaggtgataaatgaggttaaatcatttttgtctcaaaattttgatatgaaggatttgggagtagctgatgttatcttaaacattaagctaattagaggtgagaatgtgattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgcgcgcttgagcgagtaatgcgctatctgaaaggtactgtggaattggggcttcactatactgggtatcctgcagtactggagggttatagtgattctaactggatctctgatgtggatgagatcaaagccactagtggatatgtcttcacactgggtggtggtgctgtttcatgaagatcttgcaaacagaccattttgacgaggtcaactatggaagcagagctgacggcactggatactgctactgttgaggcagaatggctgcatgatctattaatggatctgcctattgttgaaaaaccggtgccggctatccttatgaactgtgacaatcaaacggtcattgtcaaagtgaatagttcgaaggataatatgaaatcgtctagacatgtgaaaagacgattgaagtttgtcaggaaattaagaaactctggagttataacgttggattacatccaaacagctagaaacctggcagatcccttcacgaagggactatcacgaaatgtgatagacaatgcatcgaaggagatgggtttgagacccatgtgagttatactatggtggtaacccagtctatgtgatcggagatcccgtgaattggaatctgggaagaacaaaccataagtaaattagaggagagtaccaatctataccctctctaagtgaagatgcatgtactctcgtgaactgcaaggcaggttgactatgccttaatgagttctgttggctttaattggcgaagatgctgtcctgcagagcattcttgaaagaactcacctttgtgagcttgattgttggtcgcagtctatggagattttgggtgaatcttctaggaagcttactaaagacctaggagtatgacttatacgctccacccgaggggtagtctacagacggtctagtaccagataagactctgagtgaaacttgcttgcacaagacttgcaattcaaggcttagtctattgttcaagttgtgagtaagtgtagcttggagttctaggtggatgttcacccttaatcggtctccatcgaact

SEQ ID NO: 74662 - DNA, 2165 bp, Oryza sativa
tgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccatgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcttgttcagcccaatggccaagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcttggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttccccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccacgcccaggtgaggaagcggacttgcacgcagtacagcgaagggatgatgagtcacttcgctcgtacattcagcggttctgtcaagtccgcaacaccataccatgcatccctgcacacgcggtgatttacgcgttcagggggggtgtgcggcacaaccgcatgcttgaaaagatcgcctccaaggagctccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcg

SEQ ID NO: 74663 - DNA, 12641 bp, Oryza sativa
  unsure (1)..(12641): unsure at all n locations
gtggagtttagtacccccttacttattctaggaaagggagacctccttaaaagggaggatgccctcctagccacttgaagcatgtgtggtggagagaagagggggaacacacgcgcgcgctcgctcgcctggccctggcctggcagggcaggcggcgctcgtgcacgacgtacgcgtcgaatggtccgtcaaaattggttcctcaccttgcgcagatgcagtctcctttggcagttttgttttgctgcaaattcggattcgtttttgttttggaaacatttcgaaaaatccggtgcgtgcaaacggcgtggagtccggataagttacgcgcgacttatccggttcggttacgcgcagtggagatcgttcgggcgccctgatcaagcgacccttctctatataaaccgagccgccgccttcacgcaacacacgcgaaatcaatctagggtttgcctcctactctgtgctacgccgtcgctcgtaggttactccatcccgctcgctggcgtgcacctgcgatcgggagagcaggtctccgaaacctctgccttcgacgtcctgcaccgggagaaggcaacaataaggtttttgggaagcgctttgcacgactgctccctgttcgtccgcgacggctcgtcttcctcttcgctcgcgcgctgcgtgccttcgtagacgcctgcgaaaagtttcgaccgagcagccggtctttccgccacctcggtacgtgttcaatatgttgcgcagtttgatctgttcatgttatactgtgtagtttacatgtgtagatctaatgatgcgttcatgctatttttcatctgtaatgtcatgatctatttatggaatagattaaatcattatatgcttataatctcaacaacagatgcttaaatagaagaggctgtatctccatttgtattgtaatattttacaacactatgattctaccaaattgaaacgataccgatcccatctaatatttaaattagtttacatagtattttcatacggttctatggaatcttagatattacattgatttctatgatctttataatcctacaaaatattattaaaaataatatgaataaatatgcttaagtttacataaaactgattaatttttttaaaatcaatactatatactataatttatacacaacacacacacacacacacatatatatatatatatatatatatatatatatatatatatatatatatatataatataaaaataagtactttctaaaatttgttagtattccaatcctacttagcatctcgatacggattacctttggatggagtggagccaattgtccctgtgtcacgaaaattgaattgacgaaaaataccctccgtgtgagtgtgacgcaccttacatcccagcacagagggaggtggagagcacgaatctcagcgcatggcctgcaccaaacatgatactactcggtgcagcagttagtgggcccgcattgccattggctgcagggaccagcggagtgggtagcaacgacggacggcgcaacgtgtgggcacgcgacaccgcacagcaaaaaaaaagggtaaaatgtcgggtgcaggcacaaccccaagtaaccaccactgaccaaagggccccacgtaccatcctaccccacctgtcagcgtgcgtaccgggtacagaacccggtgcaaaaaagaacaaaccagggccgtttcacgctttaccagcctggcgcgtcgcgtccgtccacatgcccccgcactacccctcccctccacatggcgcgccacacccacgagaccaccacgtgcttgaccacatgggcccacctgtcattcactccaagatctccggcccgggtcacgcgcgcgcggccgcattgattaataagggggaggggaaaaaaatctcccgtgggccgctgcaggtgggctccacgttagctccgggcccacgtgtcatcggctatgtaataataatataatataataataataattgcagtatataggggggatatagtcgcggtcgcggggagccctaggcgagcgagggagaaagagagaggcgttggtcggtggccgcccgtcgcttctcctcttccgacgccggcgcggccgagagaaatggcggtggctgcgagggctccgctcggggtggtggcggtggtggccgtgctcgtcgtcggcatcttcatgcccgccgcggcgcaggccccggcgcccgcgcccgtcagcgacggtgaggatatcgttgcccgcctctctctctctctctctccctctccgaagccgcattgcgcgccggagttctcgtctgctccgtagcctagcgcattctggttctctggcaccgtgcggcggctgactggttccctggttgttccccagttgttcgtcgatccaccaaaggggaaatttaatgccctctcgttaagagtagatttaattttgttttttcgacctgcgcctgaaatgtagtacgcattaaccttttttttttcagcaccagcatctatagcttgcgttagatccctctttttctaattttagacgttattaataattctagtatagtagtattggaccgagcatatatttagtgctataaatcattcaaaatcttcggcagattcggatctctgttgtgacgtccttgaaatttcctttcaatttcagttccatttggcaatttctgcagcgcattacacgaattaaatgctatatgatgcaaataccatatctctgttgtagtgagacgtatactagaacgatctttttttgttttgttttccaattactagatgatgtccaggagtagttgatctattgggcgtgctggatagatccacagtttacctttttgttgcaagtggaggcaggcagcttacacttgcctgtcattttatactattattggtggttcccgttcctggagtagctttcagttgatattggttgccgcccctttacacgtctctgactgatgttacagtttgggtagcctgaaaatgaccacaatttctatcaaaatgtgccatctgtaacaactgattagtggaggtggcaggtattacaactttacaaggatgcgccatttgtattactgaacgccgcaaatggcttatctttgtttagttatgaccttgacatataatctgttttaacttcggtttattattacgagtcttggtaacaaaactgtaaacaagaacaacctgtgacattttatagtatatgcaagagacttaaagttccattttctacttttctaggcctcacagccaacaattctctatctttgtgatcaccttgtatgatatgcttgttatatctctctgttcgcacgaattgaattaaaaaagcaacgtggtaactgtgatatgccatttcctatcaacatagcttcactatttttttttgttatgaacctagttgcaatttgccacatgctgttggtttgctatctattcgataactttctccatatgctgttttgatttaccatgacactgatgtgcattttgctcctgtaattgctttccgcaggcacatcgatcgacctggggatcgcatacatcctgatgctggtggctcttgtgctcacctacctaatccatccactggatgcttcttctccctacaagcttttctaatcccttgttcttccttcatctggcttggttagggtaaattctacttattatttagccatggcgacgattgttaacattttaggtgagatgttaggaggtttggagtgatttgtctgtccatgatgggggtggtatcaatcagatcgttgtttggtggtgcgattggctgtattggattccatgatttggtgccaagttgtgcgtgctggattcgttcattttctgtttcttttttagctggcctgtgactggttggcatgtgctctctgacgtgcggtggttttgtccttgtgacaactattgcgcctgcttgcctgctctctgtgtgtgtgttggtgctcgtcagcactactgactcgatgacggtttcggtttctctgtgggccgatgcaaatggtcattgttgtttttattcccaccttgtcagtcaaaaaagtttcaaacgactttcttcctgtgaaatagtagaggtaggccttgtttagttctaaactttttctttaaacttccaacttttccatcacatcaaaacttttctacatatataaacttccaacttttccatcacatcattctaatttaatccaaacttttaattttggcgtgaaataaacactcccgtagtagtagtagtagtagtagtagagctgataagtatcccttccggtcataataataatcatttgatgacaagatttgagcgctttgtgtttttggtgacatctcggtttaaaagggagtaaatttaattgtggtagacctgatgaacctcaaattaagatgcatgccgcacggtatataatccggattgtgttaagacggacgtaatcctgtctgcaacataagggagagcaataaatgtgttgatggctcgagtttagtcatttttaacaagacttttgatgttgcatggatccaccgttgtttatatccgataattttagtgcctcgagtagtgagttaagttgatatgtgtaggtaacttgtgcacgaaagaggatgctttggatgatctgatctgaaatagtaagaaactacgaagatgcgtcaaaaaccacgcagcacctaaactgggttgggcctaattaggctgtactaagggtgtgttcggcaccccttttcccccttttgtcacgtgcatgtttttcaaactgctaaattgcgtgttttatttgcaaaaagtttctatatgaaaattgtttaaaaaaattaaattaatataggcaaaatatataaatagtagaattaatatttccttaatagagaacatatggaaaatgattttattatttccgtgctataaacacatctccatcatcacgcaacaaagtaagcctagcaatgctttagttttccttcaaggcactaaacgaacgtaagatcagggcatccaggaagtgcccatgcgtaaaaagttggtaaaagattattttaactcttatctggcataaaagtttagcattgacaccgctcaacaatttaaaccaagaacgccaacttagatcagatgcaatgcaatggtgacacagctcagcaggtcttgcacgctttaattctagacaaattgcagaccgtctctcaggaaaagaaattgcgtgtgtcgaatgcataaaaaaaaaggtagacttcccctacaaacaattcgcgctaaaattgattattgctgctatccaatctgaactatctatggagtattaggagttaaaatttggatattcgtagatgaataataaccaaccctgtctttccattctgttcagtaatagaataaaaaatgacaagagccttattttccctaaattctctgaaaaaagaagaaattctacctctttatataagatttaatgaaaattgagatgatcactccaatcctttagttatattcaatcttgtaatcttgtatacttaaatttcaatcctgtaaccctgaacaaaaataatatatatgctccaataaacatcttcaatttcaatccagtacattgccaagacaaagaatagcaaaagaattatagtgaaaatagcaggatttctgcactcccctgtgttatatgcctgacatatattgtggcattcgatcgtagcctagatcaatctgtcctacaggataaaaaaaatatcataatgcaaataaacaagagatgctagccagtatagtactgttttggtgctgcaaaatttccttggagcaaactgtatcctgctgcctgttcatgtccattggtactgccctgcaaaatcaattggaagcaagatctactgcaaaaagggaaatgtaattgcaggagaacagagattggccaactcacagcatggtttcttggtccttgattgggtacatcatattatcctccatcctctgattgaaccaaaacaaaaattcccactcaaatctaagaaacataaccacatatcaaccccaaatcaaatgaagtcccaaatccagctatacaagagcagcacaaatttgttggatctggagaactaacatttaagggcattgtgttggttttggagaagaaaaaattctggataatacacgtatgtgcaattgtagatatagcgatagcacctagccgtgaggtccacactcaccaggccgaccacagctccccctttatatggtcgtactgttctggtatgcatttagcaaaaacattttctgaattcctcataaaacagagaaatgtcaatctctggaccgtaggaccagagatggggaaccaaattcactgcaaattaaggaaccatctgtttaacttttcacatagataaaaagaaagtagataaactttatagaggttgttgaggaaatatcataaataaatccaaattaaaggtcaccatatctgacaaattaaagctacacttgaccatagacaaattaattaaccgggcttgctagaaaaatctgagattgatttggtagcaaactgcacaagagtgcaatgaacgcacgggcatacaagcacctagaggaatcgatttcagataggttcagttggcattataaaacaatatgcaaacacctgaacaagcacctagaggaaccaattttaaataatgcatggtatatataatacaagtgcttctgaccaccatattctagataatcatgacacattgttcagaaatgcttttgaccacagtttttcaggtctccactgatttaaaattcagaaatttattttgatggattattaggaaggaaagcagcaactaccaaaattcagtatagcattataggatccaatcaaacaaagtaaaaatacacaaaactcaacatgtataaatttgacaaaggataaactgaccttgcaataaattaagagcacctcaatttcataaactccttttgttatctcatagctcattgtaagcagatattaggtgcaaaagatgatacttacaaataaggatcttgtattgatcagttcaacaaccaaacttctatttatcactaatcaaaagtaggattgtactgcattgatctgaaaaaatatccgtcgcatgagtataaggaggtcaatagtgcagatgatgtgtagcatgactacaaagtttgccggaatgaccgaaggaggtcattcaatgtaattaagataggaagaaaaagttacaagaaaaatttacatcgatagctggctgtcgaggaaggatgtgcaccagagcacacgccccgaaccatgtgccaaccgtccgaacacacactacagagagggaagccaagcaccgaaccggccatcgctatgcgagaccgatcgccaccgagctaacgacaccactacgacacgaagactctaaaatgacgccctcacgagggtcgcgacgccaaaagacgccgtcgtcatctatccaaagactggacaaggttttcacccagagctccttgccgagggaggagggatacctcaacagtgccctcaagagggttactacgtccgaaggcgaagtcactgttggcccaaagaattgggctaagctttcgctcggaaccccctgcccccgtggtacattacccaatccgaattcaccatctgaacatcggcggcacatgggtttcggcacacccgaccgacgccccttcgtngggcggcttcatcgaaccaccattcctgagagctggcccaggacctcttcgtttcaccacccgccgggcttcttcgcagatctgggcgaaggagaatccgggattggatggcatttgttcagcagcctgagcttcccccgctgacgagctgccacctcaatccagcttagaaactccccacagagaaggggaggagctccaggaagggtgagggtgttgaccggcaacgaggaagacgacccaccgccgccagctcccttagcacaaccatctgggcctacgccgacgccggaaacattgccgctctggctccggcgccaccctccggcctcccattgcccggccaccgctccccacctggccaccacggcgtaatgctggcagtacttacagcttacttagaaaatgaatagacacatagacaaccaaatttgcctcacatgactcacctttgccgcactcaatgtatcagctctgagtcctttttgttcataagcgaggaaggaatcaataagggagtactgcaatgttaaacaaaccaacagatcaaatccctaagtaagaatgcacaatttcttaatataggaaatatatgttcaaatcccaaaatgtgagtcatgttctgtacaatcagtcatcaatttcagtaaggaaactatatttctcataggcatatggactcgattatgacataatttgactataaatgaacagaataaacttgcagggatgtgagcgcatgttacttgcatgtaaggaccttgtggatattgacctgcatcgatagttggattgtgctgcagtgaacaacaataagatgaatttcatgagcataaacgggaatataatattgaccaaatgtaaacctcactctaataacacaaatggtcccatttatacaaaagtctgcttgtttttatactcactgtttgtattccgatttaatatttcatgctatcattatgtcaggcaataacaagcatccgaactcatccaattgtagaagttatatcatatagatagtgcaattcagtttatattttatttataatggccacgatcaaaggataactcatcagctgaatgaaattgtcacaagagaaggtttccaatactcaccttggagagagcagatagcatgacaatcctgatggggaagggatgattttgatttggaataaatttagcacaatatctacctaaatgaaatgaaaccaaatcaacgagagagattcaaaagaaaataccgatgacatcctaactgcagcaaccaaatgcagtttgaatgttttcaccagtaagttcacaactcgggcactaccataatgagctggtttcaacttttcacaaaaaaaagattctgaaaaaaagaaggcgggttcatgagatatttgaccatatttattcaatagttgccgtcaacagtggaacatgcatgacataaataaatataccagtggtgcaggcattaattctcttaatactccaggttaatatcattggttctgaagcgatctaccagtggtgcatacatttattttcttaattctcaaggttaataccactggtccttccttaccacttgaggctttgacaatgccatcagtccatattctaaagatgatgaactacaacacaaaatggacagttctgtaatttaaaagtaccgaacaaaatctcattaagaaatatgtatcttgaaccaaaacattcagactgaagcacctcgtgtatttctccgggctaatgatgccagggtttaactaacaaaacataaaccagaacggagatcgtaaattattggctttttctaaatagcaacataatgatatcttgggttttttttctcactgaacaccttttgaatcaagaagaaggaacgcctgctggttttgaattgaaaatcctaaaatgcgttctctaattacattagatcagactaaaaacaaaatcataaacaacacaatctgctatccctactgacatggaagaagcactatacctttcatcatcctcaaaacctcaagctacaacaatcaaaatcgatgaacaacatcaagagtaaggacaaattagagaatcggaaggaagcagcagaggagtagagtagcagaggagggaagcagagaagggttagtcgggttcgtcacaatggaggagcagatgaggaaagaatactccctctgtttcacaatgtaagactttctagcactgctaacattcatatagatgctaataaatctagatattactatatatatatatatatatattcattagcatatatatgaatgtgggcaatactagaaagttacattgtgaaatggaggaagtaccattttataacaccaagccttcatcacgagccaatacaccactactccctccgttcaaaaaaaaaaaaaaaaactctatcctaggatatctagattcgttgtcctacgataggtcacgtcgtatcatatcctatgatatgtcacattctatcctaacttgggttttttttttttaacggagggagtacttattggcgatgcaatagccaacggctgtgcatgcagtcaagacctgcatatgatgccattgaactggtgtacggtcaacttgtggtgtaactctaaaggagaacgtgaggctacctatactgagaggcggaggcagtttctgcgcgtcgtgtgaggccatggctgtcataaggaagatgtgtgggagagaacccgggtccatggcgaagatcagagccggcacagccgccatcgccagggcagagctagagcgaaatggagggtggtgccatttgcttaatttactctactttagatcgagtttaagctgatgcgggtgcctaagtttgtattgaggggggtgcatgcatggtgaaaataggtgaggtatagctaaaaaattttcttgaccgggttcctgggcaccccctattacatagtagctccgcccctgaattatttgccaccagcagaagccaccatgagcagcgccaccaccaccagaagcagcagaaaccgtcgccattgaactctggatgctgagggagcgaccgtgaactccgagaccgagttatgtgctaaactatattgactaaatatggacaaaacttgcatcagtaggttttaaaacttaaataaaatcatctacatgcacctgaattcacatggagctgctggtagcaaaaaatagaaactcacatttcctaatggctgacatatatacttgatcctagcatgtttgacaattctcaagggttgaacacaaattcagtgactacaacagaaattcagaactcatgtgaatcctcctgaactcggatgcattttgatttttgaaatgtattgtcaaatttaatcatagcgttagcacggggagaactcatgtgagtactcctgactagaggaaaaaggaaatgcaggagtaatacattacaaatgtcatctcttgaggtgctaaactgtcagatatttttccagaacaaagcagtatgaacatgatattgtactgccagatatataaatttgaattcctcagattacctcatagcagcctagcatgtagccttagatttaataaatctccaattgcttcagctggaaccacaagttgaaactaaaatgcagaaaacaaacaagtcattataaataccctttattgacatgttcagatccactacaaaagaaattgatggtgagactatactatataaaatgtcatctcacagattatataccatgtgtatataaatttggtggtggtatataaaactaactgagaaatgaatcatatagaggtttggtggtgatatctaaaactaactgagaaatgaatcatctagaggtatagaacagaggcaattgagagccgtagatcttcctattattcccatgttgtgacagtaaattttcagacttacctatcttatatttttcagaaactttcagtgttaaaatagatgatgttgcatccctatgtatgcctatattttatatatacatgtctattaagagaaaagttctgctgcagcagaatatgcatgacaatactaaagaccataagagaacatgtaagtaaccttaaattaaataaccgtgaacaactgacatgtgtaagatagtaggtgttgtctgattttagagttaggtatagcaatcaagagtttaggttttcacctagagattatagcatgtgggttcacaaaatctgaataactggagctgtatccttaaagcatcaatctgggaacagaaaaatgcaaaagaagaattcgtccggtgaaaacatgtgggtttgcaagttgaaaaatggaaaattcaatacattggggatgcaacaccatctatttcaacatcatctattggccggcggaggggttcgatatagtagaaggcataggttactaaggaggtttcatacatttaaaatattcatgtatagatttgaaagaggtttgaattatcaaatgaaaaccgctgctcacaaccatcaacttgaaagtcccaactcctaaaaaccaaaatctatagaattcaatattagttcgattgctaggtttctgaaattgtaatctctactgtcagtcagtcccagtcaacaaagcatcatgtatatagaagtgattccttgcatgagttgaagtcaacatgagcaatgaacaaatataattgatctctgcatgactcagatattaagcaagatagggatattatggaagagttgaggaccttctttttctgttatatgaatttttcactaagacaaaaacttttttggatacactattactaaacagtaggtaaagaatagacaaattagatgtatcagaaataaaagttgtaggaatcacgaccaccattatggtcttttttagtagtagagataatgatgtgaatgtgttaatg

SEQ ID NO: 74664 - DNA, 3886 bp, Oryza sativa
agccggatagtccgacatgcattgttggacagtctggctcaacgtttgtttggctgtcactgtgtaagttcaagtgccttaatttggttttggtgattaatgacaaatctagttatatgagattaacatttttatgagcttttgtttgactagtctcatttggatatgaaagtaaaaaatgattagaggtatgtattaaacttcacatattctaacttggtctctcttgtggatccaaaatatagtgtgagctccctcattgatcttgattgattatgtgcgtatgtgttcctttatatccatatgtatgcacatcttgagggggaggttattctatattttgtttattataagatttctatcttgatttgaaatcatctttcatctcatctctctatattgtttatatcggattattatctatcacaaaagagagaaaagattgaaagatcttggattaaacaatttgtgtaattgttgctttagtgatagatgataaaccgatgtttatgggattaacctctcttttacataagttttcaacaaagttatttcccgataatgagatgtggtagatatgcattctttggtgatggaccttaatcatgacaaggatgaaattcatggagataaagcaatatgtatcacttcttatctcctactttttgataggttcatatatatgatttccatgttattgttatataagtgtgagactaatgtttacttgagtcttatcttatttagtctcctttacattgagaacatggagatcataaaggtatgtgttttttgctttatctttatcattgctacatgccttctccatgtgtataggataaaccccattggttcttcataacttatgcatacacttgcctctcttgtatatttatttgtatgcatatatttagggggagcaaatcctatacatttattgtgcatgttttagatccacgttgttcacctattatttatattggatctttgcatttgagcttgcatacgagtatatgacacttgcgatgttaatgaatactcaacaaacatatccatatctttcatatgcaaccggttggtcaccaagtggaggatgacaaccgatttgttggtactaatgttcttctttgagatgtgcaaaggaataggtctaattgtgatgaagctaatggatgacaccatgggttgatggtcaccaagccaagggcatcgccatgtcaacaagaatgaaatcaagcttgtgatgagaagaaagtcttgacaaatgatggtaaataccttggtataaacatggttgaatcaaatggtcataagtattgatctcgactcaagcttgaccccaagatggatggcgcaaggcaaaggtactaagaatgttttcttagtcttttcccggtcttggtgtttggtgtagaccagatttgctagataggtgccgtactatcaagaggggtctataaagcgagcttgtggatgatcttgtgccatgttagttcatatgcatgtaggtgcatttggtgggcttgtctagccaagtgtgatgagttttctcaagtcctaaaccaagagagaagtgggcatgtccaataggagtgagtgacatcttatgggtatgtccggtggatatcctttggagtttgagccctttatccttgacttaagttgtatttcttggatggttttttcatgggttggatggccctttgaataagctttccatagagtccaagaacgccaaattccgagacccgagtcaagagatatcgtcgttttactaacggtcggttaagctgaaaagtgacctgcggtctgaccgtgggccttaggccggtctggccgggcctattagccggtctgaccggtgtgataaggccggtatgaccggccgcactggtctgttgcactggtctggtttttggtgacgatacagagccgctagaaccacaaccggtcagaccgagccgatggcggtctgaccgagccgtggacaatctgaccgcctactacactgcggtcagaccggccaggttgagtgggctcaatggttgccctgtaacggctagttttctagtcgttacaaagtagtccggtctgaccggccactctatggcgatctgaccggcagagcacaaagttggggatttcaacttcaacggctagttttggtggttgggggtatatatactcactccccagcagcaagggcaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagtatcctagacttgttactcttggaggttgccgcctcctagacggcttgtggaggtgttgcccggtgacctctccgaggagattgtggaggaggcccggcaccgtttgtgagtggtttggagttcaccaccttcagagtgaaggaagaactaccccgagttatcaaggcttggatagtcctttccgtgggccggctcccgccttgcccaccccttgacgaagggggcgtgcggtggcttcgtggttgagcggtggagttgggctcgcctcaacggggattaggaaactggcgagtttctgaatctcggtgaaaaattccttgtctcttgtctcatttatttgtcgcatttacatttgtgttatttacattcatagagacatatttgagcccatatcacttaggtttgcaaaacttaacttagttgcttagttaaccttgcacctcaccttgcctagcaacttaggttagttttgtttaagtgccattaagttttaaaaccgcctattcacccccctctagtcggtctccttgatcctacacactgggcaatggtattgaactaaccagatggtctagtgtcggtaccggacaatgggcaatggacagtccaagtgataccagattgtttggctctttatagcccaatggctatttggttagttaccgtttgaaaggtgtaaagagcctgactgtccgttgcgacaccagactatccaacccaatatattttctagaaacatgttcgaacggtagcaaatggctagttagtgcaatagagcaacctaatggagagtcccttgagcttatttgggatcaaatccttgtaagtttaatgctcatagtggcttagtgtgcgcccaccgagagttccgttcttagtgtttcaagtgaagggtgcatcttattgttcttgacatctttgtatgcctagctagcctcagaggcgaaccctgtgacgcctcaagatgcttgtggaagacccgatgtgattgtgaagggtttggggttgaaccatcaagaagagagcgccgttgaaagggagcaacactcctgtgtgtgctccaatgaggatcaatgaagattgtgtttgattccttctctctcttcactctcttgcatttagatttctagcttgaactagatttgtgtgtggtcagctgtaggttgcagtccattctttgaaacctgggcacttaggctaagtttatgttagagtttctaattttggccaatttgtttagaactaaattggagctcgccattccctgtcttcgaaaaggagcggcaaggtgacaatttgagagagctttatcccccctggcaccaactatatcaaatattatgaccaaatgcagcagtatttgtcttcttttgtaaagtgcctagaaaacatagacatatattcatccaagagcatatttttagaaacagtctaataatttaaagagtaaagtgcattggcggtccttaaacttgtagaattgtgtcatataggtccctaaactctcaaaatgcatat

SEQ ID NO: 74665 - DNA, 5025 bp, Oryza sativa
cgccggtcagattcccgcctgagggcctctgcgaccgccggatcctcggcctcagactggccggacttggaatggcgggagggacgcgacgggatctcgctgaaacgaaagaaaataccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctacttcctcttcccccgggcgtcggcagggcggctgctccccgggcccctatcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggtgaagacaaggggaataatggcgaaaggaaggaaacagatcccttcctcagtgcctttatactcttgccaacgctgtgcccggctccttgcttctcgcgcccactatttcgccccctcgtttctcgcgcccacgcttccactaatcccattcgcccgcttgcggcgcatgaggtggatatgcggttgtggcagtcgaaatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgtcctagctaaaaagccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggagatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacgacaactatacaaatctccgtccatttatgaaaagggggggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcagcccgaacctgtatacatcgcccgtgtcttgtgtgtttcctgtctcgcgagccttccacatacagagagcttagaatctctccctgagtccccggccgaaccggcaaaggggggcctacgcggtctcccggtgaggagccccacgctccgtcatatgtcataataaggacacgatccaacatgtaacatgtatttggtgtaatttacttactggacaatgaattgacaaataccctgcaatgtgatgtctaattttatctactttcctccaatgcatagaatttgtaatttaggcagagtttgattcagctagttggcttaattacttcctcacttttcaagactcagggcaatctttttcttcgcatatgaccaattacaaatgtaattgtcactacatatttcttgcaccggcccagtagtttcatgagaagtacatcttaaatgcaagccatataattgcttatgggcttttggcccagataagtcataagcgcgtgttcggaataaaagacaagatgagagattgagatcggttttatcccacgcgcctttccctttctacatgccactcgtataacacaaacaaagccttcacattttgttcattgcttccctctctcacattctcaatcggcgaatcctcgtgcttgttggtaacctcccccaaaccctagccgccacttcctccccccccacccccttgctttgtgccgaacatggagggtgaaccctcacgccgcctctctttgctggaccggtgcgacgatgggagcgaggatccggtggtgccaccgcgagttcccaccatcctcaacctcacctcccaccaccgtcttgaccgatcgaaattcctaccattgatccaccctactcctgcccgcttcatctcttcaacaggatcttccttccccccctactcggaaccaccaccttcggcccctatgctagaacttggtagtggctttgggcctgaagacttatactcgttctttcctaatcattttttcttgatggaatccatcagtctaccaccatatgatgttgtagatgtgccgccggtgatccctgtcgcactacggtcggggagatctaaccaggggcttcctagcaagctaccgcttattgaggggcataggcggtcgcatagcgacatccccttcgggtattcacaagaacacccacaaatgccacctgtagcatcagttaagccggaggtcacaacgatcaaggggcaccaattggaggatgtggcggctgctgccctcaaggacatgggcatacaggcatggagcccttctggtagcatagacaaagaagttaagagctccggtgctggcagcacaacccaccattgccgcagcttgtcggttgacagcttcatgatggggaacctcaacttcggagttgttggacagcagatgtccagcccccctttgctaactacagaggtgaatgttggtggaggtgagcccattggtagtactgcttctccctttgctgcagagcttgcgaatgtgaaattcactgaggatgagaagaagaagattgtgatggataaatccctctcagagattgtcttgactgatcctaggagggtcaaaaggtgtgtgagtttcaatctttgtgtacgagactatttagggggattgacagtttgacatagtgttttggttactgaaaatcaacatcttattgtacattttcaggattctcaacaatcgggcatctgccacgaagtcaaaggagaaaaagatgaagcacgtaggggagcttcaacgcaaattgcaggtgctgcagtcggaaactactacattaggtgcacaagtgacagtgatgcaggtatgttttcaaaacaagtaatcatttgattaggagttttcacaaccttagttactgttggtgttgtttgtagaggaacaacaatgagcttgtatcacagaacaatgaactgaaaactaggttgcaagcaatggatcagctagcacagttgggagacggtaactttccttccttgtttttcagcatttatttgtt

SEQ ID NO: 74666 - DNA, 5044 bp, Oryza sativa
ccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacctaacaatggtatcagagccaccctagagtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcagcgaaggggagtgggacggcgccgccgtgtcgccatgccgccgccggcgctgtgctagggtttcggcgacggcgacgccgctccgtgcaaccgcaagagaaagaagagaagaggagctagggtttcggcgccggcgggcgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgttttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacaggagattttaattttaggaacattaattatgtgctatgatgttgtaatttttctgaccaatgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaagcaacagtttacagttgagacaagatcagtgtctacattgcaagaaaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactatgcaaagaagtgaaagatccattagagttgccaatggagttgaagcaaaagttgaggctggagatcttcgcctagaactcgcgaatggcttcacacttttacttccagacgtttttatgttccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctcagttttagaacaatgcatacaatgcatagaatgcatcggtgcccaaaacaccgtatgagctatggatcctccgtgtgtgggggagtcctgcaaaggataaagtatttaacccaaaacagtaagctgccattttattggctattctaaaagatcaaagggtcatcgtttctactgtccaaacagttatacaaagtttgtagaaacgggacacgtcgtcttcttggaagacgaaatgattagggggagctcggtaattcgagaaattgatcttgaggagagccgggtgtctgtacccgctccgtcgactcagcaacctttcttctctctacctgctaatgttgtgccagcaatgcatgccgttgcggtaccaaacacctgttgtatctctcctgtggcaacaatgaatgaaagtgaggaacctgttctacaggattcaacagaaattattgccacatcagaggaggagatgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaatgagccaaaacagtaggctgtaaatgggtctacaaaaccaaatatgactctagagggaatatagaaaagtttaaagtgcgactcgtggcaaaaggcttcatgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgccgtataaagagatccatttatgggttaaagcgaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgttacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcccagtgcactggaaattggtaaagaaagtcttgcgtgtttgcaaggaacaaaaggcctcatgatgtcttacagaaaagcagaatcgctctagatagtggggtattcggattctgactttgcaaaagataatacaaagttaacatcgggatacatgtttaccctggcagcaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaatccacagtaatgtactctcacaacaattagtcaagtggtgctgccaaacacattgacataaagtactatgttgtgaaagacaaagtccgggatcaaacaatcagtctcgagcacataagaacagaaaggatgctcgcggat

SEQ ID NO: 74667 - DNA, 4343 bp, Oryza sativa
aagcgctccaccttttttatgttgaagattgcctcgtcatcgcccgctaccagcaagtcaatcctcccacacttgtagcaatcatttgcccaataagttagtattgtctgctcttcatctaggacttctaattccacattcttcctgcagcacacaagctcaagcaaaatcaccccaaagctataaacgtcgaccttagaagtaatccctatgttcttgaaccactcaggtgcaacatatcctcgagtaccccgaatgccggtgtttgtttgtgtctgattcaccggaagaagctttgctaggccaaaatctgaaatctttgctacaaaattatcatcgagaaggatattctgtggtttcatatcgcagtggatgatttgtttattacactcctcatgtaggtagagcagtcctcgtgccaccccaagtgcgacttgaacacggaggctccaatgtggatgggtatcgctgaagaggaatgtattgagtgatccattgctcatgaactcatacactaacagcctttcagttccctcgttgcaaaaaccaagcagtctaactaagttcctgtgaaatgtctgcccaatggtttggacttccaccaagaactccttttgtgcttcctgctgaagcttttcgattttcttgaccgcgatgttagtcccaaactcatcttgcagctgtcctttgtagacaacaccagaggctcctgtgccaagtacttcttggaaaccaccggttgccttttccagctcgctgtaagtgaaaatctttggaggtaatccagagttattggacggttgcgataactgggttttcttcctcgaggtgatactacaataagtaccaaaaagcataacagagattaggagaaagttcaccaatacagagcttccaaaaagtaatgaactcccaagaatccaatactttttggtcctccttccatttgcttgagccgctgctgaacacggatggtgaattggtgctcctaggcaccttaataagaactgtcctcggtacattgacatccattttaccgttcgacaaagggaaccttttcttccaacaagtgcttgaagctttatcgaacacagctacggcacagaaacaatcagtcacacacagccttcggcattcggtctgatctatgggattgtattgctcatagtcagatagaggccaatcaacgcgatcgattggtgccatgtcatactgcaacattgctgtcgtctcatccagatcacagttttgtggctcaaaatctggcctgcagcctttgtatttccttttatcatcgatgaacttataattctgtgggcataaacaacttgtcgtgttcttggtgccatcaatggtgcagtaactgttaaagccgcatgctccactacccaccattgtttgtattgactggcagatgttttctggaagtacatcgactgcagtccattgctctggccataagggcctggcatgtatgttttttgggtaaacatattgccggaacacaccatctgtgtcaagggtagcacgatggaagaaatcacccatagagtccacccctgcagaagtgatatttacctgtgaaccattaattatagtgaagtatatccttccagtttcattgaacactagctgtgagccattgtccactgtgttactagcccaatatggatcgtataagtatccagaaggtacagcatctggatacataacaagattaccatctcgttgaacttttagttgaaatcggccattggaatagtctgtggcgaggagacggctgtggagtgccgtccccagtgaaagcacttgtgtgggtaggatggtatcagaagggtcaccaaaggactcccactttgttgcgccatcggtgcctaaaagcctgaaattcccggtgtcgagcattctagcatagcccacatcagtgacttgtggattccatacctcattgccagatggatcgcgaagagagagtgctccatcagcgagcttgaggacagagccagattggacttgtaccggtattgtatcatctttcccattggagctagtccttgcgtaccagacgacggtcttgtcagcgatcttgttgaaccagacggcgagcaggtaagaggaggagtttccatctaccgccagaaaaccgaatgcaaaatcagcagagggcgagatccatgagttgtttaccccctggggtgtcaaagaggagcctatactgatgtttagctgagcttgggcagatttcgtgcagtatagtagcaagagttgcaggatgggcaagaacaggagatgagccattgctattgatcaaccttttgctcgtactgatgacaacaaaacttatagcccttggagaacggcatttgttagtcttgagacctgtgaggcaacggttgaacctgtcaaaagcaattacaaagctgtcaatatgatagacatgagagggagattagttcacatttcattatcagaactttagaaaatgtcggctttgaatgcattaaccatgctgggttctcctgacatgatccttgctggtctttcctaccgcgtttcagaagaacagttttgaccagcttaggttatggtcaacccaggtttaatcttatcatcataatataggagtacactgtaacattaattgatcaggttttttttgacagagccagaacctgctttgctgatcgtaaggccattcctactgggaggttcattttgaggtttccaaaagtcacctaatctaaataagctcggattaatggatgaaacatatagacctccaatttacagtttcatatagatggtattgttttttgacaatgtccctgtggcatttaatttaatcagaataaaactcttatgcatgaaacctgcactaaaaatggcctaatatatgttttagccatttctaccacgcaacgtcagtgctccattcaaggggagctaggacacattgactaatgatgtccgtctatctaatttaattagaatgaaactcttatgaaaccatggtagcaagtagcaacatatattttgaacattgaactggtcaattggaatcagtacctcctgagtcctttccaagcttgcgttgcagaagtcttcaagtctccctggtccacgttaggtcaagacggcttctagaatacttgcttctttgacagaacagaaggcaaactctatttcagattctgtttacggtaagtacaatgattgtgcaaagtccttttttattggctaagcttacaggtaggtatgaaaacggtcggaaatgatcggaaaacagcctcaaccatttccgtaacctttctcggaaacgaaatcgaaaacggtaaagtcagaaacgaaaacgatatcggaaatatcggaaaaccggaaacagaacaatacggacagaatgtcggtacagatcggaaaccggtattaaatacgaaaacattaaactataaaaacatatatttaactttacataagtatgttatatgtatacataaatttaagcttatacaatataaattataaattaactccattttagccatgcacaaaagttagatatttgattgaagagtcaatcaatctgtaagtagagacatgccctataaatatcgacatatttagaatacggtaattatcatattataagaaacggtaatttccacaagaatacggtaaatacggaaacgattggtataatagcaaaaccatttccgttttcatttccatattttttaccatttccatttttattttggtcgattaccatttccatatggctcaactggtagaaagtcgaaacgaacatcggtcggcggggaattactgttaccgttttcacccctacttacaagtttgcacaacttcaatccccgttaaatggctaaaaaatgggttaatttgatctgtgccattgcaaatatgtctgttcagataaataccattataattcatttatgcgtagccgtgccactcaaattttacgaaattagaaccatgctatcactgtcaggttttccatcttccgaatcggcacatgggactcacccatcagattcttcttcttccttacaccctccattatcttcttccttccccatctcttcgtcgtggcaaggagcgcgggcaggatgggagggggtcggcgacgtgtatggtgtggccctataggagagcaccgactaaggcgacgaggccgtgagcccctacgcttccatgacctagaatgatgggacacgcagcacggtcttcgcctccctcctagcggcggcgaacgagcggatggacacgccgagcgcggcatcagcggtagcgagcgggaggaaggcaaggcgccaacacggaat

SEQ ID NO: 74668 - DNA, 16194 bp, Oryza sativa
cttgttgtaggcaaatagatctaggatttactttgctatttatgctgactccgaaaattttcggatatatccgaaaatttcggaaatatctgaaaattattgcttccgcttttaattgaattttttgaattagcctattcaccccccctataggccttattgacactttcaattggtatcagagcctaatctcctaattcggcttaaccgcttggagagatcatgtcgggccaagtgggggatgggaataatggtgataagggagctaagattccttatgactatccccctacatctacatcttatgtgagtacatttagcggcaaagcttcatacttcaatggtacggactatgtcgcttggaagcataagatgaagatgcatttgaagtctattaatccatctatttggagaatagtcgaaaaaggctatgttttgcagaatcccgaagatcccaccaaggaggacgacgagaacgagcacaagaacgctcaagccgctaatgcaatacttagcgccttgagtgaaagtgagttcaactgtgtggatggcattgagagtgccaaagtgatttgggacacgcttcagaacttgcatgaaggcacgaatagtgttcgtgagtccaaggtggagatcctcaaggggcaatttgagaggtttgtgatgttggatggtgagagcccaagcgacatgtatgatcggttgagcaagatcgtcaatgagatcaagggacttggctccaaggacatgaccgatgaggttgtggtcaagaagatggttcgagcaatcactccaaggaactctaccttggtgaccatcattcgtgagcgtccggactacaagactctcacacctcatgatttgcttgggcatatccttgcccatgacatgctcgtgcaagagtccaaggatgtcatccaatacatcaaccaaagctcaaccacaagcatcaagaaggaagacttggcattgaaggcgaagaaagaagaagaagagaaccgcaagagcaagagcaaggcagagatcgatgatgaagagatggctctcttcgtcaagaagttcagcaagttcatgaggcgaagcggcttcttcaagggaggttcttccaaccactactccaacaagtcaagtggaagacactccacaagagtgtgctacgtgtgcaaagagcccgggcactttattacggattgcccccacctcaaggatggttcccacatcaaggaagataagaagaagggtgagaagaaggatgagaagaaggagaagcacaagcatagcaagcgggaacattatggccaagctcaccttgggatgatattcggctccgactccaagttaagctcaagtgatgaagaaggagctgccacgttcaccgtcaagccttcatcaccaccgagactcttcgaccactcaagtgatgaggatgctcccatttgcctcatggcaaaggaatctaaggtaccttctcctcacaagtcatttaatgttgatcttgttagtgatgaggaggatgaggttctggatgacgaattgtttaagtccataactaaggaatccctaccacacttgagtgagttacttggaagaattgaggaccaatatgcaactcttgagaggcaagaggctttgctcattcgtgagaaagagcggtcttatgaactcaagaatgagctttctaaggagagagaaaaatgaggcttaggtacggttttacaagcaaaccaaagagtctcatgctaatcttgaggtggcgaacgctcaacttcaagagagagtggatggcttggacaaagcatacctctctcttgaagagaagttcgaaaccttaaagaatagtgtctctctccctagcgagccatcttgttccaaaattgtcccaagtaatgaaccatgtgtgagatgcaaagatattgatattgaagcttgtgctactaactctatttctttgagtgctttgcaaaagcaaaatgagaagcttatgggactccttcacaatggcctacttaagtgccatataggtagtaaggccctaaaggagtacctaggctatcaaagggacaacttcaaccatcagggtcttgggtatgttcctccactaaaaggaaaggtggacaagagtgtgatgatcaataggccccaaggtcttagcaattttgttaaggccaaaagtatccttcctaatgattatacttcacattgttcttttgatgcatcttatgttcttaggaagaatgctagtggtcgtgttgttgctaagtatgtaggcccaaggggcaagaatatttctatcaagagagtactttgggtgcctaacgcacttgttactaacatgggaggacccaagcaagtatgggtacctaaaactagaaattgatctcttgtaggaatatgtctccggtggaagaagttgggtgattgatagtggatgcaccaatcacatgaccggagaagaatcaatgttttcaactcttgatctgtcacgccctaaaaatcctaagtatataaattgttgtttaattggaattattagaatttattttaaaagcctacaagttaaactctaataatctaggaaaattttcaacataaaaatggtctagataaaattttattaaatactttgcttgttcctctattttctagatttttctaggaattatttgagcaagggaagtatttttaataaatgaaacaacatttcacaaattattttttaattgaaaaagttgaaaaatcctcccctaagtcgttgggccgatttcggcccaactcttctcttccccgcgcggccgaaccggcccaagccggcccagccgacgccgcccgcccctcctcctcgggtcaccgacatgtggggccccggacccatcttcctcctccagccggccggttgccaggccgagccgtccgagccgccgtttgcgccgtcgattccccacatcctcctctatctttccccctaaaaatcggagcaaaccgttgagtattctctccgaatcgaactcgttttcgagtttatctccaaaaccgagtttcgtttttcccgagtcgatttcttgcgggaggagtccgatctcttcaatccaaggctataaataggaccccctagtcctcctctttcgtttgccctctctcccatcctctcccgtgctccgtagcgccgccgccgcgcgtgtcaagccgccccgccgccggtcgaagtccagccgcgccgccgcgccgtttgcgccgtcgccgccgcttgccgccgccgccattgggtgcgccgtggtgagaggaagctcggccacccttcctttttcgtcgccggtcaccggagctctgccgccccatacaagccaagccgccgccgttgcctcttcgtcgccggccgtcgttgttcgtcgtttggctcgagggtgagtaccgttgggttcgtctcgtcgtcctctacgtgtacttgtcctccaaattcgcagccgatcatccaatctccggcgagcttgccatccgagccggccgccattgatgacgtcatcgtgacatcaccatcttttcttttttcccgtttttctaatagattaaatcttcggaaaatcataactaaataaccgtaactccgattcgagtggttcaagttgctaaatttttctaaaatcaggatctacatgttaaaaatatccacatgtactgtttatgcttgtttttgtactgttttgttaatttttgtttaattgctttagtttccgacgttccggaggagagcgtttccgttgaggaagattccgaagcgtttgcggaagcccaaggcaagtcacacagatcccaaacaaacctttgagtatgttgaacccatttaaagctattattttatttcaactatgcattgttttcgaatgtcatcgggtggtgaacctttcccaattaattaatggccgaagatgatcttattttcctatgggttataaatttgattagcatgaaccttatatgttggattggttcagctaaatgctatatgtaagtctgcttagccatgcttagaaacattagctaactaaagggattaattataaactatgttacattattattttatttatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcatgattcattatagtgcgccagactgtgaagtggcgagaagtccacgggggtcgctggggagtccatgccttgtttataagggggtgattatgatccaggaaaggtgcgctgtaaaggattatgttgtgcaaggggtattgtcacaactcctttccgaggtatcgtggtggtactaaggcgcatggtaacatgttgtgggattgtgacttgtgggtacagtggtacacctctgatcagagtttaatctattcgaatagccgtacccgcggttatgggtgagttgagcaatgtttttcgtgattagtcccatattattcattaatggtaattgtgataattaatttgactcctggtttggaatggtacgttcctggtatggaggttagatttgtacaaccggggttggttgttcatatgaggttgggcctatgcaacatgggtgtgttgtatggtgttatttaatattgattaattattcaactgtttttaccattcccttaaatatttattaaatgttgtttctgcaaatgagctatattatgccatcctttgttatcctgtgcacttgcatatttgctgtgtgacttgttgagtatgtcatatgctcatttttgcaataatcattcatcagaagaggagtatctcagtgaaggtgatgatctggaggattaggcttgttcctggttaagatgcctgtggagtggagtcgccatagctgttccgtagtttgttatagtttttttttccgctgcgtagaaggtttttctttgagaggaactatctacctctgtagtaattatttatttgcgaatatcaaatagatatttatttgtactctattatcaatttgttattgtgtgcctcggttgattcctggacgagggtttaacacacatgtaagcgtttggaattttggatagaaattccgggcatgacatgatccaaatggcacttcacaagataacatggtcttcggggacgatggaaagggaaaggttatgggattgggtaagattgcaatctctaatgatctttccattgccaacgttctcttgttaaatctctaaactacaatctcttgtctatttctgaattatgttctatgggttacaattgtccttttaccgatgttgatgtgaccgtctatagaaggaatgattcatcggtagtctttaagggtgttctcaagggaaagctttaccttgtggatttttcctcaagtaaagccaaacatgagacatgcttagtggctaagtccaacacggggtggctttcgcatcggaggctagcccatgttggtatgaggaatcttcacaagattctaaagtacgatcacatccttggactaacaaatgtttaattcgagaaagatagggtgtgtagcgcgtgtcaagccggcaaacaaattggagcacatcaccccgtcaagaatgtgatgaccactacaagaccattggagcttctccacatggacctcttcaggccaattgcttatctaagcattggaggtaacaaatatggtcttgttattgttgatgacttttcacgcttcacatgggtgttctttttgcatgacaagagtgagacacaagccatcttcaagaagtttgcaagaatagtacaaaacgagttcgacctcaagatcaagatcattcgaagcgacaacggcaaggagttcaagaacacgtgcatcgagagtttccttgatgaagaaggcatcaagcacgagttctcggctccatatttacctcaacaaaatggagtaaccgagagaaagaataggactctcattgagatggcgaggaccatgttggatgagtacaagacatcggaccgtttttgggccgaagccgtcaacaccgcatgccacgccatcaaccgcctttatcttcactaccatcttaagaggactccctatgagcttcttaccggtaacaaaccaaatgtctcttactttcatgttttcggtagtaagtgttacattcttaataagaaggctagatcctctaacttcgctcctcaagtggatgagggattcttgtttgggtatgggtcaaatgaatgcgcataccgcgttttcaacaaaacctccggtattgttgagatcgcgcgtgatgtgacatttgacgaaactaatggctctcaagtagagcaaattgactcacatgtgttaggtgaagaggaggacccgagtgaagcaatcaaaaggttggctcttggggacgtacgtcctagggagccacaacaaggagcctcttcctcaacacaagtggagccacctacatcaacccaagccgacgatccctctacctaaagcttggatcaaggtgaagaaggcgagcaagtgctaccctcctcgcccaagaatccaccaaagtatccaaagagatcatcccaccgacaacatcttaggagacatcaacaagggagtgtccactcgttctcatattgcaaatttttgtgagcattactcgtttgtgtcttctcttgaacctctaagggtggaagaagctcttaatgatctagattaggtgatgccgatgcaagaggagttcaacaatttcacccggaatgaagtgtggactttggtgtagcgacctcggcaaaatatgattggcacaaagtggatcttccgcaacaagcaagatgaggccaggctcgtaataaggaacaaggcgaggttagtggcgcaagggttcacccaaatcgaaggattagattttggtgaaactattgcgccggtagctagacttgagtcgattcgcatattgcttgcttttgctactaacctcaattttaagctatatcaaatggatgtcaaaagcgccttcctcaacgagcctatccatgagttggtatacatggagcaaccactgggcttagaggatccgaagtatcccaaccacgtgtacaagctccacaaggcactctacgggcttaagcaaacccctagagcttggtatgtcttcgcaattttcttgtgaaaaacggctttgaaatcgggaaagccgattcaactctttttactaaaagacatgataatgatatttttgtttgccaaatatatgtcgatgacattatatttggttctactaacaagtcttttagtgaagagtttagtaggatgatgaccaaacgttttgagatgtccatgatgggtgaattgaagctcttcctcggccttcaaattaagcaactcaaggaaggaactttcatttgccaaacaaagtatttgaaggacatgctcaagaagtttgggatggagaatgccaagccaatccagactcccatgccatcaaatggccacctcgacctcaatgagcaaggtaaagatgtcgatcaaaaggtatatcgttccatcgttggctcacttctttacctttgtgcatctaggcccaatattatgcttagtgtgtgcatgtgtgcaagatttcaagccgctccgaaggactatcaccttgtggccatgaagagaattcttagatatttagtgcacactcctaaccttggtctttggtatcctaagggagcgaggtttgatctcattggctatgccgatgcggattatgccggatgcaaagtggataggaaaagcacatcgggtacttgccaattcttgggtaggtcccttgtttcttgttcttccaagaagcaaaactctgtcgccctatccaccgccgaagcggaatatgtttcggcggggagttgttgtgctcaacttctttggatgaagcaaaccctgagagactatgacctcaatgtatctacaatcccactcctatgtgacaatgagtgcgccactaagatagccaacaaccccgtccaacactcccgaaccaaacatatcgatattcgccaccatttcttgagagatcattccacaagagacgacatagacatccaatatgtaagaaccgacaaacaattggcggatatctttaccaagcctctagatgaagctaggttttatgagttgaggagtgaactaaatattttggattctcggaatgtggcttgatctattgcatgcatgtttgcttggtagaataggtttgcataccactttgtgacaaaatggtcattcaactcatggatggacactagtcacttttgtggagaacttgaatctatgtgtatggggatcttatttttcaatgaattttggtcctagcacaacttgaaatagattcacacattccctctctcgagggtgaattatcttgtatcatggtaattccctctcttttgatccctcggatcgtccatttgacttgtggctattgttttgtgtgattgattgtgtgctagtcacaagttcaaatggagcctctagtgctcgaccatccctcctttcctaaatactatcaaaaacctttgagaaatgtgtttttgtcaaaaatttcccggtgcttgtcccttgcaaaatccatttcaaatgtttgcaaaatagtttcatcaaaattcctagcgaaatccccttgcaaaactgtgttttccaggaattttcggactttccggaaaatttttggacttcccgaaaaattttcggatatatccgaaaaacattagaaccgtgcgcaacccttctggatccgttcggacttatccgaaaattttcggaaatgcccgaaaatttcggggtctttatatatcaccccgtggactcccttctctctcctttccactttttttccccacgggattgactccctcctctctccccaccggcgaccacctcctctccggcgacttcctgcggctcccctcctctctatcctcgtgggagcgcgcttgggggacttcttggggcttgcattgtcgatcttcaccgcgttcttcaagtgttcttcgcgttcttgaggtattcgccctaaaatcaaatcctttgattcctcaagttttatcttgcgattccctttggtggagatgttcccctagtgccctagaacctgcggattcaatctcacaagtttttgttggcggatttgtgcggcatctgagttatagggttcggcaggattcttttcggacttttccgaaaattttcggatatgtccgaaaatccctggccgacccctatcacttcagttttgcacgattcttaccttcacttacttgtttcttgcctttttggcttccattcactggtcccttgtatctcgcttgtttgaaggatgcctcccagcaagcaaacctcccacaagtccaagcgcccgagggatcgctctcccactccatcctctcatgatgattcggacagtgattggtctggtggagaggatgcggttcctcaggttgccctggtggctcggggtggcaacctccctcctcggcgatctactcaagctcttggtgctggtggtggtggtgaggactcctctcgtcaactgcaaacgccgccgcatcaacccaatgtccccattggtcctctccgcattcatacccccgagagggatccagcggtgattcgccaagtgtatgattggaggcggaagactgaggttgttgctccctggtgggatgaggatccgcgccctcttcaccactccgccacgaatccgcggttttggactctctttcaacaagacttttatgagtcagtgatcaagtccaaagctcatcccaccgttcccatgcaatggatcaactgggaggagttgcaggcgcataatgatccggtgctaaactctgtgattgcaaattgtgagcgcatggggattcgctctttcatgactttgcagcaggattggtgcaacgaagtcatcgctcaattctatgccaccgttttctttgatccacaccgtgccatgcattggatgacccaaggatcttggtattctgtctcctatcctcctttggctgagatttggggtttcgacttgcatgacttactcaaccttcctgatctgcataatctacccattcctaccaacactgatctcctccctctttacattccaaatgatcctaatgtggtgttgggtaaggtcgacggtctcaaaccgtactttgcctacttgaaccggatgtttcgccggtcctttgtgccaaaggatggtgatgctagcagcattaaccgcctctccaggactgtgcttctcaggttcgatccccctcctcatcgctttcatccttatcactttgtgtgggaagaaaaccgcatggcttccattcagtacaggaaggggttggtctatgctcctcacattatgcggatgatcgagtctgtcactcagcttcagtttcgccatgatgtgtctcattcctagcttcacttgtgccttgttaaggcgccccgctcctcagccgctcgggacatcccctcctcttccactcagccgcctcctgctcctgagcgcccttcctctgtggctcgtcgtgagccgtctcctttattccgcattttgcagagtctttttggtctttgctccgcggaggccaaaaagaactgccgattgcggaattcaacgaagaaaacggctcgcgacgtcaaattcctcaaggcaaggtattatgaggatcatcacatcgatatccctccttctcctccgggtttcgaggccgagcccgatgagctagaggaggaagagattgaggatccatttgctgggtcgcctcctgacttcgacttctttgtttatgcccatggctatggctatcctcctccaccacctccagaggatcctcctcaggccccccttcgcttgagtcgtcgtctcatcgtcctctctttttggtgtcttgatgccaaagggagagattatctatcatgtctttagggtcgagcacatttggcttttatttgtatgagactatgtgtgatttctaagttaagtttaatgctttgtaagactttattgtttaattatggatgcttgagatgtaatggatcttattatgtttaatgtggtgcaatgccttatcctctttatatggtgtgtgtgatgagatgtaattattcttatgcatgtgatgtgttggatgtgatgagcaaatgtgatatatttgttgtcttgtgagcttcaatgtggatgcaaagatttagggggagctctctacttgcttttatgcacactcttaggaggagctttcactaaacctttgcaccaaaaccttaaattatactcattctctcttgtgttctaatcgtattgtcatcaatcaccaaaaagggggagattgaaagtgcatctaggcccctaatgattttggtgattaattacaatgcgattagagaggactaacatttttatttaagcaaatgtgaagcttgttatgtccttaatgagttagcgtaatgcatatcccgccaaatacgttgaagtgatgtgttgcggcaaatgagcaaatggtattttgtacccttttctttttgcttgagtcaataggaaagccgcactattaagagggatgatgcattgacaaatgagcagtgatcaaagtgctcaaaatcaatttttaaaagtgtttctcctcagttatagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaacatccagaacgatgtttttggctctgagtattttcggacttgtccgaaagtgattttcggacttttccgaaagtgattctagaacgatgtttttggttctggatatttttggacttatccgaaaaaatttcggaatgtccgaaaattctctcgttgactttgctgttggtgctgaactggaatttttggacatgtccgaaaatctttcaaaatatccgaaaatcacaattattgtgtataacaggcagaatttaggctgtggctataaatagccccctcccctcacttgtgagggctgctggtcacattggatatttttgtgcccttggcttgctcttgttgagattcacttttgagccttgctttcttgtttcccctctcacccatgttcgattcggatttggtgtgtgtgtgagagttgtggattcgagtttgtgtgagtgcttgttgttgacttcgtgaagatttgtgagcacttgcatcatctccgggagttcaatgcttcatttgttactcttggaggttgaggactcctaggcggctaggtgtcgctcccgacccaccgatctacatgtggttggccgggagaagtttgtgaaggtcggatctcacctccgaaagggaagagatacccttagtggaaggaggagtgcttagtgcaacctcttgaggaaagggttagctaagacccggctcttagtgagctcctcaacggagagtagaatccctcaaggattcgaactttgggaacaaattcgtgagcttcatctttggtgactttacttcctccctctccactagctttgcttatttgagccgctataggtctagttgatgtttgtgctagcatattcttgttgtaggcaactagatctaggatttactttgctatttgtactgactccgaaaattttcggatatatccaaaaatttcggaaatttccgaaaattactgcttccgcttttaattgaattttttgaattagcctattcaccgcccccccccccctctaggcctaattgacactttcagctctgatgtaatcaataatctttactcagggacaagtaaatgctcaatgtgatggtgttgttgacggtcctaaagtaccaattccgaccgtcaattcatgcacaaatgcaaatgaaagagaatactaaacttagaggtagtgcttattactaaccatttccacaagtcttggtgaatatttgtacgtgggtgcattatggacgaaaatcacccgccatacgacaaaatacatatctagacaatcagacgtgagtacacggattggaggccctacatgtcaatcataatcgcctacaattgagcccatctgaggtacaacttgtaggggggccactaggcagcctcccagccaaaggattggctgggaggtgggccaatggggttggccgaacccaaggtcttttgaaccacctttgcctctccttgccatctgccgacgcgtggagcaagatcttgaagccccaaaggtggttatgcttgattaccggcagttaccgaccttccaaccgacttaaggaggctataaaagaaggagctcactacactctaaaattacacagcaagtggagtacaactcacttacacatttaggctgagttcgggagtgagcgttgggaaccctcactcccaacatgcaaaacagagcggtgattagtgcataatttattaagtattatgtaaaataaacttgaaaaatggattaatatgatttttaaaacaactttcctatatattttttttttcaaaatgcacaccgtttagtagtttgggaaacgtgcacgccgaaaacgagaaaggtgagttgggaaaagtaggggaagaacacagtcaaagggtgtgttcgggaggaggggttgggaatccctcctccccagcacggaaaatgaagcacgtattattgcatgattaattaagtattagctattttttaaaaaaaaagattaacatgattttttaaaacaacttttatatagaaaaattttgcaaaaacaacaccgtttagcagtttgaaaagcgtgcatacgtgccccaaatgtcggacttctctccgaaggagtgctagagatgtcgacattcttccaaggagttctagaggagtgccgaagatgtcagctctctgtctctctatctctttgatcttgtacctcgttggatgcttcttttacataagtatttgtgatctcatttggtattaacttttcttatttaagtaagatatattctcatcattccaggttcatcgctgtacttagagtaccttaatcttatataagtgtgacatcgagattggggtaataatcaatagcgtagacatggtgttaaggctagagtttacgtttgtttgttgtgtgctccacgggttgtagaagtagatggcaggtggtaacagccatatccgtcctttgtaattctccatgttcggtacgtcatcgagctgtaggccggagtctccttggaagatcacgagtaagctggtgttcgaaacaattgatagagttttaacttaacttaattaacccataggaatccgctctttcctaagcatcccaattagttgttgtccttggttgaatcttgttcttagattacacgcacatgttccctgtgatttgatacccttggaatactctaaagtgaagtgctacttcggtatccatgttcttgcggatttatttatgactgtagcaaataccaacagcgggccactattatgttgtcgctagtcatgcattgtgcacacattattaatagatgaggggtctcgacaagccattgcgtgcaataggtgatgacatgccctcccaagcaattagagcaagtttaacagtagagccaaatattagctataagatcatattagagttagtatgtatagtagatgggctctaactttgtatttatttttcttctcctctctctttctcatgcatatacatttagtgcatttattttaatgtgtgtgaagagttagctcttggataccatcagctcgccattgttgaagcccttaccactgcctaggattggggacttggggtgtgaggcccagagagaggttaggagatgggaatcggttgaatggttgaaacagaccagaccgggtggtcttcacgggtggcagggaaatcttgtcttttcaaaacatttctcttcttgtataggctaaaaataataaaataattgacagagcatccttcagcagattaccatattttttttaggatgtactcagaccgttctatatttttgttatgtctacatgcaaaaaccacaaattttcaatgtgcggtaccaaattttgccaaacaaccaccctggaatgataattaacaagtatgaagtttgttacaatcgtctcaaacttatttgttataaagttattgtcaaagtatgaccattaataccatggaaaatgattaaaaaggacaattatcgttatattggagggaatataaatttgtttgtgcagttcattgatacaaatatgaaaaacaaaaattaaaatgcccagtggatagacctcatgaatgattttgctatatggtttatatatggaaagtggcgaataaatatcatggctagtgtagtgggcaccttatccaaacaatgcataaaaagatagcttgaacttgcagctaaattgttcctttattccacttctttttttttattctcccaacagtggactacgcatatctgggccacgttgattttttttttccgaaaatggccacgttgattcggtggtccaatttaatgcacttgcgagcaactaattccgttccataaaaataaaccgatataaaaataaatctattatgggatatgactgtcatttaaattaagttgtgctaatatgatcctaatgtttccgctgtcattttaatttatttcatgcttacaagtcaatcaaactacagtatatatgttcaagtcaaacaacaaaagaaagctagatcaatctgtgcactcatgcacagcacagcagtagcaaagcttcaaactgactgtaatatgtaatcacatgataaaagtccattgaacatcctacaaacacttctaggctgtcacatggtattcctataaatactcctaagtcgtcatatggcactataataaaccaatggaaccattacattcaactactaaatttatctctttaggaaaaaaacttaatgaattgattt

SEQ ID NO: 74669 - DNA, 26601 bp, Oryza sativa
  unsure (1)..(26601): unsure at all n locations
cgtcctattctacaaaccaaacacccgaatggaatcatcccaatcctcaaatcagggatggtttcatcccatcccacctagtcccagaaccaaacacacgctaattgagttttgggattcacttttcacctgtaaagaccaaagtttttcatacttgttgtctatgtctgttccacatgtaaggggttgcgctagaaaagcctagaataatctgtcttgctgctttttaccgatcagatccaacgattttccttcgtcctatttctctatgggatggttcagtgttttttattacttggatcaattaggtgttgtcttgggttttattgtccctgactctgaaatgctagagcaaactggatcctaatacaatattcatggtataataactgcaagcttagtgtaacttacaatagaaccagcaccgattccctcataatttccagtaggtccgtttaccattaatgcccatgatgcactaagatcattttgtcctcgcacttttggctcatagacattgattgcaacttgtgttccatatatttcatcatatgttgtacacccagctctctacatagaagatagagtcatgtttattattagtaataaaaacaaaaattttggatagaagaaaaacttcacacacaacacaagtaacactaaggtgagatttcttgattcctaattgttttagggataaatttattacttgctactaaaattgtactcattcacttagtttgccacttatactgtcctaatgacagtacgtgggggtttcaagacacgcatgtcagtaagaaagtctgtgtgtagaaatttgagaggaaactaagaaattgccataaaagacattctttttttagcgtatctggaacgttgatctggaaattctttcaaaatcgttcttacttgtggagctctagttgatagagttagaacaagggaagaaaaagatgcagaaggagggcaaggtttgtgcaaatattaggaaaaaaatatatgctggaaactacatatgtagtggtaaacctggaaactaccattagattgaaaaatggacgtctgagattcgtccacgtcaccacggatacaaattttactagtaggtttatatttttactcatggtgacgtgtacgaaatctcagacgtacatttttcgatccgatggtaattctaggtttctactacatattttccaaatattagtgttaacatttatctgcattattacggtgaacttttatcattgttttattcaatacaaatagtcgtagaaaaatgccaaatttcaatatcatattatttaaatattttatgggcatatattttctaggttagtgcaaatcaaaagaacatttgtaacgttacaataaaagaactacttgactctggaaagtattcttttgattagtttgaggagtaaattagaacatacctcccctccacgatgatgggtattaccgattggatcaaaactaaattgtgtcttcagatcagctttactattttgtaacaatggtattgttccctttgggcatgcaatggtaggcagatgagcttctgtcgctatagtgtctgatgatgatttgattttcagctctgatggataagaggtgggctccatctggttgaaaagtttacaaataaaaaaatgttgggcaaatgaaacaagtcataaaacactatcacattactatttactccctccgtccccctaatataagagattttgatattttccttgcactgtttgaccactcgtcttattcaaaaaatttgtgtaaatataaaaaatgaacagttgtgcttaaattactttagataataaaataagtcacgaataaaataaataacaattctaaaattttttgaataagatgaatggtcaaacagtgcaagtaaaatgtcaaaatcccttatattataggacagagggagcaatatttactaaactacaaacatatgcagtcatatcccctttccttccattgataataaagaacaacctagatgctcaattaattttgccaaatcaagcagttgatttgcgccaaagaaagaaaacaagtccaaccacaccttttttgtgtaattgactaattgagaaacatgagttggattaaggacttatttgtactatttgattatggggttaggatgagaagaataaagcttgataatatgaaaacggagaaagagagtgtgaaatagcaacatacctgtattatgtgccctttcaacaatggatgagatagtgctggttgtagattgatatcgatgcaatgaaacacgtcgccgtctccagtctattaattgtgaaatttatattgcttgtcaactagacaaaggaattatatatgtaaatctagaagaatcgaaattatatggagatatgaaatgaaaaaggtgtgtagatagtacctcaatgatcttgttgataatcttgtcggaaataggttgatcataacttgcttcatgctttacatatctaccttcttgtattcctgccgcaaggaggacaagatatgatatgaaaattatcactggaagttctagtggtttggtcattgagaaaactgaattgttcactattctaggatacagacctaccgttttataggacatggagggtggctaccgctcttacagtaacccccgttttaatgaatttggtggaaatgaactgtcatgtctttgactcaaaagatatagtgaagatggaaaaaacaaaagacatgatgtatataatctgcgaatgatgtacgagtattagtagagaaatcaaatatgaccgctcaagaagaatgaatttaatgcctccagagaatctcatttattgcagttgccaactaagaaagatatagagcaataaacttaataaatgcatgaaactagtctatatttattagaaaatatataatctacagaattattggcacaaaaaatattgcaacgatatataaattgttgcaattagttagtcagtgattgagtccacgactcctcctcgttgtaaccgtccatgcttccccattcttctctctcgctctgtccctctctctcgccacgcgcaaccgttgtcggtcgtcgagacgccgccactgtgtgcctcttggctcccagggcgccgccttcctgttcttctcctcttcaactcctcatgtactattcctcctctcccaccctcatctctcccaatgtggcggtgttccttcggctagatctaaccatccctgatctcgggtatcagatccggggcgaggccaccatgtagatggggagagaggcatgaatatggcttcagctcgggagcttcttgcagccaccatctccatcgtcatgtcccttaccggtccgatagaggaggtgaagaagcagatgctggtgctgacaaaggtgaagctgatgtgcttgactagttgggaaagaatattgcaaaccatattcttttgatgttgcacataatgtttacttggtgtttcaatcagtctctttttggatgttgtacaaattggtacaataatttcttgatgttgcaatattctggttttgtgtgttgcaataagtatcgttgaatgttgcatgtgattgaaacatctttcgatagagcaatgaaacactcttgatcaagtcatggcacgctgaaacaattctcgttgaaacattttttcatcgaattatgaaatatatgaaacattttttttggatgtgatggaaccctatccgatgtttcttcttccatcggacgtccgatttgtagcgctctcccaataaaatatgcattgttatcatattttagaattttacttgcaaaagctaaaagttaccatgatgaaaaatattacacggtttcaattttcattgtaataaatatgctctcatacctcactatattgatgtggtaaaattatttgaattttctttgaattataaataagctattgcgacaattagataactattgaaatatgcttggagtagcctaaataaaactctgttgcctggattcttacgttacagaactaatctcagcaaagtacagccacaaaccagcccatctctagttctccaccttcctagcaaatccagccagccagcccactatacccaagtccttctagatggaaataagttcaccggaggtccctcaacttaacaacgagattttttaaggtcccttaactacaaaatcagaaatgtgtacccctaatctcacacaaaccatgcacttaaggtcctatggcagtatatatgggtgggtttgctgacgtggcatcctagtcagcaaaaaaatatttaaaaaagtacgtggggcctgtatgtcagctgcacattttttttttcttctccttgtcttctcttctctctcttctctcttctcttcctcttcagtgagggaggccggcggagtggcgatgggcaggcagcaggcccgtgcagcagcggagtggcgatgggcggtggcaggcagagcggcgccgggctgtgggcggagcggaggcgggcgaagctcatcttggggcagctcgcgggatcatggggcggggcgcatccaaagcgcacattcagatcactatttgtggaatgatattttgcacaaatctggtttgcgatggaatgaactgagaaacgagcatcatctcccctgtgtcgtcctctgtgccaccgtgagagcacacgacacacctacaagagttcagacattcatggaagcagctgcaagggacccatcatatctgctggaagaagacaactaacatatttcggctgggcagaataacattcgtatcaaatccaattcttgggtgcaaactctaacatattttggcttggtttgatcgcaagtataggttttggacaactgacagatttttttttatcatagaccagagactgacagatgtgctctctatgagggagaacaatacaggaggctgccctccacctgctgctggcccaaatatccaacagcgagagaacaaaatctacattaattttattacggcaaggagaaattcactttgagtacatcgatttggtggactcatgtagagttaaaagtactctactaatttggttgggagtaacgttaatctggttaatttcgattaagagcaaccaaaatactgtattttctatctataaaaaaactccaaaaatacaattttttttatttgagaaatgcattacaaacgtagatactcacaatacacatacacccatataaacgcacacatacacccaacctttattagcgcctcgaaaagaccgaacttgcatattttgagagtgacaaagtcatcactggtacctcgttatcgataagtacgttgtctagaattgaaaaaaataattagctgtaaatatgagtactaaaaaatatattgtactcctctatgttctatctattatatgcaatacaaatattttcagttctgttatcctaaattcgattgccccaatgtgcaaaactctccataggatacacacatcactctaatcctccattacctatgacaaacacattcattccgtgtgaaccacgtttgatttagccaatcacattcaccaaggcaaatttggagcactcaaattccaattttgtattcatattcccattcaacaaacccccacagcataatttaaaatgtaggcgtctgtgtgctgcaggaaacgtacgtccaatccacaataatttatacacgcgtatatacttcacggctacgcagactgccgtttacacagaaacacaacatcgtacacgcaccgtatgtgcttacataagttcgtaccactgactatatataccaatgcatcctaattccaattcaccaaaccaaagtagagttcacagaagcagcagcagagcagcaaccaacagcagcaggatcaaggtcacacaaagcctgatcgatcatggccatggccaaggctctgctcttcgccatcctcggatgcctctgcctctgcagcgctgttctagcagctcgtgagctgagcgatgacgcggccatggcggcgaggcacgagaggtggatggcgcagtacgggcgcatgtacaaggacgatgccgagaaggcacgccggttcgaggtgttcaaggccaatgtcgccttcatcgagtcgttcaatgctggtaatcacaagttctggctcggcgtcaaccagttcgccgacctcaccaatgacgagttcaggtcgacgaagaccaacaagggattcattcctagcacgactagggttcctactggattcaggaatgagaatgttaacattgatgcgctgccggcgaccatggactggagaaccaagggcgtggtcactcccatcaaggatcaaggccaatgtggtaagaaaattcaggctactcagatgacattcttcagtatcttttatgatagagttttgtgataacatctattgtgtccaatgcattgaacatgaatgattattgcaggttgttgttgggcgttttcggccgtggcagccatggaaggtattgtcaagctaagcacgggcaaacttatctctcactctctgaacaagagcttgttgactgtgatgtccatggtgaggaccagggctgcgagggtgggctcatggatgatgccttcaaattcatcatcaagaatggtggcctcaccaccgagtccaactacccatacgcagcagtagacgacaagttcaagagtgtatccaacagcgtcgcatcgatcaagggctatgaggatgtgccagccaacaatgaggctgcccttatgaaggcggtggctaaccaacctgtgtctgtggccgtcgatggaggcgacatgacattccagttctacaaaggtggtgtgatgaccggctcatgtggcactgacttggaccatggtattgtggccattggctatggcaaggctagtgatggtaccaagtattggttgctgaagaactcctggggcatgacttggggtgagaatggtttcttgaggatggaaaaggacatttctgacaaaaggggcatgtgtggcctcgccatggagccttcctaccctactgcatagggaaagctcaagtgtgatgtggatgatgtatagggattgatgaataatgtgttgctgtggttcatactttgtttgttcaaaatatataatttataatgcacttatctacgagatgcatggataacatgggttggatctgataaaataggtcaagtatatattgtccatgagcaaatgagcctttgctacaattaattaagatggctggtaaggttataagtagaacaaataacatgtactgtcataatttataattcaaattgttgaaatcactagcaatcacatacactactactttctctgtttcatattataaatctagacatatatatatatacatatttattaacatctatatgaatgtgggcaatattagaatgtcttataatatgaaacggagggagtatagaaaaggaaatttgtgctggttgggagatgaccataggtgccagattttccaacgccacccagcaaagcaacacctttgaggtcccaggaatgaaaaaaaactggcttgatgccttgaccaactctccgtcatcactgagatcaccatcattcacatcaaacacaatcacaatcatcactgagatcaccatcatcacaaacagacaaagaatgtcaccatcacatcgacgaccgggccaaccccgtggtcgtggcggtggatcagtccctgtgttgacagtggcgttggttggatggagaagaagaggaggaaggaggggtggtggtggtggctaaggaggaggaggaggaagaggaaggaggggtggcggtggggatgaggaggaggaggaagaagggcagtagcggggagaaggaggaggcggcagaggataacgccagtcggctcggttggccggttttttttaattataggcggtcttttaaagaacatgcacatataatatcagtataggtatcgatttttttctagaatcggcacctgtatgttcttaaagatgccagtttttaattttttttatcccatgaaagtggaaattggtcaatagatgccggttttaaatgaattggcacctatgactatgagccgtttcctattaaggtttccattgtagtgttataatttataattataataatttatatttttatgcttcttggtgtattttgttagataatgtcttggtgtacttatgtaccattaaaattactactgatgcttggtattacaaagctaacattttggaaacatgtcaccatatttttataatattaattatcgttctatgtaaataacttaaaaggtggaaaattcttcgtaaaatgtcttatccctattatgatatataccagttataaaaaaaagaattcattttagacctgctatgtaaagttaatttatgtctgctgaatcctgagtaatctagcagtttgttctccctatatacttttcaagtgaaaaaaaaattgtaatttccataacatctggactggctattctcattaattaagaatgcattcaaagaattctattcatttcaaatattttgcagcgaattcagtaatatttttactagagctccctcctgaactcctgcattgctttcttagctttattcaacaagctcgcagcatttcgcctgtatttctctttccgatctccatccatcatcacctcgctgatgcacctcttccctccataagtaccattcttgtcccattgcacctccgcgcacctatgccccacaaggtctccatatagtatgcaatggttggttgatcagcccattgtgcattgccaaaggggcacaccgttggcaatcgcctccaatccgtgatgagcccacttatttgagtaaaaattaaaaagagaaatattgattattcaccacttgaataatatttatctcttctctccctcccttctctctcgctctcttctctctctccccctcccatctctcccgcagccggcggaggcgatagtggcaaccacgccctccgctctgccagatccggtaggaggggaggcggcggcngcaggaggggaggcgtcagcgacaggcaggggtggtcggatcctgcgttggcggcgggtggggtggctcaagaaagggagccggcggagggctcgcccgtggggaggagccctcccctccgctagatctagcgggaggagagacggcagtaggggtggtaggctcgcggggggttggtggtggcaggcggcgggctctctgaagggagacggcgcgatgggaggtggcgcgacggatgaccgtgcaacggcgacgactgaagaggtgtgatattttttattccataaatttgattagagtgccaaaatttgtgtcgtgggatgaatgctgccaaaatttgatatgtggatgattccatctttgcatgttgtgggatgaatgttgccaaaaaaaattttcttgttctttctattcttccaggtgtgggaggagggactgcttggctcaatgcattggctcgattgagctaacgcatcgagccggcttttttttattcgtcgaacctaaaaggtcccggttctagaaggtcccggttctaatgaaccggcacctttttgatttcaaatcagtgccgcctcccttgtgccggttgggaaaaccggcaccggagggggtttcccaaccggcactaattaccttttctgtagtagtgatactagctttggaaacaaaagtacataaatactaatgttataattcaacattcaacaaatcatacgctttcaaaaatccacattgccacaatttgttatagcaatcaagctaagaaaagcagcagacgaaaaactgtgcaaagggaaaacacaacaataagaaaaaaaaaagagaatatgagataatctaacttgtgaggtagcaaggtctcgtgcctcaagctcgcagcgaaaaggagaggggagggtcggaacaactgaatctagatccaccacctagggatcgaactaccgtaagaacagggcaaggccgtcgtcacaatctccgtgctgacttcccgggccttcgtgatctcacgacacagtcatcgaccatggagccaccagatctgccaccactccctctccttagatccccaaccagcggatccaagtctccgccatcactcctacttaataagctaccattgtcgtcaccgccattcctaccaatcaagcactatcactacattctctgcccctaacttctcgtcccccacgtagtggaggaagcgctgcaaggaccggatctagaggaaccctgagcagccccgagatttgggttttagatctggtccttgcatcgcccctcgctgcgtcgaggaggagggaggagcaagagagaggaggcatgcagcgatgtttgggacagcaaaaggagatccccatggtagggttggggatgcaagtgggagagacatatcggtaggcaaacagttctcctcccccgcgtagtggaggaagcgctacaaggactagatctggtggtaacccttagcagccctgaggtttgtgtaacatcttgaaaattcctgacaataaaaatcactaaaattttgaactttttaaaactttttgcatcatgctagatgttatggttgttattgcttgccaaaccataaattgacacaatggaaaaatcaatctaaagatttacacccgagcaataattacgatttacaacgatacggtatttattatcaatcccataaatatttatgcacatgaaagccaagccaaataaagtacaagttaattattaaaccgtgtagtataaatcacaaatcaaatattaaataatcaaaccatgttgatagcctgatttcatatttaacaaaaggaaacaacatggttgaatatgattcacttgaatccaatctcacatgagatataagaacacatgaaatgatgatcaccactataatgagatataagccaatgccccgttcagggaatccaaaacctctgtatcagcaatttcatagacaaggaactacaccacatggatggaaaggaaaacagaaaaggaagatgtcaccactaataacctatgctgaactggatctcagtaaaatgggaatagaaatcggtgatttgcctgaagaagttgacgagctacaactatggcaacgaaagagagatggctgttgtttttcttgtggacaagtcggacattatgcaataggctgtatttaagacactagtgaagaacaagaaacactgccttcacagatcagcccagaagaggacagagttccagaaccatccaaagaactatcgaaggttaaggcatgtactctttgcggagagataggacactatggtagtaattgcgttactcaatgcccctattgcgaccaagaccatccagttgaagaatgcccaactacgaagatcacctgcttcctctgcgaaaggatggatcatgtgcccaaagactgtcagctgagcccgttgcttaccaagacggcagaagtacaaagagtgacgcttcgcttcgctcatcaactcatgaagtcgggaagccacgaagaccctggatttcctacattcgattagcatgtttgtctatcgatcaatatttaatgttgaactagtttaatgtcatcgtagttccaccgaatctcgaggacaaaatttctttaagggggtaggtttgtaacatcctaaaaattcctgacgataataatcactaaaattttgaactttttaaaactttttgcatcatgctggatgttatggttgttattgcttgccaaaccataaatcgacacaatggaaaaatcaatctaaagatttacacccgagcaataattacgatttacaacgatacggtatttattatcaatcccataaatatttatgcacatgaaagccaagccaaataaagtacaagttaattattaaaccgtgtagtataaatcacaaatcaaatattaaataatcaaaccatgttgatagcctgatttcatatttaacaaaaggaaacaacatggttgaatataattcacttgaatccaatctcacatgagatataagaacacatgaaatgatgatcaccactataatgatcgtgtttataaataagtaattcaccggaatatatatagattgatacttacaacatttcgccgagttcctcatgacatgaaaatcactcatataaaataatggtcacataaataaattaatctttatatataaacaagaatatgtgagtgtttaaaactagattaatgttgtaccgagtcttaatatactatttatagaataaatagattcaacctatccgtgtaaaatatattgctatgcaaataagttcactcaatgtgctattgtaataataagggccacattaggatattctaattaattttagaaccctcaaagcctccaaaattatttaggttaattttagaattagacctcatttaaataatacaatagaaaaatatatatgagaataaaatatgggtaatattaaaatttggtaaactttcatctaaattaaaacatataatgggtaaactccatttgtgtgaaaattagggtttatggaacaagaattgaaaaggaaatcaatcaaatagacaacataggaaaagtcactgttcattatggcctaggtgtttgatgtggtcccctagcccttcccccctcctctgccgcgctccccctcgcgccccgcgcccctgcacacgccgcgccgctgccgccctctgctgcgcgccgcctcgcgccctgcgccgccatcaccatcgccgtcgcctcgctccgccgcgcgctgtcgcgccgcctcgcgccccgcacgccgtcgccgtcgccgtcgcgtcgccatcatcaccacgccgcacgccgtcgccatcgccgtcgcatcgtcatcaccgccgcgccgcttgcctgtcaccgtcggctgcgccgcgccgagccccacgccactctcgtcgccgccgtcgcgtcgcccgtcgcgtcgccatcaccatgcgccgcgagccgtcgccgtcggcctcgcgccccgagccgccgcgcgcccatcgctgccgccgcaggccgcgcgcctgtcgtcgtcccgcccgtcgcgtcgccgctccgagccccgcgccgtcgcgtcgccgcttgtcaccgtcgcctcgctcaccgcgcgccgcgccgtcccatcgccctcaggccgaccgccctccccgcgccctataaacccccccccctgtcgccattaccctcatcaccttctctccctttcccctctctttcccatctccggcgtcgccgcctatttggaagccgccgccgccgccgcggagccgacgcgccccgccgccgcgctgcgcctcgtcgccgcgccgtgctccggcgtcgaccccgccgccgtcgtcgccggaccggtaagcccttccgccttccttcgttgccggtagccgcgccgcgccgctcggctgtgagagagagaagaaagaacgagagaagagattagtgcacagtaattacttagttcaccccggataaatgagcctatgacgcgtgggtccggatgattagaaatctaattaaaatcaacattaagtttacactctatgacgtatggggcccactggtaattaaacaagcaggtttgaccctaagtcaaccagggccggtcccacatgtcaaccacagtgggttttggataatgtttccgattaaaaataaatcatttatgaacagtacatttttacaatttctcggattaactcaaatttgaatctttaaactagcataactctctcattttaactcggatttgagtgaaacttgaacctaaatttatctaaatttataagctttccaatggtatataattcactatttgataaaatatatttataattattaaataattaatactaagataatgcataatagtcaacttaaaaatgtgctaacaaataaaattagtactttacagtaaggtagatgtaagaatatttgtctctaacatgctttgtcaatgtaacagccacacaaactaattttaaaatatgtctcaaattaatgtataggaagatactagtactattaaatggttgtataattaaacccatgacttatagattatttaaataataaagttagccttataattaggcaaataaaatatggatacacatagatcgttcctaggctttcttgtgagataataacatagccatcctaatcacatatatcgaatagcttacggtaaatagcaactattcagtaaatgatccaatgttaaaatattgttgcacacacgtatattgtacatcccaatttagatgtacagtatatcaataacctacccttttgaatataataaactaaggagtctatgacaaacatctatagtggataaatactaaatataaatcatgacctaatataatctaagttcaattgtaagttaggattattcgttgtaaaattatgtggtgggataatctgtaaccataatacgattagcctaaacaactctaacatacaaagcatggataattattaaccttttataacttattgtgacaagtaaaatatgttcataattaaagtaaagcctccatcaattaaataataataaaaatgattcaatatttgattgatcctaaatccatctaacaacagaacctctagtatataaccgtcctatttacatagatgtatacatagtcataatccttccatagccatttcatatatatatatatatatatatatatatatatatatatatatatatatatatatatataccataaatgctatgttggttaactcctaaatagatcacgatgacaatagaatgattaagaagctttagcccttagcatgattggaatccattagcaaacacgaatagtacattttattgtgcatatttgattgttgtttgaatattggtttttctcgcgtattatagaccttgtgtatcggttagtcgtgaggcaacgtctgcaatttctaggaggagaaggttgatcaagattatatcaagaataaggactatcctgagcaggcaagtcatcactattctttgatcacgttgatcccaattgcgaaattaatttttgtttacaaataagattgtatgtaatgatgaacatcctacttgtgattatgccatgccttgattattgtttacccttaaatctttgaaaccatgattacgtatgagtccctagtcaactatgacacttgcttagaaatgctactttagaatcttgcatactcatgtttatcaaatattatatgcttgggcaattacctttgggaaggtaattgagatgcggcatgtggagacatgagcaccacattgccttgataatgatgacatgaaaggaattaaaaacctttgttttagaccggggtggacggtggatttgggtggtatccgggaaaggctagtaccgtccccggtcaattaaggaccgagccatgaagttaagcatgaaacgaccccgtacaaccacatttctcgaatggggatagacctagcggagtaaatagccgagcggaggcagtatccatgcatagtggtttctcatgtgtaaggcagtggctctacaatggtgtcgccattgctaggactgccgtgtgttgagttgaacctagttataacttaattacatgggtgtaaaacttcccttcccgggtgcgccagaactcctctcactactagaaactgtgtacgcctagagtgcatgaggatgaaaagttcatagagcgggtattgccaatgcgaggttatcgaaaagctttgtcgtgacgcgtctcatatgttgagacaaggctcatgtgttgggcagtcgcggggtgtgggtaaagtgtacatccactacagtgtaagtaaaccaaatctattcgaatagccgtgctcgcggttattgagcaccgggacatgtattacacttggctagactctaaattcttaacttgtgtgggatgggatattgcatgatgaattttatgctgatggagccacttcttgagaggagggaaggtggacgtcctcagaaaaccatgacgactcaatagcgggaagctatccttgggattacaatggatgatggacagaaccgtcgttgtttaatgtgaacactggtattaaaacttgatcagtctatgctaggtcttaggcttgtgaaaagaattgcaaaactagctttatgcaaaagaacctgaagccgttccttgaaataccttctatcatacgcattgttgttgtggtggcttgctgagtacggttggtactcacccttgctatttatatatcttttaggagagtgtcgaagagaagcccttgtcggtacgcttgcgtatccaacaagatgatcggagtgcagtcttgttctaggtctcgttccccagtcgactgcctgtagcatgttaaccgggccctattattattttgtcttccgctgttgttctctgatagttgttggcctacctggccttaatgtaagtatttaactcttatagcctgaattcattcgtgatatgttgtgatccaactatgtatgtgtgtaccaactactgatccagggattggtacggataaacatagaagatttccgatttccaaaatcaggggtctacagtttgggtatcagatctggtccctgcaccgtctcctacactgcgtcgaggagggaggagcaatagagagggggcatgcagcgatgtttgaaagagcagaataagatgcacgcggtagaattggggaggtgagggggggaggcatatcggtgggcaaacggtcacatcaatggctgtggagagcgaaaggattgttatgtcaacgtgtgagaggaaatgtagagatagcttatgcgcaagagccaagcttagacttatgtatgcacgcgttgtgacctgcgttgactgtttttaccatcggttaattaagaaaacaagcaccactgtctattttttatcatgaacaaataggagtatttttatatcacaatgaattcattaataaaccggcctgaatagtatcattaataaaactgagaatgatataatttccagaaacaactttaaataatccggcaatgacaatgaggctccggttgatggttctgtgcgatagggtcgttacgcaagattgaagtctcaacatttttaaccatattatttacatgagtttttccttgtgctattttttagcttcgtatagtatggaaacttgtaattagtaggagagagatatatttttgtaatggcaagttctaatagaaaggatggattaagtggagaacataaataacagtttgtctggtggaggaaattaaaatgcacatatgtgttctgtaatttagaaagacataacccttgtgctcccaaagtatggaaagcttaaagaattatttttttttgtcccgatatgtctatgcttagcttgttgtcctcgacgaggacataagctaataacacttcaggtaaagtttggcgtagctctggatacgagatttcttaaatttggtcgtacctgcaaatctatggagctgtgattacgtgaataatatttagattaatcatttgttcctattttagatgaaataagaaattttaaaacagtataatttgatatagaaacttcaaattcagaagggatatggggtctggagttatgctagacatgaccttcattatgaaataaaaattgtaagtaatataaagtaccattttacacagtccgtaaacttaatttacttctgctgaattatggaaaacatcagctcctcgacctccatgaacttttctaggaaaaaaaattattcataagctagaacatctctaggctaatagccattctcactggattgtcatttcgaatacttcgcagcaaattcagcaatattcttgtcagaccttcctccttcatgcattgcctctttagctttcttcatcaaccttgcagcactcctcctatagtcctccttcctatccccatccatcacctcccgaatgcacctctcaacctcttccctttgtatgccgccactcttttcctgccacactctgacacccatgccccacaagctctccatatactttgatatggttggttggtcagccaaatgtggcattgccactagcggtacaccattaacaattgcctccaacgtcgagttccatccacggtgcgataaaaaacaaccaatacataacatattttattctaattgaaaacgacttcaattgagctattgttgtctagtactcattcactagtctactacacactccctccaggctaaaaaaaataactttgaccaatattttctattaacatatatatataaacaccaataaatatatgattttattgaattgaagtactttttagattaattatacatatggtttgcatatttctaactcaaacattatacatgttatttatagtcaaatttttaaagtttcacatatttcttataaaaatgacaattattttcaacctggaagaaaattattttgttgtcaaaataaataatttaagtttttgttggttccatacctgtggccttgtgagaaagcacctccagctgggggcaaaagggaacaattagtcctctcttcccacacttttctcgaagttctcgagataacttgtgctcctcgttggacctcacaacccaaaggaatggcttgcctgaattgcaaaggccattgccgacctcctcgagcttggctgcgtcgtagccggagaaagtcccatacgacacaaacacgacagagcgaggaggctgcttgtccagccattccatgcacggcacggtgctcgtgaagaggttgaacccgtacgccgtgttcgacggcaaccggccgtcgccgaggtagaacgacggcaacaacgggccgaccgtcttcgcacgccatgtcgcctccatgtatgctgcctcctgctcatttcacagccaaaatgtgtaacaattttgggaccaaatgatcttgtttgttgcaatgtaagctggatacactagattacctttggctcgaggtcggtgaaggagttgacgagcacgtcgtcggcgtcctccagcccggcgaactgcgccaccgactgctcacagaacgctggtgtcagctctggcgtcgcgacgaacggcggcaggtcgtcgtgccccagctcgacgcctagcgcgccccgcgcgtacaagccgctcacgtccgccggcgtcaccggcagcgcaaggcgcccggcgcacacctccccgtagatgaggtcgacggcgcagggctgcggcatgaacgcggcggcgcccacgccggcgtcgcgcgccacgcggagcgcccacggcaggtgcgggtcgaacaccagcacgcgcgccggccgccccgcgcgggcctcggagacgagcagctccgccagcgtccgtgcaccgtgagcctcgaggctgcggtggtactccccgtagtccgggagcgcggccatgccgccggcgtcgtcgtcgaagccgtcggagaaggcggcgacgcggaaggggtcgccgggaggcgggctcctggagagcacgtagcgggtggcgacgagggtggggcggaggccgtggtaggcgaggcggcggccgaactggagcatcgggttcatgtggccctgcgccggcaacggcacgagcaggacgtgggcggtggcgccaccgtgttgatcattcatgctcgccatgggttcgaatcacttggtgatttgacttggaggtagcaagctcgctcgcggcgacgatgagctttatactaggtgtttgaagggttgagaggcagagtggcgcgcaagttaattttggttgtgctggcgcgcttgacgacgacaagtttgtaggcgaaatggagactcgctttgtccagggactatgactatcacagcctcacagaatggataggtgttcgcgtggtcgaagagaagttgctcaccgagattcctgcccttgaagtccttctgtcaaacaaaacaattgctcttagaggtgtgcttgggccgactagtagacaatctctatctctatctctattataaaaatagaagatgtttttgtcggtattttggtatgttatccatataagagtcagtttttaagttcgtttgcttttgaaaatacatatctgtatttgagtcagtttctaatatcattcacttttggtaatacagaatgaatcatataagaaatctgtttaaaaaaaatcgcatgctaacttgagacgatcggactcttaactgcagttcatgattttctatatatatatatatatatatatatatatatatatatatatataagcgaactctcacagtgaatttcatcttaactaaaccatataacaataataagattaaaatatacttcactcgttgcaacgcacgggtattttttgttgctctaactaaaaagccagaaagcatgtttggggttttgtgcagctgcaccccttctccgaaactccatctatctactatatgattaaaacagcctagaaagaaggtaacacatttgttttggaaaacaactaggggttatccatcattggcatgacattagcatttcatcaagaaacgacctgcacacagcactgaccggccctttattatcagtcataactggcattaatggcaagtcatactcactttgaaaacaaatgtaaataaataccaatacgataaattcaccatttaacaaatcatacgcattcaaaaatcaacagtgcctccatatgttgagaacaatcaagctaagaaaaggaacagacaaattaaaagttgtgcacagggacaataacaataagcaaaaaagagaacataagacaatctaacttgtgcaacagtgaggtctggtgcctcaagcttgcggtggagatgagggttggaacggctgaatctagatccaccaccgaaggatccaacctctataagctcacaacgaggcggtcggcgcaatctctgccctgagttcccgagtcttcgtgagctcctaacatagtcatcgactacaaagctaccagatctgccatcgctctccctccttagctagatccgctaccagcaaatccaaggcttggccatcactcctagtctctgagtcaccgttgtcgtcgtcttcccattcccaagccaccaccattgttcctgcaaatcaagcactccaactccatcgatctcctcccctaaatctctcccgtgcaacgaaggaagcgctacaaggaccaaatctggttgcaaccctgccagatccggtccttgcactgcctcctcccctgcgtcgaggaggatggaggagcaacagagaggaatcatgcggcgatgtttgggagagccgaaaggaggtacgtagtagtagtgggaaggggagtgggggagggggcatatcggtgagcaaacgggcacatcaatgaatgcggagagagagagaggagaggtgcgtctgcgtgtgaaaggagaaggagcgatagcttctaggcaagagccaagcttggacttatgtatacacgcgttctgacttgactggctggactgctttaattttgccatatggtttcaaaaccaacaagtaccactaccggtttttaccgttaatagatagtaatatttactatcagttcattaataaaccgcctggaatagtatcgttatattaaactgagaatgatattaatttcagtaacagttttaaataaaccggtagtgctctggttgatggttttgtgcgatagggaagttatagaagattgaagtctcatcctttttaaccatattatttacttgagtttttcattgcgctttatttttttgctttatatactatagaaacttgtaattaataagagagatatattgttgtaatgccgaattttagtagaaagaattaagaggagaggataaataacagtttttccggtatcagaggaaattgatgcatgcacatatatatgttctgtaatttggtaagcaagctatgtccggtactctcaaagtatataaagcttacataattcatttgttgtcctgatatctctaaggtagcttgttgccctcgacgaggacataagctaacgacacttcagttatgaaataaaaattgtaagtagtataaattaccattttacacacactgtaaacttaatttacttctgctcttaatttacttctgctgactcgtggaaaacatcagcagttcagcaccttgacctccatgaacttctctgggaagaaaaaacaattgtattcagaactagaatatctctgatatatagctgggtgcttgagatttcagcaataatttttgtcaatttgaatacttcgcagcaaattcagcaatattcttgtcagagctccctccttcctgcattgactccttagctttcttcatcaaccttgcagcattcctcctgtagtcctccttcctgtcaccatccatcacctcccggatgcatctctctacctcttccctttgtaagctgccgctcttgtccagctgcactcgcacgcccgtgccccacaagctctccacatactttgaaatggttggttggtcagcccaatgtggcattgccacaagcggtatgccattaacaattgcctccaatgtcgagtttcatccacagtgcgataagaaacaacctatagatgccatatttggtgccaattaaaaaaaacttgcatttagttattgttgtctactacttattcactagtcttctatatactttttgttatcaagattaatataatttgagttcttggttagttccaatacctgtggccttgtgagcaagcacctccagctgggggcaaaaaggaacaattagtcctctcttctcacacttttttcggagttggacagataacttgtgctcctcattggacctgacaacccaaaggaatggcttgccggagttgcaaaggccattgccgagctcctccagcttggctacgtcgaaggtggagattgtcccatacgacacaaggacgacagagcgaggaggttgcttgtccagccattccatgcatggcacggtgctcctgaagagattgaacccgtatgccgtgttcgaccgcagccggccgtcgtcgaggtagaacgacggcaacaacgggccgaccgtcttcccacgccatgtcgactccatgtatgctgcctcctgctcatatttcgcaagcaaaatgtgtaacaatttgcaatgcaatgatcctctttggtaatacctccgtttcatattattataagttgtttaactttattctagtcagatttatttaagtttgcttaagcttataaaaaaataatagtactttcaacacaaaacaaacatattgtcaaaatatatttattattagatttaatgaaactaatttgatatcttatagctaatttttgtataaactatgttaaatttaaaaaagtttgagtcaaacgactcgtaatatgaaacggagaggtatgttgcaatgtaagctggacggaagcacacttaattacctttggctcgaggtcagtgaaggagttgacgagaatgtcgtcatcgtcctccagtccggcgaactgctcgaccgattgctcacagaaggctggggtcaactctggcgccgcgacgaacggcggcacatcgtcgggccccagctcgacgccgagcacaccccgcgcgtacagaccgctcgcgtccgtcggcgtcaccggcagcgccagccgccgcgcgcacacctccccgtagatgaggtcgacggcgcacggctgcgacaggaacgcaacggtggccacgccggcggcgcgcgccacgcggcgcgcccacggcaggtgcgggtcgtacaccagcacgcgcgccggccgccccgcgcgcgcctcggagaggaggagctccgccagcgtcggcgacccgtgagcctccagggtgcggaggtactccccggggtccgggagcgcggccatgccgctggcgtcgtcgaagccgtcggagatggcggccacgcggaaggggtcccccggtggcggcgtggtggagagcacgtactgcgtggtgacgagggtggggcggaggccgtggtacgcgaggcggcgcccgaactggagcatcgggttggtgtggccctgcgccgccgggaacggcaacaggagcacttgcccgccgttgttgttgtcctcgatgttcgaggtggtggcgctcgccgccggtgtgctcatgctccccatgatcttgtttggtttgtggtactggtatgcggcggcccgcggctgctgtgtgtgttttgagtcagaaggattattaataggagtgcagtggagtgacggccaagattgcttcctgcacggtccaatttgcggtgtacactctttcaggggtgtcgggagccttgattagcaagtaaagggtaatgttgcacgtgttgtatcacaaggtttgttttcttttttacagaaaccgcagatcgatgtagtcagacataccactatgcatatgcacaccagtgtacacgctcgttttttttgaacgtctcgtactgacagtgccaagttcgtattgataaagtagaaaaaaattacaagattacaaccttgagaggtcataaccagttaaaaaaatatatcaccacccacacaccgacaactctaatacacaaacccgggggaggcgctagtaccgaccggccgccgctaagcgtgaccgaccgccactagaccaacaaaggaactacagccgagatcgtccaaaacctaacccttagaagcgacatgaaatcccgctctatccacatctttgggattgagggagagagggtgagagagaagaataaaaccgctctccccctaggccctccgatttagccaacttgcataagctagatcgccgacataagaggacgttaatctagagcaagcttgcgccacttgtttgggaggttttggcaaaaggttgcctagacaacatttccaaggagagaagcgacggaagcactgccatcgccgcccgtcaaggtctcaaagagaaccgagactaggctttcacccggccgacccgctagagggatgagacggcacgacaacgccctcagaagggggagtgacgctcgaaacgccaccgttgccggcccgaccaaggcctggctgggttttcactggccgtccgccgcctgcctatccaccgctgacacatcattactccaccaccatctaaacctcttccagtgcgtgggcaccactgcattggcgccccccccccacacacacacacctctcgccgtgtcgccaccggtcgtgcctcaacgtgatgcaccagcatgcacctcgccggcctatgccgaccacaccttccactgcgccggccgcatctccccgcgtcgcgctggcctccgctgccggcagctattggtatttcttacgaccacagataaatccacaagtgcacggaataccgccgtagcacttcacctccgagtgacctcaaaaggatatcgaactcagggaacatgtgtaatctcctgaagactaagtccatccaaggacaacaacaattggtagactagctaggctagagagggctttcaatgtgttttagttatctaagctaaattaaaggtaattttctatctgctgctttgggcactgaccctactggtctgccagcgtggttctggctatagctctataatgtacccgaatgtgaaggattattaggacggaattcagagctgtcaccacctgtcgtctacctctaacaaatctatgggatacacaacaaacaaatgtaatatgtaacctagacaccacacctaagttattaattactactctaatcctagtactagagcacttagtacgaatactaaacaatgaacccgcaagatggaaatctatcttacttagactaagtaattaaataacataagaaaaaatcttgaatgcttactttatagaagatgtttctccgaactcggagcagagtgtaccgacagctccaatactcctccagaattcctcctagaaacctacactcgtcaaggtagaagtcagagagattgccaaactttcaagcactcctccagagcttccactcactatctaactattttctaatgtgtaaaagatataatagaacctcttgtaattcagctcaaagttgtgtgccttggaagtgagatgagctcatccttttataggctccatatgacagttaaagccatgggaaatgtccaaaataccctccaaccgtcattgaggagtaattagggacgtacatgtggaaaatggcgatcaacggcgccaggatgggttcggccgaactggtggttcgtccgaacccaaaagcccacctcctagcctctccttcagctgggaggttgcttaatgggcccccaacatcatgtattataatttggcttaattctaagtagctttgattggccctccaatccgtgtaatcgcgttgtgattgtccggaggtgtattttgtcgcttgacgggtggttttcatccataaaatacctgcttacacctatttcaccaacactgtggaaattattagtaataatccctacactaagttggataccatattttatttcattatatacaggc

SEQ ID NO: 74670 - DNA, 3333 bp, Oryza sativa
ctgaaaatgcgatactcctataaggatgaccaaagtacactgcctagtcttcatctggcaaattggtacacactgcacactataaacctgcagttctactctaactgaagacctatttacagagttacactactactacggtactaccacaaaaaaaaaagaagggggagggggatctgtacacagccaaaccagctgaccaaggccgtatgccccgtatccacattcacatattacaacgacaatttataggcttgccatcaagttgatttcagccggtccaatctgaacttcgcctgaaaaatgagcagatgctatataaattcaccgacagaaagcccttaatctttgcaagatgaattcagaatcagtgcaaggcgctactgctaaccatcatggcatggatatcgtcaaggaagggcttaagcaactttgcgagctttcgaatctcctccttcagagcagcacaatcttggcatttgccaacgagcaggttgatgaacatcttcctgtcaggaatgagtttcattgcgatctgttcaccacgtttatcaaattgtgtcagccaagtgcaatggaaccaaggattgatcattttcgacaaaatcgatgccccaagattcagtaaaccctgaccttgtaggctgctgaagagatccacccatgccatggctttagagtgaccatgtatgcagattctacaagctgtgcaaaacacttctgatcagaatcctcctccaatctctgtaatagtgcaatagtgaaatccatggatctggtgacgttagaaaaggtaaatacaaatgagaagaggcatattaagcagcctacgtattgcatatctcataatgacatgctatgaaagatcgaaattttcaagcgtaagtgcatatataagagaagaacggaagctcattacatgggctgtcttgttttacctagtaagccaaagaatagctctcgcgcagctatcaaccttccttgcagtgccctcatctacctccttctccagtatctcctctagattatagtatttggatgggtccaacaagtacaactcctgcagcctctgcaataggcagtaacagatcagaaaacaaaaggttgcacctggattttttttcttcaaaattcacagaaatgttcaaaagatatacactgaagtcagccagagtcacccattagtaaatagttggcaccaattatttgcaacctactagcataataacgttcacattttcatgccaagacaaatcaactctccacttggccatcactatcatgaccctgtcaatatgctctttccaagcctagaaaaactttaccttcaccctctcctgataatcttgatcttgaaaatattaaggtaaaacaaaacaagaaaaaaaacctcatcctctcgtagaggaaaataaaaaaggaacaaaacaacaagagagggacaccgaagtttgcgtctgaaaatgccccacggatgaacggacggatgtgaccagagcagttgaaggcctgtgtgaggcacacgcaaaagcaaatcttgaggagaaaatgatctgatcggatcagatatttacaacttttgcatcgagaggaaagccctaatcctatctcctttgttttatctcttgtcctgccttccaaattccaatcagtcgccgtctcctagtccaagaatcgagagcgccggaaagagaccgtaaataatactatgatgcaaagactttgcatgccgagataaggttcctggtgtttgtggtgctggaacttgcaagtgattcctctgcagttgaagctgcagttataagctcacgcaaggagggctcgtggtgtgctcgaatcaatatgtgtttggctgaagggacacgatgggtcaggatagagcgaacccatatttcagaatgtttggtttgatgaaagtcaggtcaagtcaacaccattggagtcatgacctgataattctatgctagtagtacacaccttgaacaactcggagcaggggcggatccagcatgggggcggcggggtctcgagtcctcacgaagaccccacattttaccatacgtagataggagtggggactataactttatctataactttatctagtttgcttagaccccaccgctatttaaccgccaccgacttggaggagtaagaagagattatcggctgtcgaatcgtgctttgagattagtgcgaatatccagaaggtggggggcctcaagaggcagctctcaactttggcaaagcaaagcagtgactgtgagcccagtgacagtgtcaaaaggaaaattaattagaggttagcctagctatctacgtggcttaattaaaacgaccggttgctttcggtggctactggctagccgtgtggccggcacgggacaggggaagcagccacaggattacgcttccctacatgggaccgcgccaacagctctaatctataaaattagtagtagatgtgaattcttggggtatgattatttggattcacaacttgcaaccttttttgtttcggtttcttgctctcaagtcgagcagcaggtaggggtgtgattgagactctgtgcctaccaaccatacaagaaggcatttttagttagctaggattttcatctgatcagggaactaatgctttttttgagagagagggaactaatgcttgactagtaaaacctttcttctactaactctgtcttaaaatatagcaaattagacataacatgtaacacgaatctgtacaagctccttattcgtcgtagaattttgaatctgtacaagctccttattcgtcgcataatttttcacgatctcgcagatatatgtatttttttatcatgatttacgctaagaaatggtaatgatgaaaaactgtaacatggcgaaaatatttttagggacaaatatgtaatgacaataaaattaaatactagttctaaatatttgtaatcagtagccaaactctaagatcatgcagattactagtaggtcattaggtacagaaggaatgatttttttctttttgtacctcgatgtttcgttggacgtcgagcctcagcacagccatggtcggaccgatcttatctgcaaacgcccatgtaggagtatcaccagagaacagtaagaacaagcaaaagcaacaacgacaaagcacgcaggtcaccatgtgttcaaatgaagaaacgggatgcgatacagattactggcaggtgatggcagatagaggagtaaaccatgcaatggcatgtaaaaaaggaaaaaaaatggaagaattggagaaggaaggatgaattatttttgaaatttgaaccaagaacaaggttgaaagag

SEQ ID NO: 74671 - DNA, 2718 bp, Oryza sativa
  unsure (1)..(2718): unsure at all n locations
tataggtagtcattaaaaaaggaataactctatttcgcctccctaaactcatgcccctggttgaaatacatccctcagtcgtaaaaccgggtataactcatgccccaacttccaaaaccgtagcaaatagactccccaagcggtttaaggggcggtttcgtcctacatggcacttacgtggcgagttgacttggtctttataccacgtggggcttacgtggcactaaaataacaacaaacctaaatgggacccacatgtcagtgagtaaaacaataaaaataaatttcagactcacgtgtcatttacattgtcacctcctcttaaacctctctctctctcatgtggatgttggatggcagtgacaggcaaaccgtgtcggaagtggatggcggtggcggcaagacgtagcacggcggagggcgaggactacggcggaagctgccgagtttgacggctaggtcaacaaggtcggcggatgaactctccactgcaggcggcgcgcgagcgtggtagcgtcaatcttggtgaaggggatgactccccacgccggctcagcagtcagcatcctctcctcctcgccggttccccacgccgccgccgncttctncccttcgctctccttccctaacgccgacctcgtcgtctgcctccgcctcgacccctgccccgacgacaatgcaaatttcgacgccactgagtatcaccgccgctatcccgaactttttctttgtttataggatatgaaagatgtaaaaaaggcttaagaatattttaaatctacaagtcacatggttggttcttgtgaagaaaatatcaaaaaaataacacaaaataaaaaagttgcacatctctcctctacactagagaggagaggagaggaaaagaatggggttggggccacattggtgcactccccctgccacctcggcgccgacccgccacggtggtaggaggacggcaccagagaggctggcactgtcccgttggatgactggcgccagtgattctggtgctccaaaaaggatcatttctgggataagtttttctaggggtctatttgtaaaataagttttttaaaagaaccaaattgtaaaaaattagaataaataacctgtaaagaagaatagatttttcttttgtcaaacaccacatcattcctacaaaaccttaatggccaacaaatagttgttgcccctaacaggataagtgacttaaggcttttcctaattccccgtagcaaattaccaaacatgttggatacaccacgaggcgggaaaagccctgtagccacttgtatagtgcaccacacaaaacaggcaaatttgcattcatgaaacaaatgtaaaattgtctatctttgtgacaaaaggaacaattcttaggaagctatatcaaatggacccttaggtgtttgtacaattcaatgaaatcaatccatttcaaatgtttttctttctctaaacaagattttcttttcttcatagggataattttttttccatctaagaatgacgcttttttactagacgtgttaagatttcttctaaatttgttaggcataccctcaattactacaccagtccatgtgactctagctacaaacactagttgaacctacaatgcattgagttaaacatccgtaattttgacattttaacccttttgataaacgtattctataagtaaacctggacaaaaaatataactaaaaataggccttcacctcagcatcacgggccttggcattgaggcccaacatcataacgccagacccattggctgtcacgcccagaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaaacctccacaccatcagcctcattgtagaactcttcctctgatgaatgattgcaaggtgagtatatgacatactcagcaagccacgcagcaaatatgtaagtgcacaggataacaaaggatggcataatagggttgcatttgcaaaagcagtatttagcaaacatttgagaatttaacaaaacagttgagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtaacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatac

SEQ ID NO: 74672 - DNA, 17694 bp, Oryza sativa
  unsure (1)..(17694): unsure at all n locations
tttgtgtacgagactatttagggggattgacagtttgacatagtgttttggttactgaaaatcaacatcttattgtacattttcaggattctcaacaatcgggcatctgccacgaagtcaaaggagaaaaagatgaagcacgtaggggagcttcaacgcaaattgcaggtgctgcagtcggaaactactacattaggtgcacaagtgacagtgatgcaggtatgttttcaaaacaagtaatcatttgattaggagttttcacaaccttagttactgttggtgttgtttgtagaggaacaacaatgagcttgtatcacagaacaatgaactgaaaactaggttgcaagcaatggatcagctagcacagttgggagacggtaactttccttccttgtttttcagcatttatttgttcattttttttcaaagtagtaatcttgcatctgcaaagcatgttgtatcgagtatatttcaagaagaagaatgtctttctttagaaactacattcatcgggcatcgcgatagtaatatatagcatctacaactaaaatacatagtttgaaatttaaaaaattgtgcatatatttgtacaactgtataacaaaatgtcttttattgctgaatggccgtgatttgagaattattgtttcttataacaaatgttgcttaccatacatcaagaacatgattcggatactataagaggaaaacagttcgcacgatttaatatgtatgagagaaggtaacatgtcaaagaaaaactttacagttgttttatatatggtaatgtctataatcaaaactaaaattgaaagttaaaatagaaacaacaaacacttcagcaacccaaaatattgtattatgcattttattaataatggccgttatttagagtgaaagaaaaataacagggttggaataaacctccacttactcaaaatagatggatagacgtcaggcaacttattcctagcatgccatcaaatttatttccttaacactattacctaaatcgtttaaccttcacaataaatgttttttgtcaaggaaaggagagaacaaccttgaatctatagaatttggctatctattagcagcaatgaatccctacatactaggtacaaaacacccaaggtttcttaaggagtttatatcagatctaacttgtagttcctatgatataaaacaacagttcgatcataacttatatgtcaaccattgtatgaaatgtattaaaaaaatctaatcacatttgggctaaatgatgtaccaaaagtatcaaattggtggatgaaaatggcgttgaaaaaaaagagaagtgaatgtgctacttttattatttatcaaccctcccaaatcactgtgaaacatgatacgactctgtcgacggaaagcattcagatatcttttgagtactgatcctatgttggacatttgtcaatcaactatgtcagcagaaagcattcagatatcttgtgagtactgttcctatgttggacatttgtcaatcaatagtgaacgacatatctgctaatagactcttaagctcgttagaagttagcaggatttcatatactagatgatgccctgcgtattgctgtggaaacttttataatctagttttccatagataagagctaaacattagccttgacatgtgtgagcataaacaaagcttattataatggttgtaggctttgtcagcttacgctctcaccaatatttcaagtcaaagcacttcaaaataaaactaaaagtgtacaaaacaacattattacaaatgaatctataagcgcaaagggcatggttgaagattctattcaactttaccgcttggacactgagctagaacaaattaagagagagagatgaacctgacagttcaatacaacctaatatgggtaagtaaaaagtaagaaataaaacacaacaattatagagaatccacgccaaaatagtcaaagaatacaaactgaaaaaaaatctgctgagaaactgaagaaagataatgataaaatgataatatatcaatcagtaatataatttacaatggaacaattagcatagcactacctagcatggagtacagattagtgaaaatgtgggacaaatcttttgcacctacctattacggatttggtactgaatttgaggaatgcatccaagatttggtattgaattgtggtttccatcataaaaaataaaatgggtttatatattgtctccacaaatgggagatgggccaagagatgatcgtcactggcaatggaagatgtatattataagtatttcttgtaaaggttatagatgtcatgattaattaccatgaaagtaaataggtaagataaaacggctagctagttgattaccatcttgtcagctacatgaatcctatcttactataaagtaatcccccactaactccttaagcttaatattcaaagatgccacatcatcatccactaataagatgccacatcatcatccactaacaatcatcacatttaaacatcatgcaaacatgctatatctttatagtttttataatttaagagcttttcaaatacaaatatgttaaattatcatccaacataattcacataatgtttcaatgtatatcttttatgatatcctatatacttatacagttcatcctcacttagttagtgcttaaatgattaatctatggtccaaattatatttctctttttttcctctaattaagtcatatcacatcaattgtttttagcctttagatgattaatctacggtccaaactatctttctactttttttcttccataaagtcataccaccttactttgaatcaccattctacatactatttaaatttaaattatcataaaccacattaatttacttaatctgatattatctagctatcttacatgttattttttttgttatcatactaaattctcgcagcaatgcacggggtttcacctagtaattagagaataataaaccagcaagcatgtgccttttgatgcgctacactctagctgcctggaggtgagggatggcaatatgggttgggcaccgttcttcttgtattgcattactcaatttgtagggattggaaacaaatctgggacaaccaatgttaatctagtggcttaaagtaattcagatgatgttgctgcaacagggttgagagaattagtattaattgttgttagtggggatcaactatatagagttactagatgaattcccgtgcattgttgtgggatggttgtgcatacagtaatgactttgaaaagatgtcactacaaaaataatgaaagaaaaaaaaatctgatgcttagtatttagaaataaaacaacatttactttgaggtgacttgaactattaaaagaatcaaaacactatttataatatttagaacatgaactgcttacggtagttttactttttctttgttttttaaaatggatggttaggacaaaatctgttgatgattacttatgcatatgttttattataaattactttcggttgtttcattcatttttccatgacttcgtagccgtagctcaaacgatcatggatatattgctttatttattgtttcatattgttcttgcctagttggtcacgtcgtagattaaaatagatctgtattctatgatttggtacacaatttccattgatttgcaatgtgctgtctcattgcacttgcctcattatttactcaaggattgcctgtcccagatagttctgtgcacactatggctccagttctgctaactttgatactcacatattaggctccctcctatttgtggggtagttgggtggaggaagtagtactccaaaatcctttatttatatttatggacaaatcttgaacccaaaatcccttaaatttttagagggagggactagttttttccttggggcctatagcctctagttgaacgcaagacgatagcaagagatatatggagagaacaagacaaaagtaggatatggttgagtgccctcttgttgatcgagatcgtctcgcagggccttcgattattgcggattgcagacacatgttttcaaactagtaaacggtgcatttattttaaaaaaaaaactttatatatgaaagttacattaggaaataaaacaaatccattctttttgagtttgaaatagttaacacctaattagtcatgcactgatggagtgccttatctggtaaacaagcctggtgtaaacttgataataatagagaaaggcatctacgctttagaattgtttgggctctactttggtgtagaatggtgggcaagcccttttctagtattattacttatttgcagttaatactcactctgtcctcagttacttgtcactgttcaccatcactatttcaattttaatcagtaataacttttaaacaactaatttattgttaatgaaaattatatggttaacggtacaacacacattgctaatataatatggtggtatacttttatgtttatccttttctttgacaaatatttgaaaccagagaaagtacaacactaggccacctttctagcacacgtgctaaaaatataaacttcaaagtgtactagacaaatgattaaatgaaattatgtcgagcagccttaatgggaattttgtttgaagaaacactattatgtatgtctccaaatcagccatgaatattattcagggcgaacctttaggccctgctgccatgcattttatgtcagcatttacatcagtaaatctggtccataacattttttttgtctacttttcttaatatttgttgtctacatttctttgtccagctctgacttcaagattggctgctgaggcccagcacctaagagctgttgttagtgagatcagtgatccaaatctgccaagtggttcacaccaacaactgagctctgacatcgaccaactgcagcagctgcttacacagaggcagacatcacaaatccagcataatcagccacaataaactgtggaacttttagggtgatttctcataagagacttttgaaagggttattgcatattatattttgctaaatgatgggtaataactttttattaagataatggaacaaaatccgacctttgctcaatgagctacaaccaattattacataaaattgctcaaaagcaatcacgcaccaaagagttcacaaaaacacaccaaatttaacaaaacgtaagaacaactaataggcatcaacacaaaataaagaacccacaatttattgaatcctatttgtaaacctccaccaaagatagcgaaaagctgcatttccgttgactcaagtttatgacatgcattatttattagctagcttgatgtcatcacacctttgtagttacttttctttgttgcacatcattttttagacaaaaatgtaattgcaattatactagtgaactaagtatacacaacttctgaaagacaggcataatcacggtttcggatcagtcatttccaatttgcatcctttcacaagtgtaggggcactaaggtattgttaaaaacttagacgaaactttttcttcacgtctgactaatgaaagtacatctaggcccctaattattttgggttaattggattcatgccattgcaaatatgccgattcagataaatacaattataattcgtctattcgtatccatgacattcgaaatcgcactaaattgaaaccatgtcatcgctgtcacgttttctgtatcaaaatactcctagacatatgacccacatgttagttccatcttcttcctccatcctcccctcttctttcttccaaatctctctcttcctcgtcattgctggagcaggaggtagagcagtggtgtgttacgatccctcttgacctccatcaatcaacagcaaggagaagggaaatactccaattccaacacaagatatcaagtatttgagatacaacttgaggaagggattgaatcatagacacgggaatcaacaatctagaatgggaagaagaagcaagagattggggaatcagagaattggagcttgaggtaggagagcatttgggaagaaaggagacaaggcatttgcctgttcattcatatgttcatccatgatccaaagaactgcagtgtggcttggttttatactccttgctgtttggttgggcctagagccggcccagcccatgtacatgacattctcccctcctcgaaaatcggcttgtccccaagccgatatagcggttctgccgggatcccatggaacatataaatcttcgatgcaggtagcattctcatcactagtttttcagaatattcttgccttcatgtagtttaagtagcaatttgtccagattttggtgaaatatgaagctccataccactgtgctcttgtgcttgagctgaaatacaaccatgagtttacgtacttgctgagccccttcactgtccaatctcttgctccagaaatcagcattgagatgtagctggatcccatggtaacttgaagcataaccccaataaaattgagatgcataaccattttaacaatgcacatttgcttatccatatttgctgatgtcattgagccttctgagctgatgcagttcagtttcccaactgatgcaattcccccaggatcccatggccttgacatagcatattcttgaacttgggcctcatgaaaagcagtagcttgcatgaagtaaagtatggctactagcagtttgatagtctcaagatcccaaagctatgtcatcttcatctctgttattataatctgctgaattgtagatgatactttgaaatccaagtgacgtagatttaaggaataacctatggagaaagtgaactggaataggctctgatcttgacagcacttgcacaaatcatgaacttgatttagttcttgatctccccatcttccaagagcaggccaagagcgtagtttaattagctttgtcattgaagccatgatctgcagcaatggttccaggtcagccctcaaactaactgggaagacaatttgcagtggtcgtagttgtggttgctgcatgtccttcctaacatgtaaaccatccaagtgatgcggatgaaaaataaattgccagtgcttttcagtatgcatggtcaacataagctgctgcatgaaccaatactccataatgacaaataaatcaagaactgcatttgatttcctctgaacactaagtccttgcaaaccaaattctcctggatcccaaattattcccaccaacagaatatattgcagatgaagtgtttcagccaaataagattgcatgtgaagctcccgaagatttactgagcatcccctcacatcaaagttgctcttggcaatcaattttcccatataagtcaaccattgaacattttgcaaactatcccaaggtccaaacaaaaacagccattgaaccttactcgatgtcctaccgagtgagaaaaatgctccaacatcagttttatctcctgcttcaaaaagtgctgaccgaggattcttcttgccttgtttccgtagcaattgcccctgctcctgaacaatagtcacaccaatgcgaagagaaagatcaggtagtgaccatcgttgtaggagatacatcacgtctccgctactttcattcaattgtggattaggccatggttgtggctggtgctccactcgatcacctttgcaattggctttgagaaggtggccaattccatagaaacttcactaccacgccttcactgccttgacttagctgtggatcaggccatggtaagggccgagaaccgaaggtcatctcagcttggttccatggaattactgctctccaaggtggtactggtggtgagctagctgtgtattctgagctccggtcaaggcaactatagcaagtcaagtaaacgacagaaatagcttgatggccaaaccatggattgttgaaggatgtttgcagtaatgtgaacttggaattcacttcagtgagctcaactaaatcctcggtggctatgtcatcatcatcatcattgatcatttgttcattgcctttcgtcaaacacttggtaggtgtccccatacacgactcattagtatcaaccaagctaattgaattggcctcctttctgacctccatgtgttgggaactaattcagtgttggtgctcgtaactgccaccactctggtgatatcaacgcttgcggttgactcaaccttgatgtcgcagcatgtcacgagcatgttgttgagcatggcaatcatcttggcacacaactcttggaatgtctcctctggtttcatctcagatttgtccatgtcggcctcatcctccttagtcgcggtgagggaaaccggtggcgccgctgctgctaatgcggctgagggcatagattgactcatggtggccgggaacacatgttccaatgtggtaggagtgctctcggcatcggacttggtgatggcacagcttggtaccagcatcgaacacttggtgggtgtcagcactgcaccatccttggaacaaggctgcacatgctgagcctcgagtaggcaccctccatcatagatgtggtggccatgggtggccccccgagccttctccgcaccacctctcgcccggaaccaaacaagagcctccactcgccatgcgtcggccaccagtatatgcaattcctccgctccatagatgtcataaacctggtgcaatacctcattggtcactgggtagatgatgtggctcacttggacatgaagagcagcacctgcaccagttcccaaccagctcggcatttcatcaaacacctagcaggtgcctctagtgcaactacctccaatgcttggattcagtatctggaagtcgctgctgcaaccgtgtgtcgtccaccttgtctcctggcatggaatcccacgaaccgacggctctgataccatattgttacgatccctcttgacctccatcaatcaatagcaaagagaagggaaatactccaattccaacacaagatatcaagtatttgagatacaacttgaggaaggaatagaatcatagacacgggaatcagcaatctagaatgggaagaagaagccagagattggggaattagagaattggagcttgaggtaggagagcatttgggaagaaaggagacaaggcattttcgtgttcattcatatgttcatccatgatccaaagaactacagtgtggcttggttttatcctccttgctgtttggttgggcctagagccggcccagcccatgtacatgacagggcgtcaccgctggagctgctgcggctgctggacatcccatgggtggactcctgagcgagtgccaaatcctgctgttcccgtcgaccatggcatacatgcccaccagcttcaccatcctagcacaccaggcgtggcacacactcacgctgggagcttgggactaggcaccaagtagtccaaggcggtgctcttatgttttgagtccgagggaacgaagaccgccgtcgactagctctggccggctataatcccgctcggggacgtcaacaagaagctcatccgggggctcaccggctggcagcgagatggcccggttcaagttcaggatggtctgcctcatcatctccatctccacaagttcagcgagatggccctggtcgtagtagctcactaatccaactcttcaagtgctcttgatagtttcatcagtgcaggtgttccactttgtccacaaaagaatctgcatagtccgattttttgtggtccaattggtttattccagtgtcagtgttccactttgtcccgctagaaggtgttcttacatatctactgagcccaggaggaggaaggtagagagagagagagagaagaaattggggaagaagatagaaaatgtgacggtgaattggtgatgacatggttctaattttgttcatattcggatggcatgactacaaatagatgaattatagtagtatttgtctgaattggtgtatttgcaatggcatggatccaaaataacccaattattttgatggttaatgataatgttattagtgaggactaacattttaattgagaatatgtgaaggaattttagtcctctaagagttgatgttcaaggcaatagccattcgtgtagcaaaaagatgaaaaaggtaaagattcaaatggtaaaatgttttttttcttgcttgtgtcgatagggaagtcgtacaattagatggcatgttgtctcctaggaatgagtttggtgctcaaaattgttgatgaagtgttttttattcttggactttacattctcccaatatttggaatttctaagagtggtttttgaaatttctagagtaaattttggaaaactgcaactatagtaataaaactatcagtttgctgcagcattaacgacctatttcagtttgttgcaaagattgcgtgggaaattatcacaaaagtgcaacttttacgtggcctaagcatactattgtcacctacatgtcgtttagtagcataagatgtaaaagttgtagttctatgataatttcccacgctatcgttgcagcaaggtgaaatatgttgctaatattgcaacaaactgatagttttttccctatagttgcagttttctgaaatttactcagatttctaaaaaggttacgccttgaaaaatgctcgttggtgattttcgcaagttccaaatactttttggcattctcgaaacggtcatggctagccaaaatgctctcggtgattttcgaattttccaaaaatattttttcaaaatttttggaaatgtgaaaaagctctctagtgattttcggaaattcaaaaaaagtgtatttcaaaaattttgaaaatttgattttgctctttggtgtttttttggattttccaaaaatggtttccagatttctgaaatggtaaaatctgtgaaaaagctctctgttgatttttggaatttccaaaattctattttgccgagtttctggaaatttatactgttcggaatttccgaaaatgcatttcaaattttccaaaaggggaatctttgctcccatcagcaaatatgtgggtgtgcctataaatagtcccccttcacccccaagctagggttgctgctcttattgcacactttgagtcgttggcttgctttgacttgagatttactttaaaccttgctttctcacttcttcctctccactgatcttcaatcttagatttcgtgtgtgtgtgagagagagagaaagagtgagtgtttgatttgagtttgtgtgagtgcttgatgttgactataaaaatttattgagcatttgattcatccccaagagatcattgcttcgtttgttactcttggtggttaaggacacctaaacgggttgggatcaacctcgaggcactgattcatttgtggtgtgccaaggaattttgtgaaggtcgaatctcactttcaaaagggacgatataccactaatgaaagaattgtgcatttgtgcaaccttgaggatagggttgaaaaaggacccggctctttgtgagctccacaacggtgagtagaatcctctcacgaattcgaacttcgggaacacattaacttgcaagaatcccggtgatatccctctcttactcctctagctttgttattttgtgctgctagtagtttagatggtgcattccttccatacttgtgcctagctagatctagtttaacttgtgtatatcgctttatctatgattttcagaattttcataacttccgaaaagtattgctttcgtttttacttaaaaattttaattgtctattcaccccctctaggtcgaattgaccctttcaaccaactacaaatctaagtggcattacacatttattggcatagtagtcttgtttagggctaacaaggcaagcttcaacaatctcaagtgccatcttgcatgcaatccatgccatcgcttacaagatcatggcctaaataaagcacatgccttgaaagaaagacgcgatgggaataacctgttggttttatcacacatgcctttccatttctgcaaggcaccatacaaaatgaaaaaaagaattttgccatttgattgatgccttctctcactagctttcggacctaacatccatacactgactagaagcctcctccaaaccctagtccccgccgcttcccctaggcttgtgcccaacatggaggatggcacccactatagttctcacagccggaagggtgcattgatgcgcgccggcccccatggtttgtgccctagtccctaggcttgtgtccaacatgaaatcctatcttactgtaaagttatagcccactaattctaaagttcaacatgcaagcatgccacctcatcatccactagcaataattacatacaaaacttacgtaagcatgaaacatccaaaaaggctaacgggcaatcgatcgcccctagtgatcatccccccctcctccacatagtttcctttttaggcaccacattactttcctattttagtaaatttatgcacctaaagtttgtacacttccagtttacacatctaaattttatacacataaagtttagagacccaaagtttataagtcaaaagtttatatatccgattcaatttgaatttgaattcaaatattttttacatatagtatttctatacatctaaagtttatacacctgaagtttagagacccaaagtttataagtcaaaagtttatatacccgattcaaatttaaatttaaattcaaatatttttatatatagtatttctatacatctaaaatttatacacctaaagtttaaagacccaaaatttataagtcaaaagtttgcatacctgattcaaatttgaatttgaattcaaatattagtttatagatccaaagtttataagtcaaaagtttacatacccgtttcaaatttgaacttgaattcaaatattttatatatatgtatttccatacataaatttttctaactttattttcttatttttttaaaaaaatttatggtgtagtaggaagagaagaaggggaggaggaagggggagaggagcgtatcgggggatgggggcgatcgctgggcgattacccgcccattagccacacatcatctataattcattggattctacaaatcaacatccaatcatcttccttcacattatttttcataatatttttaacatatatatccattatttttataatacttaacatatattcatccatataatcaaagtgcgagatatcatatttcatctacaatctcatacagagtctaccaaatgtatttctctatgaacatagtttgacaaatcagttttatttgttgttaataactaatataattttaacttaggaatttccccagcacatcgtgggcaattcctagtgattatagaaacatcaaagcgtggggaattcctagtgactatagaaacatcaaccaaattaagctcctttaacttaattttctttgatgtgaggcaataacatttgagcctctctaccaagtggcaagtctcagtaagtccgggtgtgtacttacccacgataacactacgtagtccatccgtcttataaaaaactaatctactaccggatgtgatatatcctcgtactatgaatctggacatacatctgtccagattcatcgtactccctccgttttgagtttttgtttgcaacgtttgaccacttgtcttattcaaattttttaaattattatttattttatttatgacttactttattatctacagtactttaagcacaacttttcatttttcatatttgcaaaaaaaaattgaataagacgagtggtcgaacattgcaataagaactcaaaatctcttatattgtgggacggagggagtattagaatatgtcacatctagtgctcgattcgtattttatgggacggagggagtagggttgtgccaccaaaacaatttaagttaaattaatataaacccaaaacaatttgtttcgattatataccgtgtatatgcatggcaatgtatcttaagcgaatcaatttaggctgtgtttatttcacttcaaaattagaaatttggttgaaattggaacgatgcgatggaaaagttagaagtttctgtgtgtaggaaaattttgatgtgatggaaaagttgaaagtttgaagaaaaactctagaactaaacccggcgttaatgccaaaagtatgaataaattcgaattcaaaaccgtgttcagaaacttccggttccggacaaaattatttagcactgaccagctgtggaagaagattccacacaaacccacccctccctctccccttccctcctccttcctaccccgccgccggtgcttgtcgccgccgccgccgtcagagagggcgaggagggcggctcgaggaggagcagcagcagcagcagcaggaggaggatggggttcatctcgttcgtcgggagggtgctcttcgcctccatcttcctcctctccgcctaccaagagtaagcacgcgcggcaccatcagatctctctccctccttgtcgctggctgaccggcttctttttgttcctcgccgatttctactagtataggtcgtgcccgtttcgtttggattggttggtaggatcgaagagtcgtcttgaggcaagatccgtgcgttcttggatctttgatgtgacagatctgagagagtgggtaggtgttgttgattagcggcatatcgtcgtgcgagtaaaggcatgggattccattccactgcaaaaggagaggggggattggggatcagatcgcacgcggcgtgaatcttgaatccctgcatgatgatgcgcatatgcatcatcagtgggagcatgcatgttctttctttcggatgcaaatacagtagcatgtttgacagtttggaacactagtttgcagttcctctgatcccatatggtccaaatactccagtgtgttcatcatctgtgctcatcaattgggtatgtgacgtccacattatgagctgatttgatatctgtttgggttggccaagattgtggtgctagcagcagcagcagcagcactgtgctattggtagactgacccgtactcccaaccgattaccaaatccatcttcgtctgataacttaggtgtggcatgagtcgagtttccaacagtttgtgccgctagtggtgaagctctctcccaaccaattccaagtttatgactggtcacaatgctgagttaacatgactgttttgaacatcttacatttggtgatcttttaggttggggcctgacatttttattatctcagggtataaatatggttcaccggagaagcagcgatttggagatcacttagtgtaactgattttcgcgttagcttatgagttacattggtcagggttctgtaaactgtctactggtacaatgccatatgtaaggaacaaatgtcttgccagttattactgtatataattggtggctttgatgcataaccagtatgagctgcatggattaatgaataacacataccatttttagtataggacattgccgtggtcatgtttgccaatgttgtgacttgtgagtaataatcgaccttgtccaatatgtaacttttatttttcttgtttaaggttatgtggatcaacaccatttcaatgaacaagggtaactaaaacttctgttgaatttttcctctctttttcattagttagtattgtgtgcatgcttttttgtcccctttgctccatagcttgccaaaacctttctacttgcttgttacagtgacgttacagcagatatcactatttttttccacattatttgaaccattgaatgtatatgcttgaatctgctatcaagtactaatacaagttttctgaaggttaagataaattttgttatcataagtaggatttgttattccatatatgtctgctctacttgtctccgtggcaaaaaggacagtcatacttctcttgtcaacccccctgaattgttctccaaaaaaaactccctcttaattggtagccaacgcccaacgcttacaagtattagttcttctgtggcttgtgactcagaatttagcgcaggaattggcaatacaagtcctttggtagcctcccctgtttttgagttggttgtaaaaagtacttctgaaactctttttagtggttaaataattctttttcttctttccatgcaccttttatactgttgagaatcttgaatacaattgttcatacctgcaggtttagtgaatttgggactgatggtggaccagcagcaaaggccttgaagccaaaattcaatctatttacgcagcaagtgtccaagagcttaggaatggcagtgccacatattgatgtatgaatatttatttgatttggctgccccattctacctaatattgtttcatttacttataccattctacctctttttctacagataaagactgtcattgctgctaccatgtttcttaaaggctttggtggtcttctgttcatcatcagcagctcatttggagcattcctacnnnnnnnnnnnnnnnnnnnnnnnnnnnnnnnncacctaatgtgttttctttatgcattctgcaccatgcctacccaaagtaaaatattatgtgtatttactattgtatgatatatgtagttcttattgttttaccatataaattggcaattttagctttatttctgctttggcacagcattttgatacattttaacgagattttgtccttttaaagtcatagcatctggaaatggaaaactaacactattttcctaagagctcagtgtgcatctcattgtcagtgtagtatatttcacttgactggtgcatataagatgcactttggagtttggagtttgacatgtgattcaccatagtccaaaggccttcatgtttttttactctggaagtaaacaaatgttctgtaatcccatgaaaaacattaacccattcaaaatatatgtaattcagatctatatatgtcacagcaacactatggatctaagtattttaaggatcctgggttaaaattattgtgtaaatgtgtgctttgtctagtgtaaccccatagtatttctttccctttctaactattcttcacattctttgtcggagattggaatactgaatatcttgctcatttgtgcagctcctgtacttagcagttataacacctgttgtgtacgacttctacaactatgaaatggagtcttcacaatttgttcagcttttcgtcaagttctcacaggtttgttagcccaccacctcacttactaaagtttttatttcaaaataattcagccgttcttgttaattgttacaatccccgcatatttttcttgtctattcagaatttggcactttttggtgccctgcttttcttcttgggaatgaagaactctattcctagaagacattccaagaggagggccgggaagaccaagacaaactgaaaccagccactgtagtaggggaagctatttgtgctccttatgtttgcatactttacaaagtacatgtctcaattttcctcttgatactccatagaaattgtgaattggggacttaacagaacctagtatgtaggatacctaagtatgtctttatcagttctgttatcggtatatcccggtgtgtttcttctgtcatgaaagtaccattttgctaccgaaattggttgtctatggaagatcaaatagattcata

SEQ ID NO: 74673 - DNA, 2622 bp, Oryza sativa
  unsure (1)..(2622): unsure at all n locations
gtatctccgaccacccgcgnttngccgcctcctcctcttcctcctctcgatctctcccgtcctcctcctcctccttcggctcgtctccttcgcccgcgtccttcgctcctacggccttcgccgccgcgtctcctcctccttcgctttcgccgcatggcccgtcgtccatggcgctcgccgtcgccgccgccgcttcgctctcatctctccccgtctccgtctccaccaccatggattgatacctcagaaagtcttcggtcttcgtcggagtcaccaatcacatggcgattgcgagcacgcaattattgtcgttgtgatccttcgctgtgtgtgttcttgtcctgtgtcagggagagtgtgaagtcaaaatgctcaaacaccgtgccgcttctgtaggcatagaagagagatttatgaatatatactaagggcagaaaagaataaaaaaaaagcttcagcggagcttaagattctaagaaagaatttaaaaaaactggtttttcctgcttttggcttttatctttttttttattctacaactacatcttctcataatctaaatcaaaagttgtttagaaaacttctgattctaaaaaaaagctgtaccaactaaaatcttctccaaacatgcccttggattggttgggcacgttgcacgttagttaacccgcctttgttcgctctggggaacgagaaaaggcactgacaagtggtaaaaatttacgagtactagcagtacaatggtccacggttatcgaactggtgattgagtggtgaacatggtaattaaccaagctttgccgtcagcgtgcgttaaaacaaacaacggcacgtccagctcactgaatttctatcgagaaccaatccgcatgtgcataatatttcatctactgagtatatatgtactttgaaaagatatttactaccctcttactaacaaggatgtcaaacatttaattcaattatagtgggggtaataataaaaatcaacatccaatcacattgtaccacgtcagttttgtaggatgtttgggaacaaaattttgtatctgtatcatttttctcccaatattcaccatgcaatattcaccgcgtaaccgtatggttaccacagtaactgtgcttcccacacggatgcgattccttcaccggtcaaattattttaagtttaaccatggttaccaagcttacctcgggaaagggtaaccacatgccacatattgatgcccactgcgcaaagtttttcatgagatttatgtttatatacatattttaaatcatgtctcgagtcaaaactaaaaccaaagtgggtgtatttcttctacagtagtcctgcacttccaacttgtttgcatgttacagtttgatatgcaaaacttctgcaagactagtttatgattgtgatattaatcagtatatggagcagtttttattatcctgatattgatagccctcattattactctaaagaaatatagggagagggcgtcacgtcctcttatcatactcgacgcatgaaagggatcacgccaaggagaagacaccagaagacaatatccctggccgtcacacaccagttcagtcagcaatgacgaaataaatggccatgtcactcctatcttttaagttccaatcggccgccaaaacaggtacatgccccaattctcacagcagtttctgccccccacaaaaaagaagtgatcagctgctacaccatcttgaccagatgccagatgcagtcccagatcctcagaaaccatcggtacaccaccaaacagcttctgcagtccaccacaggtaaacaaccaaggtgcaaatgtaaaatgttacgatcgccagacatgagaagctcgcactaagtaaatggcaaattggccctggctgcatgtgattgccactttgcctgacgaccttggaagagagatactccttggacatatgcaaaacaatcctgatctttaagtagccttgatactgattctgatttcggtctggtggtccgaaagaaagtatagataatttcataaattgtcccccaaaaaaagtgtcatggactcatggtgtcaagattccccaacatgatgccgttggaaaccaaagataaactatccaatggaatccacaaagctgtgggatcagctaattccagacagggcaacagcaaaactgatgctcgtttggtgttcacagtttgtgctttaaccacttagctcatgcagcagcaatacagcagcgtgatttccagtaaacagatcactcagctcgttgacatttggttctccctaatcgcttgtagtggggtactgattaaatccgacctggctctactttaccaaaaggaattccaaaatatcctccaacaggcaacagtagcaaaacattgattaaagaagtgcaaaagaatgaatgatgcgacaaacaaattgaatcatatgcagacggcaaactcaaaattaaaacatctttatgaaggctagtacacaaccactcgtgcaatcccctttttaaagagagaaagaactgagtcaagtttaagcaacctctgaaacatcacacgatgataatctcttctgttacatagaacttttttaggcttttcattgtctatgacatcttagcaag

SEQ ID NO: 74674 - DNA, 7784 bp, Oryza sativa
tgagtcccagctcgtcccaagccaacccaggccaaccattccacattttagttgttgagcaaattttaagaattaaaacactaacttgggtacattgctttgcttgcccataacagagggcgcggctattcgaatagattatactctgatcagaggtgtacatctttacccacaagacacatcttcctcacatgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgatcgaccatcgtgaactatcattaagccatcatgaaataatagtaaatcattagttatcccataagtgtactaatgtttctaagcagggctaagcaattatatctaatatctagttgaaccaatataattaaagctcaactagtcaaattaatataccccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcagaaaagagcaaaatcaccaaaacagcacatgaacaagcatgaacagtacatgtggatatttttaatgtgtagatcttaattttagaaaaatttagagacttgaaccaactaaatcggagctaagatgaattagttatgaatttttaaagattaaatcggattaaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcgggtccacggcggttcacggcggacggccttgatgacgccagcaatgacgtcaccgacggcggcggcggctcggcgaggcagacggctcgggcggcgcacgctcaccggcgaacggcggcaccacggcaccaacggagggcaccagcacgtagaggacaacacggcgaacacaccggtgaccaaaacggcggcggagaaggaacggacgacgacggcgacgagaaggaagcggcggctaccttcgggttgtcgacggcgacgaagctccggcgggttccgacggctgcgaaggggcggacggggacggcggcgacttggcgatgacgacggcggtcttcccgagcgacggcgacggctggaacgacggcggcgcacggctgaagcggcggcggcgaaggcaaagctagggcacacggcgctagggctactccggcgacgagaggcgaaggcgagggtggcggcgagtagaggagacaccgggggtccttttaaaggggctcggaggcgacggcggaggcccaaggcgacgacaacgacgaaggaaacgctcggcttggagagaggaaaaccgatccgaaacgaactcgattccacgacttccaaaacgatttagccaaagattccaaaggagaaaaggtagaggagatcccggagatcatttcccctctattgattcggccggagaaggaaaggaacggccagatttggaaaggaaacggcggcggcgcgaaactagggtttcggcggcggcggccgaaggaggacgatgggtccgacaggtgggacccacctgtcagcgaccgaacgcgcgcgcgcggcggctgcggactgggccggctgggccgaggagagagaagagaggttttgggccgactttcggcccaaagccaaaagagactttttaaaacctttttcaatttaaattattccttaaatgcaattctatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacattggcgctgaggccgtgaaatacaatatgaaaagagtaatagatctaaatgcatatgatttcttgtgtgttgtagtggtgagtggtgttttgatggtttctggagatcgccaaactacatggcgctaggatgttgggcctcagcgtgacccatgacgctgaggtaaaggactacttttggttatattttttttctggttcatttataaaataagttcttcgaaagagtcaaaatgtcaaaatttcaagttaaatatactggattacagctctttcaaaagtgtttttcttttcttttttgcttttgaattgtggggttgtaatgtttgttgggtcatgatgagcacaaacctgcacgtaagtgtacagaggtccacaacgttaaatatcagcaagcgtggcacaattttctgcaatatttatagtacgatagtaatattatttaatcctcttttgaattatttaaatgatgcctccaactacctgcctgcaaatcagctcagatccaacgaaatggtgctactttccaccctttttctttgggggcgacgaatccatccatctaccctataggcccctccattccgtgaatatttttttaaaacttcttttggaccgcacaaaaaaaatcgcataatatgacaaattttacatgaatttcatcagaataaataaaactcataaaatcgaaatatcctagctggaattttatacccaattgaaattgtccataggattatgctcctcaacttgtcactgtcaactgaaattccaaatcattctgttcccatttcaaaaataaaaaggtaaaaatcaaacgcatccaaacaaacgtgatatttatatttgcatcaaaaaaaaaaaagctctctctctctctctctcgctctctccacatcggtcgtgcggtcgtgccgccatcaccatcgcccctccccctcttcctcctctcttctttttccctccctttcgcttcgcttcctctcctcctctccaccattggcgacctcgcaaaccctagcgcggcgagcggggggaagatgagatgggacgcagcggaggcggaggaggtgctggagcggatctgggacctgcacgaccgcctcagcgacgccatcctcgccgtctcccgcgcgcacttcctcctcccgccgcctccgcctcctccgcctccgccgccgtctcagccgtcggcgccgcccgcgcgcgaggggaggaacgggtacgtgttcgtgaaggggttgaaggggggtggaggaggagaaggaggcggggtgggggatggtgtgggcgtgggctcgccgaaggccgcgccgccggaggcgatgccggaggcgaggagcctgcacgccatacggacggcgctcgaggacctcgaggagcacctcgagttccttcatgtgagattgcgctcgcctcctccccttcctctgttcttctagggtttttttttgctctggattggttacctggaggaccatgtatgagttgttgcaatgaatgggggagtgggggaatggatcctcgtcaggctgggggagagtgcgttgttcacgtgattgcggctatcatttagcttcgttttcattgcgcggcctgtagactgtaatttgagatggggctaatgatttcaatttcttcatgggagctagcttctgttgctatccacctggcgcttcgtttgatgtttcgattggatgttgattgcatcatgctgttcgcatggtaggatcattgagttgctgctcatgagttatgctgaattatgtggtttgttaatatcatgtcatgggtgctggattttggcctttttctttgggtgtttggttgtgcatatgcttttgactataaatttgctaattaaggcgcaaatagattggaaatgaaggcatgtggatgttaaaaaagtgatagtccacatggctttattctcttttttggtggttttttagttgatgcttgctatttgtctaggcaagaaaaaacatcatttgttctgtagtcatttgtcactggataaaagttcatagcataaaaccatgattaatatgatacttgaagatattatttggtctataatcattcatcactggttaaaagttcagcataacattggccaaggtatgtaagagaggctaattttgctgtagtaccttaccagaatgaaacagagtgaagtagctcttgctttgtcatgttccattttagttagttctgagcataatttggttactgtccttttatgagtggtgggttggaaacctgtgcatacatataggcaatgcacagttccctgtgtgtttagctaattcagttctatctttcctacttaatggtatggttatgaagcttgtgtttcttagtcgttaatattgttcttcctccacagaccgttcaatcacaacagcgggcagagcaggatgctgcaattgctagattggaacagagccgactagtccttgccatgaggctagctgaacatcaggggaagaagtatagagtcattgatgaggccttggcgtttgtaggcgaagttggtgacaagagtcgattcatctcaccggaagatgttcgtgcaactcataaccagtcaggggaggatgtaatggacagtgggagcaacggttcaagtattatggggaatgtgttatcttgtagtctatctttggccaagaactcatttcgagtggacaaaatcggtagtgctctgggtaacgctgcagcgtttgctgtaagtatgtttgctttcttgcagctgcatcaagttgcctttggaagcaaatctccagcaatggattacaggaggcacagttaccattctgggagctcactacagagtggcaaaggaaagcaactcgaagtgtacctagccagaggttgaggaatcatcaagtcacttgctgttgcctgtacagaagttttgaccaaataccagttttcaccggttttgttagggcactaatcattctttatgacgaaatggactatgtttcaggctactaggatactaattgttaattcgtttggacgtgttggactacgttccaattaatagacgtcatacctctaaacctgtaaatggatttttcattagagatggatggaatgcttgtaagtctgtattctgtcagccgattggaattgctgtgttaggtttgttgtgtcctcatgagttatgaggattgaggagtgttgaaaggacaactgtttgttgtgccctcatgagttatgaggattgaggggtgttgaagcattcaaggattcaaggttctttgcttaactgagaagtccagttttttcttttcttttcttgattattgactattttcgacatcggctaccttacaagtacatgtgatgcttcatgcttgtgttcttttaaggcagtgcacttgagggtataactttcctgtgtcatgtgcttgtgcttggtgattcctacatcctcctggcatttatctgtcaagtctggatcatatctggtgccgaagcttctttggttaggtccatacttcgccttggccactcctttacctcagtttactgcttttgctttgttggtttgccggctctttgcacactgctgtctcatgctgcaaagattgttaatgttgagtacctgtgattacatggaagccttttcttcaatacgtactaagcattagctttattcagccatatgggtactagaaatatatatttagtacatctgtacataagcctcacgggaattctgcataatctggtatgctcttactggacgactttatcagtggtatcaacgttaaaaaccatatttaacttgaataatatggttgctttggctaatcatagtatcactcatgccccttttcagggcatttcactcccatgttggagaaaagaaaaaagaaaaaggcgagattctatgcttatggttccgtggtttgttctttcgaaatttggcatccataaaggaaaaaaaaaaagagaagacaaacgctaacagtgagggaataaaggattaaaaaagtgaataaatgattaaagatgttcacttcttactaatcatgctcgacaagacaacctcttttggctgggaaacaagaaggaaaaagagggcacagaaacgatctcagcgtcgccgattaatattttatcctccgttaaacactgatatggaggagatgttgttctttttcctgcaaaacatttgtagtagatgttgtaaatcaggtcttggttgctattccagtcaatttcatcatactttattcgttcctagttacatgccaatataatctttcggaacatgtgagaattgttgagagaaaaatacccgaatgccggctacatcttgggccacttctggctgccattgattgcatgctctagacatcgcactgctttggggggaaaagtacaccgaaggtccctcaacttgtcatcgggacacaaaaacgtcctcgaaccgcaaaaccagatatacgaggtcccttaactatacaaaaccgttcacccgaggtccctaggtggtttttaccccggttttgtcctacgtggctgctaagtcagcgtgggacccatgtgggccccacctgtcagcgtaaccca

SEQ ID NO: 74675 - DNA, 753 bp, Oryza sativa
tggacaagaatacgtgattcagtcggtgacaggttcttggcggctcgttttgcgtgttggagatggagatttggagtggatgtccctttttacagacctagattagctatgataatgaggtagcagtcagcagtgaactcaacttgcctgctttgcaggagtattcgtcttcctccttttgaaacttgaaaagtgaaaaaactataatttctgaggaattctcgtgttccacagttaggcaattcataaatgtcatgtatgctagtatacacccttaaacagtgtactcaccccgtttcataacttttgacgttttagataagactgagaatcaataaattttaaactatttagattgaaaacactataacacgatgtatatattaatcttacaacttattttttatatgttataatagaaaaatcatagtcgaagataattttttaagaccgtgtcattttctaaaatattaagaattatagaaccgtatggtacatttatgtttaccaagcagtgataaggtatttatgtattttacaactttgatctctgaatatttgcgtgtaggagatggggatttgtggtggacgtccctttttactgacctatattagctatgataattacgtatagtaagcagtaaactcaacttgtctgctttatagtaatgttcgttgtcctccctttgaaacttgaaaactgaaaaccatgaaatttctgcgaaattcttgtgctctagttaggcactcatc

SEQ ID NO: 74676 - DNA, 600 bp, Oryza sativa
catacacagagcgcatacaacccttagaaatgtccaaatcaaatttacctaagaccttaattccttatggatgttctgtccattcaaaacagctggagcaatcatatgatgttttaaggttgcaaaattttgtttgccaactgatcatgtgggtaatatagcatgtacctatgaaatgctagcatagactagtactctttccatgcaaagaggtatagcattgttgaaaatgtcctctaaaatgtgctaattttgttcaccatatggtcatgccatttgatatatactgttgaatgttttaatatgagataacttccgttgtctttgattaaacatcagctgccattgtggtcagttctattccttagttccattagtgtttcttgacatattaaccacacaacaatgacatattatctattatatgagtatagtgtttcagaaaattatattagtttgtggacttggtctgcaatgcaggctgatgtttgatgaaatgatctatgatatgttatcctccaattattctttgaagtttggttgtgataaaatgaatctttatttcatgtcatgaattcctatcaagtgaagttcaatttt

SEQ ID NO: 74677 - DNA, 5839 bp, Oryza sativa
ggcagtggcacagctatgctcagagcggtcgcgagatggggagagatggagatttgcctcgtgggtggcggccggcgggggagcccgcgcgctgctcctccgccgccgcgtcgcccgtcgccaacgccttgcgggtgccatggaggtgggctgcttgcgcgcggcgtccggcaggaggagcaggagcacggcagcgaccaccaccacgcggcggcgacggcggaggtggggccaggaggtggctagcgcagcggcgatgggtgcggaggtggacaagccgacattattcccgatgacaaggcagacaagctatcgctgccgaggttagaatggagtttcgcctggcggccaccgtgccgtcgccggtgctcacgggcgcgtccgactccatcgacagcctcgacttcgaccccaccggccaccacatcgccatcggcggcatcgcccgaaagatccggatttacagggtcgccgagccatctagccccgtcggctgcatctacatcccggcaaagctgagtagcgtgcggtggcggccggggcggcggcgaggtagtggcgcacgtgggttgcagcgactaagacggcgtcgtgacggagtacgatgtggagcgcggcgtgccggtgtgggagcgcgacgagcacgaggggcggcaggtgtgggcgacggcgcgacatcgtcccgtcctcttcgcgctcccccctagctaccgccgcagccgccatacccttctccccccgggctccggccgccgtcgcgctgccgccgccctcctctctcccgcctcgcctgccgacctctgcaccgccgctttgcctcgccgagaagccgcccagaaagagggaaggtgatgatgtggcttcctgacatgtggggcccacgtgggtcccacgctgactcagcagccacgtaggacaaaaccggggtcaaaaccacctaaggacgtcgggtgaacggttttgtatagttaagggacctcgcgtatctggttttgcggttcgaggacgttttttatcccgatgacaagtcgagggaccttcggtgtacttttcccctgctttgtgctgttgatttggcccaactggggcccactcttggctaggttttttctgcttttttaacatatctgtattaataactataaatattcgacatttaggacaagattaaattaatattttaaaactttaaacactaataacttgtcaaatgcttttgttttttcaaaaaaggtatgcatacttttgctttcaacttattcaatttattctaatataaaatttatggtaaaaaaaattaatagttagactgaatcttgtcttcaaatataaaatatttatgaccggatgaagtaattgataacttttctctcatttatttatatgaatttagatgaccgtgtgtgttgtgactgatgtaaaaaacctgtagtaccagatgaccttttttttttttttgaaagtaggctaaaggattgcctagctcattaataaaggagagaagtttatagaagttatttacagaaatgttccaggtaaccaaagaaatggcaacacacgcttgaattacaaattgtcatatagtcaccaatccatggatatgcttgggcaagcacaatctgtgatacagttcacatttgagaaaacatatgctctgaatatagcacatcatccttttgctaccagtcaactaacatgggctgttaatactttggtagctagctgtttacagaaatgttcagtgtaagtgtgtaacaaaaaaaaaaacaagaagaaacgatacacgcttcaattacacattgtcatatatagtcaccaaaccaatgcatatactcatattcagtgatattgttcacatatgagatatcagataacatatggtctgaacatagcatcaatttttttgctagtattcaccagtcaaccgatgctttggttttcaatccaatggtatcgtgattcttcccctcttctagccagcagcctcgaggccaggttcgccgggttcagtaatggcaagctcgggcccgccggatcaacgacggcgagctaccacggcggcggagacggctctgttcccaaccttgacgcctcttgctcgcccatccggtgtcgcaatgacatgatactccgttgagaatcatgatttcctccggacaattacatgcatgactggatcatctgcatagacctatacgcatacatggcaccatgagacagattacaaagtgtcctcaaacaagattgtcgagtcaccaggattgttattattattatttttttttgtgcttgatcttcagtaggaacaagaagggggaacggagaaccaactgaccgtgcagatcagcagatggtacatggaggattccttctcggctctgttaatagtatataaagatatgaactgtttttccgttgcaagttggatgggaaccacttttgtcttggaagcaagtacctggggaaagtatgcatcagattgcaacaactgttctgtagattgaactgaaggaaagcagatttagctaatgcaaagatctccaaaatatgcaggatgtaaaacgttttctagaggagatttctacctggcgatcgattgcgaggggcgatcagactcggatcccctccctccacctagtttccttttttggcatcgtattactttcctattttagtaaatttatacacctaaagtttacacatataaagtttagagacccaaagtttataaatcaaaagtttatatatccgactcaaatttgaatttgaattcaaatattttttatatatagtatttctatacatataaagtttatacacctaaagtttatagacccaaagtttataagtcaaaagtttatatactcgattcaaatttgaatttgaaatatatccgatttaaatttgaatttaaattcaaatatttttttatatataatatttctatacatctaaagtttatacacctaaaatttatagactcaaagcttataagtcaaaagtttatatacccgattcaaatttgaatttgaattcaaatattagtttatagacccaaagtttataagtcaaaagtttacatacccgttttaattttaaatttgaattcataaggtgtagtaggaagagaagaacaggagaagcaagggggaaaaggagggagtgatgtagcatatagggaaggggcgggcgggtgatcgttcctagccttacccttttctagatggtaaactctgcaggattgtactgagccgacgccagtatatttggataagcagataatgctcggcagtcagtacaagatggaggggttgataccccagaataaattctttttccctaacataaattgggtgatagtataagtgatcaagagcccatgaaaaaataaccacgtcagtatcctgtccaatatgttttaccttaactggtattttttctttcgcgaacgctccttactggttctgaatatactaacctttttcaatgtgaggttagttctttttccattccgttaccttggcattcctgtataccatagaagacttcgtaattcagagtggaaggaagtgattaaacggcttgataaacggttggcaagttggaaaggcaaatttttatcacttatagggcgactaacactaatcaattcagtgcttactagcctaccaatgtatatgatgtcctttttggaaatacctaaaggagtgatcaacaagattgattatttccgatcaaggttcttttggcaaggggatggacacaaaaggaaatatagactagcaaggtaggacatcatatgtcatcctaaagaccaagggggttgggaattcaaaatcttgaaattaagaacacaactttctttagcaactggttgtataaactactcactacaaatgctaaggaacaaatatttggggtcacagcctttgtctcaagctcagtggaaagcaggagactcacactttttgtcacgccccggactagccccgaacggaactagctcgtgacgctccaaattaacctgttgaccgataccagtcccaggaaacagtgctggtatcacaggaagacagaatatcacagcaacagaggtctctttattatagagtaggattacagtcatgttgggctgcggacagatcccgagctcacaactgcattacaaaaggaaagcggaagccagggattggaccaatcatcacaggcgcgacttgggaactaggccgaaacccttaaaactcatcgaagccgacttgctcctggaagaactcctcgtcagcaggatccacttcatcttcttcagcaactggggggggattatttatatagagcaagggtgagtacaggagtactcagcaagccaggggaaataagtatttaatacaggcttcaaggaaaggctgttgttttcgtaattgattttgtttgaactcttttctaaaaagactaagtgagtgcttctcaaacgacacggatgagacagtgcgtctcgtccggtcggagtatgtgcaatgtatcaatctttagatcttgaaccagggttggcatccggccaacagcttttcaaacggccacccgggccaacaacttttcaaacggccacccgggccaacaacttttcaaacggccacccgggcctagctgaccccatcagctgcagatttttcaaacatcgaactccttttcacaacagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcatccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctcttggcatcaaggctcccctgataagctagttactcagccaggggtgtcccattccacccatgtggtcatacttgtcttatgtttggatgaaattccaaggattcggtccttaagtgcgagagcgggaaaccgtactcccggtacgttccccggtccgcggttttgaaaattcatttagttcgcaagcaccgacccaggtgtcgggttttccaagtcttttgtaaaactccagttttacccaagttgttactcagattttaagtttgaaggcgaccgtcgatactcgcacggagtgcacgaatatcgaggtgcagctgggtggttacaaggggacatagcatggcaattaacaatggaaggatcaaatgcaacaagttaggtaagtccgccaatctgtcttgcagatgggataaaagatttagtgcgatcctatcaatgcataatattttgcaggcaatataattaaatttcaaatataggctcaagatgttcaaaggtggcttgccttgctcgagatccggagcttgatcctcgaaatcctcgcactgcgggtcttcgggctccgaaactacacgcaaaacgggacaactcaacaaacagtgaagataaggccctattattgacctctaagcgtgccattaggtagatctcgggatttgaggaatttaggaagttgaacggagtcaaacggatgctcggttgaaaagatatggaatttctaagattattggatttttggtctaaaggaaaaaggatttaatcctttttgaaaaagaaaagaaaagaaagaacagagggatggaaat

SEQ ID NO: 74678 - DNA, 11070 bp, Oryza sativa
aaccaatatggtgggttttttctgtcacattcctttagccattgagcctcaccaaattgatcttgagcaagccttgtttattgtgaaaatgctctactcaggccgaccggtgcggggggagccggatcagacgctccccccgcgcaccctacccccacgtgcgcatctgctagactcacatatttctcccttcccttttacacaaaagatgtttcatctagtatatttacaacattatttataaatctaatgttgcagtgaattaaaatattcttttgcaacaaaaaacccatatattttggaaactctctattaagggaatttggtttattttttgttccatcaaaaatgtttcacctagtgtacttacaatgtttcactatatatagatctaatgttgcaatgaacgaaacattccattgcaataaaaaacccacatattttggaaaccccctattaagggaatttggtttattttttgttccaccgagaaatgtttcacatagtgtactcacaatgtttcactatgtatagatctaatgttgcagtgaactgaaatattctttcgctatttgttgaaacattgttttaatatagggtgaaacaacacccgatttaaacgagtgaaacattttcgatctacttagtgaaacaattccgatatacctggtggaatatcgtgcaatatttaaaaataattcaataataagctaattttttttcatcggaatatatccatgtgtggtcttattttgaagatttaattgcaacgaatttaatggtacaatcggatcatgatttggataagtaatttaagagataaatcagtttaaattaattttgcacgtaaatcgagcgctaacgtcatgctgacgtcagcgcccgattttacccctccggatcgggcgcccgaccgggagtcatcatctcctgtttgtttattggcttcaactttggataatatggcaatatacattggctttattccgttactcatatttgcttgtaatttaagtgattcaaattgagattgacccaaccttgtttgttggttgtcatggattacattggtctttcttttgtccaatacatggaaaatacatatgcactatagattgggggcctcaccaaattgagttttgagtgaatcatgtttgtgagctttcttataaagagattgcaatgatattttcttttcccaaaatgcagggatgagccggaggactcacatgcacactatatgcatgcatccgtgaatgtgtcctcaaacagtcaaacagatgaggagccatcgttaaatccataacctcactaaaattttattcaaaacaaactcacatggtaaaatattgggcttgtttttcaagcctggtaatggaaaagttgcctgatatatataggaataagttcactttgactcccttgaaagtgatccgaatctaatccgtgaccctcaaccgtaaaatcgtataggatgtctcccgaactattaaaatcgatgcaatttgactcccttggtggttttggaggacggttttgctgatgtggcgtctatgtggcggtgttgacctggtcttcatccaacatgatattgacgtggtacttatgtggtaatagaattaaaataatatgtgggacccatttatcatttaaaaataataattgtgggacccatgtggggcccacatgtcattatctatctcttttccttcttcgtcctccctctctctcttctctcggtctctctctgttctctttatctcccccttctcttcgtctaagcaccggcgaaggaggcggacttcgtctgagcaccggcgaaggaggcagacgaggggttgagggccgagctgttgcgggagattatcgaggactggggcatcatagcatgtaatttcatagaaagaataaaaaagatgcgaatattagggaatgacctaatatcaaataattagaaggaatgagacttcaaacccaggtcgtctagtccaccaccttatgaagctagccggaagacccctgtgtatttctcgtaatttcatagaaagaataattttccatatttcattgtcaagaaccgacgcaagaaattcagctcactccaaaaggggatataattcttcttgtgccgtaaatgtagatttctacagaatgaagggacaattacaggggatgaggaagagttagtccttacaggcatgcaagctagagtggtgctgatgagccccgtgatggggtcggtggcgagggcgagcacagcaggcaaggcgatggtgaggatgtccatgccaatctcatcaaccatgaaccacccgcgcccgagcacctcctttcctccgtccttcccctcgggcttgtcctcccgccgccaggtctccttctccttctcgtcgtctaccacgtcctccaccgccggcttcgcacggcaccgcgcaggcctccaccgaggaactacactatggcagtgatggtgggcgaaggggaaggagagatggttgagcgctggagaagtggttaggacaaacgcggcggcgacagacctcatcggccgcgaggtcgccgtcatgccacgcgagcgtgtgactgtggactgtggttgagcaccgccttctgcttggccgacgccgctccggccctcgcctgccaccgccgctgctgctccggccatcacccgccgccgccaccgctccgtctcccccctgctcgccgattgcgccacgagaaagaaggagagaagggagagagatggaggaagaagagagagagagggaggatgacatgtgggctccataatttattttatgtgtgaatcatagttttttttaattctaatgccacgttggatgaaagactaggtcaacattatcatgtcagcgtcacatcaacaaaaaccatcctctaaaacttcctttcacgtcctccgtctagcccctcgacctacggccagtccttttacgtgctactgcacagcgccggcggcacgggacgacgacgaccagtcgaccacgatgcggggatactgcaggtgctctcgcctctgacagcaacgggaacgtccacagcgggcagctcgcgccgcaacaggttgtcgatacgggtggcaaggaggaggaggatgcaggtgacagcggtggcagggagggattgcgtgaagcggatcatgggactccccgacgcgtccccgtcgaggagcgggccaaggtgctcaaccccctacagcgtgacgacagtacgcttaccgtgtcggactaaatcagaaacaccatttttttcacttcatatgtggattttaattgagctatatatgtgcagttcgtgagttctcatctgaaaatattttctggaagttcttgcatttgttcatcacaccagttcagccggcgtgtgtgatttgtttctctagtttttgcgttttttcttcacagcagttcagccctctccgtgctcgccaaagccaaggactcctccacgatcgcgctccaggggttgctgcctggaacgttcgtgccggtttcctattgtagcacaaagaagtggagttcacactactacgaaatcggtttttccatgacggggaaaatcaatttttacaagcgaaaagacgagccaccagcaaccaaaggccagagcgggcctcatccacttgtgaaaattgaatttcgcaggtggcgtattaagaaatctgctagcaaaaatcgaattttgcaggcgtcgtcctaagaaatccgccagcaaaaatggatttttttttgctgacggcacctttaggtcaaccgcgagtgaagagatttttcaaaaaaaaaatccacatattcatcatgattttcaaaacaaaaacacctcaacatcattttgaaaaaaaaaaaactcatcaacatctagattcccattaacatattcatcaatagatcagcggattcacatcaacaaattcaacaaatcaacagattcacatcaacaaattaacatcaacaaatccattacagtgaagcaaatcgattttcacagcatgcatctcgtcgccatccaccgtcgaggggcaccagcactagatctggcggacacaaagtcatcctgccggtgcagtcgccgtcgagccgaagagaggcggagggaggtgggaggccggaggcgcagagaggagagagccgcgcgccatcgctaccgagccccttgctgccaccacgcaccgtcatcactgagccccgccacgtgccatccaccaccgccaagctctgtcaccgtcgatccccttgccgctgccgagccccctcccctgcgctgccgctgacggtaaagcgggttggacgtgagctccatagcccgcccacagcctcgcctgctgccgcgagcctccccgcccccagtttcgcccgccggcgcgagcctccacgcctccgtacctccccgccgccagatccgccacgtgcgagccttcccgcagcctcgcctgacttctgctggcccgcccaccgtcgcgagcctccatgccacccacgtgccttcgcgccaccggatcgccacgcgtgagcctcctcgccgcctgatccgccgccgcagctccacttgccgccgccgccaaccacgattgagggagaggtgggagtggaggggagaggagaaatggatctaagagagaggttgagggagagatgcggtggagagatggatccggggcatatttatcctcccactaacagtttttttaaaaaaggcctcccacttggacttagtccccacgcccccacgatcttttttacggcggctgttcttataccccgccattaaaaatagagatattttcgctggtggttgtttaaatgggccgctagcgaaaatagctatatttttgctagcggtccacttaacctggccaccagcgaagatccatttttgctggcggtccgtagccaccgatcccccgttatattttcgttggcggtttcgacgtataaccgacagagaaaaaaaatgggtgatgccataaaaaattgattttgtagtagtagcgagcgaacctaagaatagatgaggaagaagaaaaaaaagggaagtttgagattgacaggtgggacccacgctgattccgtttttaaaacccagacatcaaggatgaggggtcaaaagtgaacttattcctcgacctgatcccactagagtccgtccagcctattgaatttcaactcgtttgttcaagtctcaaaaagaaggaaccatcttgtggcccaactcgtggaggatatattagtcgaaatcatatgcgtctcttcgtcccgcccacgccgccaacacacacgacaaccgcttccttggcacgcatccccccgctccccaagatccccatcttctccagcgatgccgaagccgaacccccgcaccgcctcttcctctgccgccgccgccgcgtcctccccggacaccgtacgcaaggagcgcgaggagaacacggtgcccgccgtgtacgacgccagcgccgacatcgaagatgactaccgcttgttcttggagaacttgcttgtctacgagaacgaggactttgtgctggagtacgagggcaaggtggtcaggtatggaggagacgaagccgtttctgctggtggtggcagtagaggggaggatccggtgatggagaaggagaaagagaaggagaaggaggtggacgttgtggtgatctcctcctcctctgacgacgagtctaccaagattatttcggagcctaatccgcttgacagaggcgtgtttcagtgaaaggttaatacatcgttccacttcaccaatctcttttttttttctttggttagttttgctgcatttctaacacaaattagtgttgttggcagatgaaaaaggtagtggacaaggaaaagatggatgagaagaatgaggctgctgcccctcttgttaaggggaaaggtgttggaaaggttagttctcatgaccccggttgtgcttgtttcaaagggctgatgtgagatgtggaagagaaacatgtgtgatgtgtatgccgtgtgcgcgtgcaggtgatcggaatggaagtagaagatgagcagcttgtgctggctttgccgaaaccgggcacgacgactagcttgacaaacccaagcaaacgccatgaaaccgagcctcatactacttctgtgagaatttcttgcacatgctgcttttacctgttcatgttgttgtcgattagaataaggatcgacatctgtcacatgtggttgttattggtgcctagtgtcgtagatatgtcaaatctgctttgtagttctttcagctcgtctaaagggtgtaaatgtctaggattcctatttggcgcggcacagagtccagtagtccggaggcagaggagttcgatttctctcttcttgttccttcgctcactcattcccttatctttcctccattcccgatcgacaactttgatagagctgctaatcgtcgcccattgatcttccggccacaatcctcatccctgtcgctgtctacgttcccagctgccctctattccccaatccccctctccatccgcgtgccctagctcctcaaccatagccatggggactccactatcaatgccgccgccatgcgtcgcagaggagtagcagtagcaggcaccaacgacatggtcatagctgcggtcgtgaccgggaagatggcgaccttgaggaagaagagcaattttgactatgacatgaaagttttatggatttttcaattgaaagttttgtggtttttcgatgaaagtattcattttatcgcaagtttttgtgatttttgagatgaaagttcctgattcgaactgaaagttttgtgattttgagatgaatgttttcatatcattgaaaagaatggtttttgattttcaagatcaaagtttgaggaagactataagttacagttaaatcattggtgcaagaagcggcagatgtcgaatgaagcaaaagcaaaaccagcagctaggagagcaggcatggctgtgcgcaacttccgttgctagcgcagctgcgccaactagcaacccccttcaatgttttctacaggatgactaaaaataatatctgaatccacgctagttgtaaagaaatggaaattgttataacattgttaaagatagaaacactttggctatgtttggataatgggtttgggatataatttcccactcctcaaagagtaagtttcaattctagccatccattcttctcactccatttcattctatccctccattcatttctatttcccaatcccacctctcctaacccattatccaaacatatcctttcaccattggtcatctactttgggcatgcgtaatcaaactttgccttacttgtccatgcaattccttgtaaacaagatagtggaatagcttgcacttgaaaactagtaaactattttccattatgaatttcgattgtttttagttaatacagatcacgtcccattcctttcccctctaccactcatttctctccaccaccttatccatatcctctccaccatccttctctctctcatgcatccttctctctctcacgcgaagctcagaggaggagtggctggggtaggggcagcggcggcggtggctctaacgagctgcggcatcggtggcggctccgaggaggagcggcgtcggcggcggctcgagcggaggggaggtgcatctgcggtggcgcgggtggaggaaatgtgcgtctgcggcggcataggcagaggggaggggcgtcggtgtggagattatggatatcccatatctacatggcgacgatatttggactggatataggataccgaatatatatagaatatcttatttgtatctcgggtttgtttcttaacttgtacatcaaggaaacaccttgagacttagtcggttacgactgtattttacctgtatttgtatattccgttagggatatagattatcttttgtaacccggactccttcctatatataaggggggtccgggcgcctctaggggcagagatgttgattttctccaaatcatacaatcaataacacactcggcggattcatccccggacaggagtagggtattacttcttttataagaaggcctgaacctgtataaatcctttgtctccaaacccatacactttcctagcttgatagccaccccttttattattgccgaaatctagtttcgacagttggcgcgccaggtaggggtagcgtcaagcttttcgccgatcagtgcaatgggtttcgtctccggcatcgacgacctcgtcttcccacccgggcagacgtttcggttcggcagcctcgacttcgtcaccaacaacttcggcaagatctctctccttgactcggtgtcagaccagtcgggagagaaccggatttcagtcccgtttggactcccaaacgcggctgaaagctacttcaagaccatctcaatcgagtcggcttcaaaccactcgggcgagatcgcatcttctccaacgacaccagatcaagatgatggggcttacccaccagtcctgatgaagctccccgacgatttagcggccgtctccaccacgacagcgtcttcatcccgtaggcctaggcggaagtcgacttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggaccgcgaaggaggctgaggatcgacgtcagcgagctttgaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcagtccgaccacgtcgtcaacatcttgaaccagacgaagaccatgattgcggcttcggtcccagttaactccgaaagcgtccacacgccgactggtagccgagtcccccacttccgatctcatgactaccgtcatccaagcctcagcatcaccggcgcaggatctaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgatctgcgtcgagtggattggccagccggcttcaagccgactggaatagagaagtacgacggtaccactaatccagaatcgtggcttaccgtctacggtctcgcaatccgcgcagcaggaggagacaacaaggccatggcgaactatttaccagtggccttagcagattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccggcgattttctgaacaacgcaacaagatctccgacatcaccgacgacgttatcatcgccgcgttcaccaaagggattcgccacgaagaattggtcggcaagttcgggcgcaagcctcccaggacagtcaagctcatgtttgaaaaagccaacgagtacgccaaagctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcaaggaagaaggacgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgatggtcagagattgcaattaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagttaaaaccaagcaatgctccttttcacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaagtgcccgctaccaagatttcaaagagtggag

SEQ ID NO: 74679 - DNA, 740 bp, Oryza sativa
ctccctatccaaacctttgcaacagatggctgacaatgagaaaggcaataaggtcagaagtcaggacattggtacctcaagctctcgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcgttgtggagaaatcggtcatgttgccagctcgtgtgcctctacatgcgttcattgtgaggaagaccatccacccgataggtgtccaacgagcaggatcactt

SEQ ID NO: 74680 - DNA, 3627 bp, Oryza sativa
tcctgcacccccttgggcgagccgctgccctcgtacttctggattgccttgcacccggacagcagctccagcagcacgacgccgaagctgtacacgtcgctcttgtccgtcaggtgctgcagcctgtagtactccgggtccatgtaccccaccgtccccgccgtcacgcaccgctcctcgtcgtctccgtcgccggcattgcctccgtcgccggcggcggcattgtcaccgtccagggtgttgaggagggagaggccgaagtcggagaccttggcggtccagcaggagtcgaggaggatgttggaggacttgatgtcgcggtggatgatgggcgggacggcgtaggtgtgcatgtactcgatgccgcgggcggcgccgagcgcgaggcggaggcgggacggccaggaggcgagcggcggggagagcggcgccgccgccgacgccgcacgcctgtggaggtggtcgtggagggtgccgttgggcatgaactcgtagacgaggatgcgctcgccgccgtcggcgcagaagccgaggaggcggaccaggttcttgtggttgacgcgggagaggagcgcgagctcggagacgaatgccgcctcgtggtcgacgcgccgcgccgcggcggcggaggaggaggaagggccccccgtgtcgcggcgctcggcgcgcttgatggcgacctcgcggccgtcggggagggacgcgcggtacaccgcgccgaagctgccggagccgatgcgcttcgccggcgagaagcagtcggtggcggcgcggagcgccaccagcgggaactgctcgaccgtcgtgttcgggcccttggagagcagcgcgctgagccgccgctccacgcgcggcgccgtgcccgtcggctcggcgtggatgcgcccggagaccggcgagctgctgccacggtgccggcgcaggtagtaaaccgccgcgagcgcggcgaggagcgccacgagcgccgatccagctccggcgctgatcaacgctatcgccagattgctcgggcgacgcttccccttcgattgagagctcgacgacgacgacgagttggacgtcggggacagcgccatcggaggaggggtgtagccgcaggggtaacaaacggacacgtctccgccgcctcccccgccgctgccggcgcagagctgcgcggagcccgaccagacgccgcacgagcacgacttcgacggcgcgcacggacccgggagcaccttgtcgaacaccttcctcaccccgcccgcgacgcctgcgccccagcactgcagcgagtagtcggacatgagcaccccgcacaccaccttccccttcgcctccagcgcgacgaactgctgccccgccagcgccggcggcggcgacgcctccccctcgggccagcacgagaccgtccagttcccccacagcacgcacgtgaccgcgtcgcccaccgccaccgtcgacaccgcgcggctgatcctcggcggcgacgcggccgccaccgccgccgcctccccccagcaacccaccaccccgccatcatccacgccgcacgcgtgcctctcgccggcggcgagcagcatgaacctcctccccgcgggctccctccccaccacctcccctccaccatagcacctcacctccccgctccccaccaccaacccgcacacgaacccgccacccaccgccaccgccgagaaccccaccctcgccggcgcgccctccccccacgggcacctccagcactgcatcctctccccgacgagcccgcacacggactccccgccgccggacaccgccgagagcacccgccccctgtacacccgcttcgacccatccccggcctcgttcagatcccaccaccgcatcgacattggcggcgacgacgtcggcgcagccgagcacaggtacccgtccccggcgaccaccgccgagtacggcgagcacgtcccgtccccgccatacgcgtacacgtgcggcgccgccgccgacctgttcgacacgctggcgcacgagatcctgtaccccgccgccgcgccccccgccgccggcacgagcccgcacgcgagatgctgcttggaggggttggagctggagttggagacggcggcgatggcgatggtggggagggggaaggaggaggaggcgaggaggaggggcggcgagaggaggagggctaggaggaggaggaggaggtgaggtggagacattgggttggaggagaggaggaggaggaggagtttgtggagacgaccattgttggcgcgagttggggaggaggaggaagaagatggagaaggggaaatgggggagggagggaaagggtggaggtttaaaggttggtgtctatgtttttctttctcctcttcatcactttttgttagatttttttttattttttttgttgttgtttgagaaaaagtaatgggaaagatttgggtgttttttgtttttcttctttttggctaacttggttgttgggtagtatggaaatatgaatgcactattggtatttctctctctctctcttgttgagtgattttttttttgagaactttgttgagtgatttgatgtgtgtcaatagcttgtcaagaggaaataggtggcttgttaattagttatggtgttgcattttggaggaccacgttgtgattagtaatgggattctttcttttttttcttttgtgcatatgaattttaagcaagctgtagtacatttcatcagaatcctctcttttgacatatagccactatcctttctgttgtgatgatagtacaatggtggttgtgacttagtgacaagtatcttccaatggggtcgcaatctatgttcgaagaaaaattctaggtccgccaccataatcggagatcttaatatgaactttttgttaagttcattttttttatgcacgatcttcacaaggtcatataagcagatgatcatttcttctgttgtatgattacaaaagggaaggatgaaattacttactgatattttccttctaatgtgtgaaagcaaaggtaatttctcatatggcattttgtgcaactcccacaatgtggccaggcctttcaaagtccagcgaagttggagaaaattattgaatcatcattgtgctcatctcactcagcagagaaaatggccaagaaactgtacttgttttcttttcttttttttcaggaagtgagatcatgggagaatactaggagcggtttccggatctagaaacacctcccctaatactttcattactcatcagaaaaatctattgtttccggatctagaaacacctcccctaacactttcattactcatcagaaaaatctatcttattgatagtggttattgtttaagtatcagatttggacgcaatcatcagagatcatcacatataaggtttcttctaggtcttctttgccttgccacaagcaagagtcccagctaagatccagattctccatccatggcatgtgtgctctgcagattgctgagacagccagctagtgactgaagagaaaaaacatttgattacaagtcaagatcatttctttaccctgcaagatggcaattaacaagccccaacactgcaattaaatacagtttaagtagctgtaatacttttctctctgtgggctcctgattccat

SEQ ID NO: 74681 - DNA, 1561 bp, Oryza sativa
aaagtgtttctatgaaggcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctacagaggtcagtttaaaatcacatgtaacagcgaagcctcagatttggcaggataatgattagacaataacaaatccagcagtaaagccatttgggaagacgtcaaagtatatcaagtaggataagttggctctcttgggaagcataattcaaaggtaaagttatcgacccttgcatcaaatagcagaagtagctatcacccggagaccagggaagctaatatgaggcagttggtggcgagttagaagcaaatgacaagcatggtatcttagtaatgacgagctgatctcgacacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggcaaaccctaaaatacgtacaagaaaaattcaaatgtggcccagagaatttttgttaaattctccttggtctaaaaggagccctcaaattttagtggaattttcagagcacgaataataattattaagaaataaacaaagttgaaaaggttttataaaaagaaaaatccctaaaagtcttcttttccccccccttcctctcttgggccggctcggcccaactctccctccctctctttcctctcccccgcggcccatcggcctcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataaagaggggggaatcattccccgcgattccctctctctttccccccgtttttccctctctctctccctcggattcgtccggattcactcccgcaaacctcgccggcgccatcaatggcggcgagatctccgcgccggttt

SEQ ID NO: 74682 - DNA, 808 bp, Oryza sativa
gtccgttagtgtgaaccgccgcccgtgcgcccggtccaccaaaccttagccgctgacgcaataatccttttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccgaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcagctagatattagatataattgcttagccctgcttagaaacattagcacacattcgggataactaatgattcactattatttcatgatggtttaatgatagttcacgatggtcaatcgtgattagttaattaattaatgtgccaactaaaacctggtaatggtgggttgtgagcacatggttttgttggtcgtgctcatgacaattaaggaccggttcacgagtttcggttgt

SEQ ID NO: 74683 - DNA, 4354 bp, Oryza sativa
caatgctccttttcacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaagtgcccgctaccaagatttcaaagagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccttttggggcatactgctacgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagttgactgggtgcatggcggcgctcagccgatttgtttcaagacttggtgagcgggggatgcccttctttaagctactgaagaaaacagatgatttccagtggggacccgaagcacagaaggccttcgaagatttcaagaaactcctcaccgagccacccgtcttagcttcaccacacccgcaggagccgttgttgctgtatgtatcagccacctcccaggttgtgagcacagtcttggtcgttgagcgcgaggaagaaggccatgtccaaaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagtaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctatgtgctttggatacatttttcggcgtcccacaacgtcgccgagtatgaggccctccttcatggactgcggattgcaatttccctagggataaagcgtctaatagttcgaggcgattcacagctggttgtcaaccaagttatgaaagagtggtcctaccttgacgacaatatgatggcatatcgacaagaggtacgcaagttggaagacaagttcgatggactcgagctcagtcacgttcttcgacacaacaatgaagccgccgacagacttgccaactttggatccaagcgtgaggcggcaccctctgatgttttcgtcgaacacctttatacgccgacagtacctcacaaagatactactcaagttgcgggcactcatgacgcagctatggttgaagtagactggcgagagcccctcatacgatttttgacttctcaagaactcccccaagacaaagatgaagccgagcggatttcaaggcggagcaaactttatgttttgcatgaagccgagttatacaagaaaagcccttcaggaattctgcaacgctgcgtatctttagaggaagggagacaattgctaaaagacatacattctgggatatgcggaaaccatgccgctgcacgcaccattgttggcaaagcttaccggcagggttttttctggcctactgcagtgtccgacgccgacaagattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgacaaattctccaagtggattgaagctaaaccggttgtcacaatcacagcagataatgcgcgagacttcttcatcaacattgtgcatagatttggagtgcccaatcggatcatcactgataatggcacacaattcactggcggagtttttaaagacttttgtgaggactttggaattaagatttgctatgcctcagtggcacaccccatgagcaatggacaggtggagcgagccaatggcatgatacttcaagggattaaagcgcgtgtctttgaccggctaaaaccctatgccggcaaatgggtgcaacagctgccatcagtactttggtctttgcgaactacacccagtcgggccacaggccagtcaccctttttccttgtctatggggcagaagcaatgttgccgagtgaagttgaatttgaatctctgcgctttcggaatttccgtgaagaacgctacgaagaggaccgagtggatgacttgcaccgtttggaagaagtccgcgaagcagctttgattcggtcggctcgatacttacaagggttgcggcgttatcataatcgcaatgttcgatcccgtgcctttctagtcggcgacctggttttgaggaaaattcaaactacacgagatcggcacaagttatctcctttatgggaggggccatttatcatctctgaagtcacccgaccaggttcctaccgactcaagcgcgaagacggtactctcgtcgacaactcttggaacattgaacaccttcgtcgtttctatgcttaagcttatcattgtatttccctatcttgactgtcaccatcaagttttcttcttgccgttgtcagtcgggggctatcatcataataatggagtgtgattttttatcaatttaatttgcttacttggtctatcattgccttgtttgattttttctacttagtctgcgaggattgaaagtttttaatagcttctttgggttttaggctcaacaaagcttgataaaagcttttaagaaatcaaagacttggttagaactatcaagcacagcataaatacaccagtattgtacaaattgagcctccatttgctacatttacactcagtcagaatcagtcctttcatcatcagagttattattgctcggctgaaggtcgttgttgcggaattgctctacaacatcacttacaatcttgtcagccgcactttgagcattactgataagatcaagagcagcttcttcgcttgtcccgtctgcaaagccatcaatggtatcaatttcaatcctcgggtacaaggatttggtcatcgccaatgccatactagctcccatacttccagcttttttgatattcttgaaatatacatccggtgcaactctcagcttgtcaaagatttcggttgcgtcaagtgcactcggaccactgttattaaggaacatagcttggacgagtggtgtagcgacattggcgacttcgtctcttgctcctt

SEQ ID NO: 74684 - DNA, 14613 bp, Oryza sativa
gccgccgccgccctccccaccaatggatccgccaccaccgagccccccgccgccgctgtcgtcgagcccgccgccgccgccgtcgtagagcctaccgccgccgccaccgtcgcccgagccatctaccgcgccgtcgccgagccccccaccgccgccgttgccgagcccaccgccgccgtcgccgagcccgccgccgtctcccgaggaagagcgcacgagcaaagcggcggtttcacgccgtcgctcgtcccaggtaggacgagttcgtccgccagttttggccggaccgattggtcccggatctgagaggaatattcctctgtagggaccaacctatcccactacccctgaaccaaacacccctaaaaatgggttcatcccatcccatcccatcccatcccagcaaccaaacactacctaggagagcaaaccacacaccattgaaccaagtggacaagtgttactttctaaatcctgatttcttgccaaagaaaccttctcctcacaaagtcaattttctttctaatccctttgggtattctataaaaagattacatgtacaggggtactacttaggcatgagtttattaaggtttttacaaaaggccattatttgaccttgtcaatgcaaccatcatggttatgaatcctttttaacaaccatgtttaaagcaatcaaaccacattattgacaggaaatgaatcaaccttattgctacatttagaatgagaattgatgtattacactaaatggaccttgagatcaatgagaaatgacaactatttcactattcactatctacatttctaacacgtcattagcacgcagctctaaccagctgagcaagaaaggtgaagaactcacaggtaactctaaggataagatggctcgacgttttctcattcctcttgacgtcggatcttctcttccttgcaaccttcgtgctcgctatctacgtcgcctcatgcagcagctcgacaagcttctccgggctcctttgcgccgtcctcgaagttgcaggggctgtggtgctagctttgctggccatggcccacggtatccttcctctggctttgccagatgtggaggatgacgccgcaacggcggcgtcgctgcccgcacaaccaccagagctggtagcattgtctccagcaccctcacgacagtgatgctcgacacctgcaatgcactagaatgcattctggtggagtcgccgcgccacttcaagtcccatggatggacggcaagggtgcggttgtagcccgattggccgccgcaagaggtgccagatgtggtgacgttgtactgtccttagcacggatggacgagctacactcgttgcgccatatcaccatcaccttcgccggagcactcaccggcgacgccgctgtatggtccaccaccggctgaaccgccgcggagcgccgcccttctacatggcagcaggtggctctagcaaacgtgcagcccctccaccggcccctccgttccctggcctctcgaccgcaaccgcggcggcaaacgcgcgccccggcctctaccgcatcatcatgcccaggcatgtccctgccgagttgagcggcggcgacaaggccagctgtcccccgcccttgagtgagggggaggcctgagcatggggagggatgaggtccaggaggtcagggcagaccggcggcggcgtcggtggcaacccaacacggcggcggctgcgggcggtgacaatgaccagacgacagaccgtagtgtgctgccggcgataccatgctacaggctacaggctacggctgctcgctagggttggtctctatctccctctccctctccgagacaccgtgcctgccgccggcgacttgacgagtccgaccactggcgtcagttgcgccgcctgagcgggctgaggcccagctaggtagttaacagcccatccgcccttcgctgctcactaggaccgtgtaattaggctaaggccacatttagcataactttacatatccacgataaatttaaagtttatatggatttaaaattttaaatatttaaagtttatatggatttaaaattctaaatttaactaaaatggaaataaaataatttatattagtattgttaacgtaacagtaggtctatatccataaatttgtgggagctaggaatatccaacttcaaatatttatgtatctagagctttgtcgaagaggatttaaggtgtgtttgaatcactcgtttttgatccatacgttttctaagttagtaaatgtgcaatttttttttgaaaaatatagaaaaattatcttttaaaaaaataatattaacctattttttaaatttacaataattaatacttcaattaatcatactcaaggtacaaaagtgaactttttgcactgtgtaattaggctaactttataattggatccgttcattccaatctggcccggccttgaggcccatgaagcccacgaacgtattcattgtcatcgcctcattggcaagctatccatctcccaaagcgagatgcccatgccggagtaccaaaattccccagtagcagccgccgccgccgccgccgccgattcaccaacccttctcctccatcggcatgtcgcgggggggaggccggctgcccccgcgcttctctctacccagctgtacctgtacctgtacgccccccacaatcccagtcgcctcgcttccttcacattttctgggtgccaagctgctacgattagtttttgctgtgctctgtttttttttttctctctcaatgattcaatgtatgcgggaatacatcagtcatggttgaatttatggtgaaattaatggggttttgaactatttggttcgtctaatcgtccgtaggaccaagtaatttggtagaacaaatggaatctttttagagcatccccaagaacgcccgatcctgcacattactgtagagacgcgtctaattaagtggccaacttacttacggagtacatctcgatctcgatgaaagaggttgccaagttattctgtgaatattaattttgtgtattttctgttcttttcctttccaatagaaaaaaggaggtgtttttttatagatgtgaaatatgctggtaagaacatatgtacactctttcagtataagaacatataagaagtagccaaggattatttgattccaaatttccaattgcaggatcatgtggttgtagaggagataatattacttcatgatcaaacatatttaaagtcatctatttcagtaagaaaatgtttgactcaaacagattcagaggctcagagctcattgtatcataatctttcatacgtatgtaaacattatttgttgcaggcaggcatgagtgccctgaataacatgactcatatcatgctttaagcctttaacacgaagccctatatcgaagaagtatcagtctaaagaatgctattgcttcaaattacaatctgttgtttattaacaggaatgcttctatcatgcgagtgaactgatataggacgaagggtcaggaggcgttgggatttgtactgctccatcaagcatctgcatcaccttatgcattgttggccgcatcgatggctcctcctggaggcaccacagtgccacagcaacgaagcgctccaccttttttatgttgaagattgcctcgtcatcgctcgccaccagcaagtcaatcctcccacacctgtagcaatcatttgcccaataagttagtattgtctgctcctcatctgcaacttctaattccacattcttcctgcagcacacaagctcaagcaggatcactccaaagctataaacgtcgaccttagaagtaatccctatgttcttgaaccactcaggtgcaacatatcctcgagtaccccgaatgccggtgtttgtttgtgtctgattcaccggaagaagctttgctagaccaaaatctgaaatctttgctacaaaattatcatcgagaaggatattctgtggtttcatatcgcagtggatgatttgtttattacactcctcatgtaggtagaacagtcctcgtgaaaccccaagtgctacttgaacacggaggctccaatgcggatgactatcgttgaagaggaatgtattgagtgagccattgctcatgaactcatacactagcagcttttcagttccctcattgcaaaaaccaagcagtctaactaagttcctgtgaaacgtctgcccaatggtttggacttccaccaagaactccttttgtgcttcctgctgaagcttttcgattttcttgactgcgatgttagttccacactcatcttgcagctgtcctttgtagacaatacctgaggctcctgtaccaagtacctcatggaaaccaccggttgccttttccagctctctgtaagtgaaaatctttgaaggtaatccagaattactgggtagttgcgataactgggttttcttcctcgaggtgatactacaataagtaccaaaaagcagaacaaagattaggagaaagttcaccaatacagagcttccaaaaaacaatgagctcccaagaatccaatactttttgtccttcttccatttgctggagccgctgctgatcatggatggtgaattggtgctcctaggcaccttaagaagaactgtcgcctgtaaactggaatccatattcccatttgataaagggagcttctttttataacaagtgtttgagggtttattgaacacggcaacggagcagaagcaatcaatgacgcacagccttcggcattcggtctcatctatcgggctgtactgctcatagtcagatagaggccaattaatgcgatcaattggtgtcatctcatactgcaccattgctgctgtctcatctagatcacagctttgtggctcaaaatctggcctgcaacctttgtatgtcctctcattgtcgaagaacttgtacctctgtgggcatagacaatttgttgtgttcttggtgccatcaaaggtacagtaactgttgaagccgcatgcaccactgcctacctttgtttgaattgtctggcagatgttctccggaagtgcatccaccgctctccattgctcttgccataagctcctggcctgtttgctctttgggtaaatatattgccggaacacaccatctgtatcaagggttgcacggtggaagaaatcacccatagagtccactcctgcagaagtgatgtttatctgtgaaccattagtcagcgtgaagtatatccttccagtttcattgaacaccagctgtgagccattccccactgtgttactggcccagtatggatcatggtagtatgcagaaggtacagcaactagatacagcacaagattaccgtcatcttgaacatttagttgaaaccggccattggaatagtctgtggcgaggagacggctgtggagtgctgtccctagtgggagcacttgtgtgggtaggatggtatcagaagggtcaccaaaggactcccactttgttgcgccatcagtgcctaaaagcctgaaattaccggtgtcgagcattctagcatagcccacatcagtgactcgtggattccatacctcgttgccagatggatcgcgaagagagagtgctccatcagcgagcttgaggatagagccagcttggacttgtatcggtattgtatcatcttgcctattggagctagtcttggcataccagatgacggtcttgtcagcgatcttgttgaaccagacagcgagcaggtatgaggaggagtttccatctaccgccagaaaaccgaatgcaaaatcagcagtgggcgagatccatgagttgtttatcccctggggtgtcaaagaggagcctatgctgatgtttagctgagcttgggcagatttggtgcagtatagtagcaagagttgcaggatgggcaagaacaggagaggtgccattgctattgatcaaccttttgctcgtactagatgacaacaaaacttatagcccttggagagcggcatttgttagtcttgatcacttccatacttgactaaccaaaagtttctctgcgaggcaaccggttgaacctgtcaaatgcaattacaaagctgtcaatatgatagacataagagggagattggttcacatttccttatcaaaactatagaaaatgtcggctttgaatgcattgaccacctgtatggagagagaaagaaagacgtgttcagaagtctttagagaaagaaatacgtgttcagaagtctttctatgtgtttctttcctcctgaggttggtctttccaaccgcgtttcagaagaacagttttggccagcttgtatggttatggtcaagccaggtgtaatcttttcatggtaatataggagtacactgtaacattaattgatcaggttttttgacgcagtcagaacctgctttgctgatcgtaaggccattcctactgtgagattcattttgaggtttccaaaagtcacctaatctagataagctcggataggattaaacatatagacctccaaattacagtttcacatagatgattttgtttccttccttctattcataaattttttgacaatgtcccatgtggcatttaatttaatcagaataaaacctcttatgaaacctgcactaaaaatggcctaatatatgttttagccatttctaccacgcaaagtcagtgctccattcaaggggagctaggacacattgactaatgatgtctgtctgtatttaatttaatcagaatgaaactcttatgaaaccatggtagcaacatatattttgaacatttaactggtcaattggaatcagtacttcctgagtcctttccaagcttgcgttgcagaagtcttcaagtcccccaggtccacgttaggtcaagacggtttagtccctagccattctagtcttaaaacaatttagtccctcgtcagttcgaaaaaccctatttgccaccctgcgaaagaaatctaagtcaccacaccttgttctccatcctcgcagccacccaagcacactgtatgtttgtgacaggcttgaagaagacggcagcatggctatcttcttcgtttttctcctccaccccttccctctcaatgacttagggatccttggatccgaagtctctggcgccagccacagttccaatgcagtgtcgaggaggacggttgtgactttgacattggtgcggcaaggtatcatcaatcatggttttggcattactgacaactccgactttagccatggctctggcatctctggtgtgtttgtgacaaggccatgtcggtcatggctctagcatatccggcgacgataaggcattccggcatggcacggtagagatatcctctccctgtcatttgctgcattgtcatccgagcacgacagtagcaggttgcaaaggcattgcctagcttcttgtgcgatagacaaaggatatgggggcacccagatctcaccaagaacggtatgacttcgccgacaaaagttgcgctggtagctaatggcagtgcaacaagggcgtcatgccttgatctagccttgactgccatcaccttgtagctaatcctcatgacagcattttcatcaatagttaagggcttccacaccaacttgtagagcaatgtcattttagctataatttatggtattatctacaccctcatatcattcattcttcatggatcatacggattgcggaaatgtgtattggcttgactgcaacacaataattgtatggtagcatgtctagagaagattgcagactgtcacaccctgaagttttctctttttctagccttaattcaattaataaattgcctcaagaaataattcaatttaacctcgagctaaacccaaattaataaatgcaattaataattggaaatagcatggtgggatttttcttgagttccccatgtttaaatacattaagaggattattagtggaattttctgagcaaagaaaataattttaataattaaaatcaattattgaaattaaattaaaagttaacctccttttatctctcttttcggctgtgggccattttcagcccactcctccgcgcacacgctctctcctttgggtcggcccgtagccacagcccagctacagccgccgcgccccatctctccctaggtgtaaacatccctccttccaaaaccgcgtagctagcctatcccacttatacataccactccacttacacttttcattctcacatcgtgtaaaagggttatctcgagagtgatatggttgaagggacaagcccttataagttagttccactcttgctaaactagcaaggtggtactaaacatacgtatacaatgctcatgggccacacatgcctcatcctaattgggccaggatgttacatacacccccccaaggacctgatgccccgttgacacaacttacccagatagccacacatgcacattgggaaatgtccaggaacacactccccccttagcacacgtccagtgtccacatgctccatgcgccatatgcttgcacactgacccgtacatgcaacggcgagggtcagctctgataccatttagaacaaccctccctccaaaaccgtgtagcccagcccaactgacgggcaggcccacttacacatactatccaacttaaactttcatccccgtttcgtgtaaaagggttaacccaggagtgatatggttggaaggacaagcccttataagttggttccactcttgctaaactagcaaggtggtactaaacgagcgcacacaacactcataggtcacaaaggtctcatcctaattgggccaggatatcacactgggtcgccgtcaggtaggaccactgttgggcccatcttcaaccttcgcaggcaaagccagagggcgtaaccgccgccccgtgcgccccgtccacctcgcggcgcccactttgcacatgtcgccctcttccacgcccccgcaccccactctccccacgcttcgtgcttgtggagggcgtggtattcgattttcgaatcccggccacatctctctctctcctctcccacatccgctacaaaatccaccccctaccggccaagtctgagctcccaccgctatataaacgatcctcgtgatcccctcctccctttccctcttctgccgctcgttcccgtctttctcgaagtggttgtagaggttcaagtagcgcggagcaaggcaagccatgcatccctcattgaacatattatacctatattgcaaatgtctcgctttcttattttataatgtcagaattatccgttataacataagggtatatggttttattttaaattttaaattgaaaaggttaaaaaaaataataagaaactaaccactccagcttgtgtggcaacttgagagaagaggattgagattttagacatcaattctagaaattgatggtcagattaacatgggaatttgatttttagtcccaatcttttgtttgttagaggtggtaaaatttcattgagaatttagttagagactagataaatcttaaatgaaaatagatggttaagttttgtttaggtaaattaaaagaggaatttcctccgaattaccacccatgcccacgtatattttgaaacagtaaatttttaatggcatgattataattaaccctattaaaaatgtcactcaattccctatccccgtcttacgaaaaactctcgtctcccctaatcaaactgaacattttatagccacatcccacaactccccctaacctaaggaccgttcgtgcgcgttcggctattttctgcccttcctcgtatccatctgcgacattacccaccgcgcacggcggcgacacggcagtggccggccggggtactgggcttcagcggctacagcctatgggagtttctgggcgctggccgcggccgccggaccggtggtctcctgacgcgcttccacaaggtccgggtgccatatgattgttgcaattgatgttttcacccattttttttttctcaaaatattaattgcgcgtcaggtagggtagaattcgctatgtgggaatcgatttaatgccgaataaattactcttgtacaagtagaatcgcatttggttaatttggtgcgtcgtctcatctactgaggggatttagagggtcagcctaacgggattgtggaggatttgatttttctttttgttgttggcatacgatgaatcgaggtgctagttttatgttcgtggatttgtttgagtgtgtcctcttaagagagcctaacaatgcctattaactgaagatagacttttgcttttatgcagaatttatctagctaagtcaatattggtagtgaagtttattttcccttttttccctcctggaaaatgcaagtgtagttttgaagatgtggattgtggaatatgctggttgctagaacagttttttgccacattttggttgtcaataagagaagtttgtcccttgtgatgagaacaaacatatagcccttagagaatgaaatttgtagctctaaaaaaaaaagaacgaaatttgtcagtcttgatcaccttggaaatttccatactagactgaataaatccctactgttcttcgtgatactttgagtctacagatatatggcacagtgcagtttcctggtagatgtcacatgaagtaaaaacgttgaataccataagtccagaacttgtgaggctgaggctgtacttctcaaatgcaattactacctgtcacgccctaaaaatcgcctaaattaaaaatgcatattttaaattatttttagaaattattttaaaagcctacaagctaaaccctaattttctaggaaaattttcaacataaaaatgagctagataaaattttattaaatactatgcttgctcttctattttctagaattttctgggaattatttgagcaagggaagtatttttaataattgaaacaatatttcacaaattgtttttattgaaaaagttcaaaaaacccctccctaagccgttgggccaaattcggcccaacatctctcctctcccgcgcggccgagccggcccaatcggcccagccgacgccgcccgctcctctctcctgtggagaccgacaggtggaccccacctgtcgggagctccttcaacctccagccgccggccggcctagccgagctgcccgagccgcctcctttctcctctcaaatccgctccaatccggccccgattcctccgggtttttgaggggattttatcctctcgttctcctctatctttacccccaagaatcggagcaatccgttgagtattctctccgaatcgagttcgtttcgagtttatccctaaaaaccgagtttggatttttcccgagtcgattcctctcgtttggagttcgatctcttcaatccaagcttatataaagcatcccctcgtcgccctctttcgtttgccccctttcccgagctctctcgtgcctcgtagtgccgtcgccgcgttgtttttgttcgccgccgccgccggccgtcttcagtcgcgccgccgcgccgctcccgttgtcgccgccgcttgccgccgccgccgttaggtgcactgtggtgaggagaacctcggtcgcccgtccttcttcgccgccgaccaccggagtccgccgtcgtcgtcaagccgagccgccgccgccgtcctcttcgtcgccggccgtcatcgttcgtcggtagacgttgtggtgagtaccgttgggttcgcctcgtcgtcctctacgcgtaggtgtcctccgatcgctcggcccaggtccctagctccggcgagcttgcaaccctaatcggccggccgtgggtgacgtcatgctgacgtcatcatcttttctttttcccgattttctaatagattaaaacttcggaaaatcataactaaataaccgtagatccgttttaggtggttcaagttgctaaatttttttaaaatcaagatctacatgttaaaaatatccacatgtactgtttatgcttgtttttgtactgttttgttgattttgtttaattgctttagtttccgacgttccggaggagagcgtttcctttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccggttatttattggccgaagatgactttattttcctatgggttataatttgattagcatgaaccttatatattggattggttcagctaaatgctatatgtaagtttgcttagccatgcctagaaacatagctaattaaagggattaattataaactatgttattattattaatgatggttattaaatggtagctcacgatggctgatcgtgtgatgttaattaattgataattaaaacctggttaaggtgggttgtgagcacatggttttgatggttgtgctcatgacaattaaggaccggttcgcgagctactgttgtgaaacatttatcgtgccaaccacaagccagcgtgggcaacggctttatcttttgtatagcgtgattcattatagtgcgtcatactgagaagtggcgagaagtccacgggggtcgctggggagtccatgccttgtttataagggggtgattatgatccaggaaaggtgcgctgtaatgggttatgttgtgcgaggggtattgtcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcaataatgttaataatgtgataattaattggactcctggtttggaatggataattcctggtttggaggtttaatttgttcaactggggttggttgttcaaatatggttgggcctatgcaacatgggtgtgttgtatagtgttatttaatattgattaattattcaactgtttttactattctcttaaatgtttattaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttctcggttaagatgcctgtggagtggagtcgccatagctgttccgtagtttgttatcgttttttttcttttccgctgcgtagaatgttattctttgggaggaactatccacctctgtaataatttattttatttgcgaatattaaatagtcttttatttgaactctattattaatttgtcattgtgtgcctcggttgattcctggacgagggtttaacacacatgtaagcgtttggaattttggatagaaattccgggcgtgacactaccttttcaacaaaatcctgtcattcagactattcctcatcagtaattcatttcctcagtactactttagaaaagggcgagctctggatgcattgactaggaagatgaaagagagaagaaaatatatgtttcagaacactgtgtctcagaaaaattgtgtgtcttggaaaaattgttttggccagcttatgatcattttaaaaccagctagaatctgtttgccagaatccatttaatattaatcagatctggcacaatcaggtcctgcattgctgattgaaacattgtgtttcatgttccctgttttccagttagcaatgaacactgttctgcatacctcaaacataattccctctatcactaatgaccccataaaggtacagttaaaacaaatcctgttagtttgttcttctctcacaatttgtatatgcactatgctttttgtttgtttcccaccagaaatagattgtatcagtaacagacttttgttaagaactacacacttctattacataagtacatgcttgatccagtagtttagcttaactgataaagtaaatggccggtcctgcacattactgtagagatgcatctaactgaatggccaacttacttatatctccaaagaagtggtctcgttattttgtgaatattaatttagtacatttttctgttcctttccttttctttctttcgtttttcttttttgtaacggacatgttattttgaagatgtaaaatactatatatgctgataagaacatatatacaacatttcaagaaaccatatagcttttttttattccaattgcagaaaccatatagttgtagaagagatgaaataagttcatggtcaagaatatctaatatcatctctttctatataagaaaatgttttaatccgacaggttcatagtcagtgatacacatagtgacatgcatctatctgcatctttcatagatatgtaagctacttattgtaggtaagcatcagtgcccgaacacaatgccttattgaggaatcagtctaaagcatgctcttgcttcaaactacaatctatttattaacaggaagactgttttcatgcaagtgaactgatat

SEQ ID NO: 74685 - DNA, 6071 bp, Oryza sativa
cgccgtccccgtccgcccccccgtcgagctcgccgaccgccggagtgccgccgtccccgtccgcccgagccgcgccgccgccttcctttttcgtcgtcgccgtcgacctagggtgagccgtggaccgccgtctcgtttccccctttccctcccctctctcggccgccgctccaccgtgcctatggccgccgccggcgaccataggggcgcgggcgcgccgcctcccgcaggccgcgccgatgtggccgccttcgggcgcgccgagcggctgccgcgtggggcccggccgtcagccgcccgcgccctcgggtacggctgacgcgtggggcccacggcgccggccggtgtgagcccgggtgcacccggtccaccgtggaccgtgaggctgccgcgtgggccccactcccgtggacccggtcctcgcacctctccccctcggctgacgcaataaaccatttttaaattaaaatttaaatgaagaaattcgtaaatattcatttaaagagcatataaacttcaaatggccatactttggccatttgaactcggaattggaccgttcaagtctctaatttttccttaagaagtcaagaacccatttttgtgctttgttcctgtttgttatatgaagtttattagagtaaaagcctttttcttttccgttggtcgtgtagacgctgcagcttcggaagatccgctcttcgtggaggttgaagccgacgtttgggaaagcgagcaaggcaagtcatatcatctttgaacatattggatcccactttatgaaattattttgatttaaattaatgcattatcgctttatttaaattctcgcgttatcactgttttatttagccatgcctatttacctttgttatgaccttatttttgttattgttattattactttgttcaccctagaataaacaaaaccccaactagtgggcgctctactcatggttcccctagtatgaatttagatagatgcttcgctgattaataagacaacattaggtggtttttataactttagactttgggaatattcatatctcttggactttatggaatggttggactattgtggaattggatgcacacctctccctctattcaaaactctcaaaatggttataggctgggcttggggtgcatggttttgatagtagcacctcggccacataaggaccggtcttcgggcctctgttgcaaagcactaccgtacttccacatgtatagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacaaggctggtgtcctgctgctaggggctcagtcctacctacctgtcccggaggttccggctgtaggtggggttgggtcggtactcttgtctatggctaggatgggttggaaactatgtcatgtcttccgtccatatgccgtggtggtatgtggcacgtggttgcacatgaggaagacgtgtcttgtgggtaaagatgtacacctctgatcagagtaaaacctattcgaatagccgcgccctcggttatgggcaagcctagcaatgtacccaagttagtgtttttaattcttaaaacctgcttaataactaaaatgtggaatggttggcctgggttggcttgggacgagctgggacccagggtcgggttgccggttcggtctgaatcatcgtaggccttgggttaaggcaggttcgtgtgggttcacggccttgtttaataatattaaatagttctaggatcgtgttttaaatttggctttgagcaactaagagtcttttaaatgctgtttattgcaaaacctaacccctatactataactccattgtactcctttgcatttatgttgcacttgtgagtgtgtcttgttgagtacggtggttgtactcagtcttgctcaatttttcccaaacccagaagaggagctcctggatgatgaaggctttggtgtttagctcgtgcctgccgtcaagcgcctgtggtcgtcgccctagtcttccgctgtttttcgttgtcttcgtgtgtgctgggccctcgttgcccatgtaataattaactatttacgcttccgcttgattaaactctgaattgtatcaacttttggtgtaccttgcctcctaggacaaggaataatacacgcacatatggaacacccgttgggttatttccggtcgtgacatgtgtcatatctaccaaaaatctcttatattatgggtctgtccagattcattgtactagtatgtgtcacatttatattatgggccggagagagtagatatatatggacggttggtttaaagtttatataaatttaaaatttgaaatatttatgatcgtacggacagttgatttaaattttatatggatttaaaattttagatatttaaagtttattgagatatttaaattttgaaatcttttactaccttactatcatgtctatctatatatacgtgagattcttaactggacccaccattcccttccattcctcttcaccacatagctgaatcttttggcgcatcatagtgtccggctcgagtggaacaaaaaaaaacagtaactgagctgaagaatattaatccatgggaaactgaggtgatgttgcaacaaaattcattgaacaaaacaatgcttttggcttgtacatgtcaccttttttttctacaaaatttgatttatagtctaccagctcagttgcaaaattaagtccatattgatctagctacaaatgttcgggtggttgcatttcctgatttacatttcctgatttattttattttgcattgatgcaatgctttcctagctctgacactgcttctcctttccttgggcggttgaaaggcagaacaacaattagagcaccaatcaccaaatctttattcaacttttattctgaaagttttcagatgattttgcaaaacaaagctaagttcctcaaatgattcactcaatctctctaagtatatcaatataaattcctcaccattttttgccctttttattcctattctaaggtttgatatgtggagtttggtagagataaaacatggcttacttgcattcatatttattactaaatcaaaaacccagactaaagcagataactaaacatactcaagatcaagatcgtgcaaagtgtgtgtgatatatggtggacatgatatataaagaaaatgcttctcctttatgcttattttcttctcccaaaaatcgtttttttattgattaggagagagcatgcaagtacatattagtattatcactttttttccattgtgtgtgtgtttcgaacaatagttataatttcagttcatattaattgtggtcagttccagtacatattagtattaaattcgcatcccaatcaatttctattacaatttagttgtcatgctaatagtgcctattatctcagttatttatttagcactccagcagccacatggatattgtgagcaatatttatagcacattaactcttgcgttccgtaggagaagctgttgtgcctaatggaggaaagaaagaaaaatatagtgtcattacactttactctttgaacgtatctggttgagaacttctatttttaaatgactatagttaattatgttatttgctttattccgcacccatgccacttcgggttacactcagaagcccaaggctgtaaccaagaaagaaaagtaattcactgcatccctctgttggtatagtgggtgctttatatatagtttttttttaaaaaaacggtccatttttacagctatagtgctactgaatacttataacaatttatatatgtttgttttgcaggcagcatggtcactattctactgtaaatatgatccagcataagtgcagtttgtatgtacatactagctaccaaagaaaacccaggcttcctatttcagcttgtttagttcggttagcactggggtcaatgaacatggaaatgtcatgcaatgtctctgcgtatacgcagtccagacagcactgtgtgtgcttacctctgacgataattttcatgtatgcctgctttcttagattttgtttctaaatacttatttgacttttctaattttcacctgttcttttaacctaactgttcttctagtttgttcaaagcacgccttattccttgctttccaaatcgaccacgtcacagcaactacccccactaacaggacggagttgttttgtatctttgtcacagtgttgtccatataccaaaagtatgttgaatatttctcacaggtttcaaatcgaaagcacaagccaccacatttcaagtaaagtcatggggcagtaaaaaaacagatgttgtattgtctcttttttatcacagaactggaaagtttcagtcccttttttctatcctcttttcttaaaattatctttagttaacacgttgtttctcagtagtaaccacacaaagatcctaattttaagaggtactttgatattccgaattttttttatgcatccccccaccgtgccgggaaagggatcctctgacttaaccgccatgtagttaagtcactgacatgtgggccatagcaaagtaggacccacatgtcagtgactcaactgcatgtgcagttaagtcagaggatctgctccccccccctccccaaccattgaggctgtctcttgcattttcattgcagtgtagaaagttttgacactaaaaactcctttttttttgtcggaccccaaattagttcatccctatccttactcagttttagtttgtcacaatatattttgatgctattccattccaaaagcttgttatttgtcagatttcttctaaaaatcatgttcccctcatcccttttattttacctaggccagagtcatgaaccgtgtgtgtatttctgtataagtgagggaattgttgtgccagaggtccccccatccagttgtcttcccaaaacaggatgttggccccatttcctgctttttttttttccaagcaatggataaagaaagtgtctttgatctccatgagcccttgccagaaatgtgatgcccctgttttagttttctgggctgttaggatttttcttgataaatatttgtctctaagtaattgttgccacagaccctcggttttttcaagattccaaagccacttgcctaatggggctttattcatagcctccagatctatgatacccaacccaccttattccttaggcgtgtgtttggttctgggactaggtgggatgggatgaaaccatccctgatttgaggattgggatgattccattcggatgtttggtttgtagaataggacgatcccagttttttgtttggttcaaggaacgagggagggatgggatgagcgccatttgcaaccaccgacaacgccgtttgcaacaaccatggccgacgccgcctctgccctcacctccggacgtggtcgccgccgacctccttgatggcgtcgatgagcggctgcggggggctcggcgacggcggcggtagacggctcgggcgacagcggcggcggcgggctcgggcgacattgacggcggtgggctcggcgacgacgacggacgggatgacccaaccgagcgctgacggcgatggtgtcggccttcgcgcagagcagccgcggctcggcgatgacgacggcggcgaggtccgcgcgggagagggagagggagaggccggtggagaggagggcgagcacgaccaccatcgcggtcgggcgggcatagaagcgcgacgacgcacggtcggccttcgcgcagagcagccgcggcttagcgacgacgacgacggcggcgaggtccgcgcgggagagggagagggagaggccggtggagaggagggtgagcacggccaccatcgtggtcgggcgggcggagaagctcgacgacacacggtcggcccgccgccgagttccccgtctccggatccgtcgccacaaccttccccatcgccggatccgccgccgccgccctcc

SEQ ID NO: 74686 - DNA, 7386 bp, Oryza sativa
gctaccgatacttatgcacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaaagtagtcattacacttcatgaacgtaaatgatacgatggccgtcactggaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcctcatgcaccaccggtggtgaaccgatggcaatcctggaacaggagtcatcatggcattcattataccagcatgtcgatctgagataatacaaacctctctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatgcacgcataaaaattttcttggtcactccatcaacgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacgcagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccacctggaatggttctggcaactgatctaggttgatgccgccatctactagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacataaaagtaatcatctggattcacatattggcctgctacttctgtcgggtattcagggttgactccgtacgacgaccaatgaatactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttcaccctccaagtcttctcgtaccaactcactcttacttgcaccccctccacggcgagaataatatgtcacaaaattcttctcaacgtaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagatgtttaggataagattcagtaaaacttttgaaattccaatattcaatttatattgcaataataagtttattaaatctagtaaatttatgatactgtgatagtatttttcgagacaaatttatgtatatcatttcttttatttctaaaataagcatttgaggaactgttgatggttaaaattttttaaaaaaacataactgaatttttcctaaacatcaaatatttttaccaagggattatgtgacatgagtatggatttagtgttttttctaaatcaatagaacaattttatttactaaacctaaataacttagaaaaacaaggataagccttatattcttcttaaaagatgagacattctttattattatagaacaatttggatatttttttccatatacaagactttccattctcaggaaacacctcattgcaaacatgaatatgaaagtgtttctattaaacagactttcagagtgtaagtacacttaaatcctaccatctgcttagtgtaatttcagactgtaattataccaaacaccatacaaaaattcattttccttacagaagaacacagtttcactgctgaattagtttctctaggttttgaatatattaatgtctagtacaagttgaatctcatatagtatttgcagcctcagttcatctgttacagttgaaattccaggtctgtgtgagaactgagaagatcaattactctgttaaaatttacagtatatgtcaatccagcaatatgattctctatttcaattctgtgatatacaggagtgaatgtcctgtgtggtgtgggggtcctatcaacgccttatgctgtcaagcaaggtggctggcttgggctgattatattggctctgttggctgtgttggcatggtacaccggcatcctgctgaaacgctgcctggacagcaaggaaggccttgagacctacccggacattggccacgcagctttcggcaccaccggtcgcatcgtcatctcggtaaactgtcagtttaaatttgttatgttttcattgtgttgttccatggatgatgattctgtggtaactctgattttctgatgtctttcaacctgcaggtaattctatacatggaactgtttgtaagtacttcttactgacaattcagtttagttgtgtatttgtattagattattagttgatgctataaaaacattactctctcccgaataaattagtaacgcaatttacagaaagagttaaattaatgtattactaaatggtttgtaatagaatattgagtttagtggagcaatttggtttcagaaaaagaaagtcaagcattaaccctactgaaaattgaaatttatgcaagaatagaagctggaaaggttatcataaatcaaatataccagaattgtatgttaagactggaacaactttattccgtaaagcattctacattgtagtgttaaaaagaacagatgaattgaactttgaaccattctgttttattttgtacagaatattggcaacatattcattggtcctaatgtttctctacaggcctgttgcattgagtatctgatattagagagtgataatttgtcaaagttgttccccaatgcacacctgaccattgggacatttacaataaatgcgcatatattattcgcaatcctgactactctgattgtcatgccaacaacttggcttcgcgatctcagctgtctaagcttcatttcaggtatcaacacttgtcaccggaatcctttgtttcaccaaatatatttgcaaaacttgaacttattgaatattacacacacacacaagtactctttcaaaaaaaaaaaaatagtgggccaaggatatgctgctggtatttgttactttgagtatatgtggacacacaccaaacggatgtgcaagtgtggtgtttgcgcatacatataatcgggaaaaaaaaggggtgcacaatgtgccttggatctcatcttgttcattctgttatagctggaggagtgattgcatctatagtcattgttgcttgcctgttctgggttggacttgttgatcacattgaggccaaggatgaagggacagcactgaatctcccaggaattcccattgccgttgggttgtatggctactgctactcaggtcatggagtgttccctaacatctactcttccatgaagaaacgcagccagttccctgctgttattttcacctggtaataaccctagaacaaatgtctgtgattcataagttctttaaaaaacagtgatgccaagctttgcttatgtttttttttcttgacagcattgcattatctactgttttgtttgctggtgctgcaattatgggatacataatgtttggtgaatcaacagaatctcagttcacattgaacttgccatctaatctggtagcttccaagattgccgtctggacaacggtattgttcttgtctaaattagaggaagctatgacatctagtacaatgttgacataaatgcatcacttgtatgattgagtaaaattaagttatgtatgactctttatttcagtcatctttagcattctctgtaacatctggtatagcttctaatacttaatgttgttattaggaatattgtactctactgatagtgtatactttgctttttcttgcaggtgacaaatccaataactaaatatccttactgtgttattttgtcttttttacacctattttcccacgctactttgtcattattgaacaacatgttggcagttcattacaaactaatagatagctagttcaattatacggaataagaagattttcaatttattaggttgtaaaaaagcatatttaattcaagtttctcataatgttgtttcatactttgttccatgttgtaagccgtttttgcttttgtcataagtcaaacttctcatctataataacaaaaaagtcactataaaagatatatttcacagtggattaaatgaaacaaattaatttgatgttgtagatgttgataattttttttgtaaactcagtcaaagttagagaaatttgacataggacaaaagctaaatatgaattggaggaagcagtttggatatccttaactaataaccacatatgcactgaccatgactcctcttgcccttagtatggaggagttgctacctcctaatcgacagacatactcaaacatagtcatgcttagatcagcacttgtgctatcttccctcattgtggctctctctgttccattcttcggtaagtccttctcatcacttatatcagtactttccaaaatgactatgttgcttattttctgttctaatcttcacatttaattgatgtttttgagccctttcaggacttgttatgtcactagttgggtccttcctcaccatgtttgtggtgagttatctttccttcagtttttttttttgggtcttagtcatgctgtttataccatttatatatacatatttttggttttaggcgtatattctaccatgtgcatgcttcttggcaatccttaggagaacagtgacttggtatcaggtacaaataagaattattttcatcgaattgctcaaatacttcaatttgatagttgttcaatatagaaattattactatgttagttttccaactgctgaaagtttacctcatcccatgtctgattgtctaccacccactatctaaattacacgccggtcaatatacagatacctatacattgtcataaaaccaatggggaatttcgcaaaagctcagtagcatgcaaccaattaattttactcaccttatgtggacgacatcaaaactccagcttgggcaacgtttgtttttttttttgcgaatttgtgttgaaaatgcttaattacttcccgactaattgaaaggaagtcttggggatcaattcagatgactatgcagacaaacacaagctgcaaagatcctgtactgtttccaagtaaattatgcagtagtcttcaagctttccttaattttcttacaacaggtcaacaaggcttgaagaagaaacaattcgatcatatttgcaagaaactaatttgatcatattcacaatatgcaacagatattagtatgctctgccaggaatagatgaatacatatatgtatatagtaatccaggtaatggaacaatctgaagattaaatggatcttataatttagactgatctgtctagttcaaagagttcaaggatattcattaattacgcgtcgctattcaccaattcaatctggatttttcagtgggaactaattagcattctttttgtatatgcaagaaccaaaatcccataatttcaatattcaagctcattttttttggaaatatgccatttaataaacatgaataccatctcttgcaggtactgctatgtgtattcatcattgttgttgggctctgctg

SEQ ID NO: 74687 - DNA, 19644 bp, Oryza sativa
tttgcgttgtgcttagctttgttgaccggggatttttgctgccctgacctcgcagctcgaatcgacaaaagcagaagagaatcatctcacctaccaagcgtttttattcctcctatcattctccattagggataacttgggcagctttagcattcgacgtggacagaaatctcaaaatgcacaagctaaaatatcgttttttttatggagtatagtttgttatggtggattgcttattgtgacgttcttttttatatttgaataggaattgacaagtgctattagcaatagttttattaatagtgtaaggatgcttaaacattttggacttgctctgaaattttgggacctaggcggctaatagagctgatgactataacttctaaccaccctgcccctgttgcttcacacggtaaacaactgcttttaaaaaacaattatttttctcaaagattaaccaaacatctctttttaaaaaaacaaactcttgtattggactattggagccggctcatctatttcagctgttcaatttccaatatggaaattacaggttttccttttgcgagggtgaaaattaatcaaattacaggttggagaactatctttccaagaagatagcaaccatgactaaactgaaacattgcatcctgcaactccaagagagtactgaaaatcttgatgttctatcgtggaacgtcgaaactgtttatttgtttttgacgttgggtttgacaataatgacatgtttacagtgaagtcgaagctcctatgtaacttgggtggcaagttcgcaatggtaacacatgccttgtgtagtcgaggctgttgtgtcacttctacgataagctcggtgacaatacctcacgttgggtttaggtcgtggtagtttaggttagattagttgttgtggttgtgattttcgctcaggttttcctaattaacagtgcactataaggtttattcgtatttactctttaaaatgtgtcacattgttttttatataaaacatcggcaacgaactgacgttttttttgggaaaaaaggaagaagagagaagagcagcgcaaagtctaattgggctttgtcggttgggcctagttatggagattgaaagataggctagaagtaaaattcagagtagcttttagcgattcattcattgggccaaattttgagtttgggcccaactattccttctatttcctgacagaataagtcgacttgtcgtccctcaactttaacgtcttgacctcccttatcctcgataccagaaatcttcgcccctaaactatacaaaaccgtgcgtaacttatgtcccatgacagtatagacccgtttttcctgtttttgctttcatgatagatgaccgggccatttggcaatctgagaggagatggcggaggcgccagtggaggagatcgagggccggagctcgcagagaacgacaaccagtgccgcggcccccgtcgaacatgctgttcctggcgacatagcagtctcgtcgtccatccagcaaaaagtattttctatacctagatgcctaggtgtatgcatgtaattcaaacagttataaaaaatttcataaaatttgataatatagtccatgataatataagacaatatgtaaacatgtaagtgtaaattcgatcgatatataaagaaacaaaaataacaaattttatctgcattgtacgggtactattcattatctgattttattatttttatttctctagttgtagatcgaatttagtcttgcatgtttgtatataaacttatatcatcacaaacaatgttactaatttttttctataactatttgagtcgtatgcaaatgataggtgtcatggtacttttggtacttatgtgttgaaaatcctttgtccgtccgtccatccagccccagctgtaccgctgctcgtggttcatgctcgctgcggtcgccacagcaagacgacggccagcgcgaagagctcaccctgcacatccgacacgcgcgccatcgggtggaggctttttacttggtgccgtaacagaaatccgcggcggcgccgcgttcgtggttcctcgccggaatcatggtttacccgcttgttgagaggagagctctcgtggttcactatggttcgtggcgtggtaattgttggatcggtcgtcgaggctaacggccaacctgtctgatgattctcgcctgtctcgtttagccttcttgttccatcctaaattgtgatgttttcttttgcatggctagcttgtttgatcctttggggattttatggattagtacgattcttcttttggttcttgcgtcccaggagggatgatggacgagtaggaggcgagcaaggggagtacgtgacacggcttcgccggaagagaaggtggcggcggcgaccaggaacggcggcgtgctcggtggggccgcggcgctgttcgtcgtcctccgcgagctccggccctcgatctcctccatcgcccgtgacccgcgcgaaaaatttgataatttgacactttttttcgttgcccaattatttaaattggcacttgtgaggatgataagtgggaccatctgagtgaatgaaagtggatcatgatgtcaaataatcaaaactcatttaaaggagtggtaaattatcaaatcgctcgacgtgcgcatacccatccagacatcgaggtctcctcctcttctaagaccgacaagtgggcccaatcatatgccagttaagaataaacataaaaagatgaggcctatatataatgccatgtacctaagttgtattttttttatagtttaagggtgaagatttcagatataaatcaaactcagcctaaagtttagggatggcaagtgaacttacagcatcatcgtttggcttatctgcggaataagccaaacgacatatttgcaaacgaaaaaaaaaattatgaataaaacttttatatacgtgtttttagcgatctaaaatcaaagatcgaaaaaaactttaatggaagaacctcaaaattaactccaaatttaaagttaaaaattaaaattttagctgataagtgtaagcacaagtaaaaagataatgccattattcctttgctgaccggaggaaatgaaggcccaggcctcaagtgggccccaaataggccgtgcgtggtgctgtacgtgcggccacgtgggcaactgcgtctccgagcccaattcacgtgtcaccttcgtctatttattttctcacgtgataactaatagggaaataaaattgaaaatatacttttgtttcctttcaatttacaaaaatatacttacaaaaatatatttgcgaaaatatacctcatcctaggttagcgggagcggtacggtaagcacggtcgcgcctgccggtcccgcacggcggttgcgcggaagcgatgcagcccgcggcacgagtatgcgggagcggcggggatgcgggagcacctcgggagcggcacggtcccacggaacgggcgtgcgggagcggctcggttccacatttttttacggtatcagtactgttctgcactgttcaaacagcggtgccgccgatccaacgtggaaccggctcatgaacagtgtcaaaacagtgtgcatgtgcagcttggctgcccgctcacgcgcggccggcctgcgtgaccgcggtgccgcttggccggtccgcggtaccgagcgtccgtgctgcgggaccaccggtccccgtggaatggtagtgcgggaccgcctcgatcccgcgtaaccacatcggggaataggtatatttgtgcaaattttcgctatataggtatataaacacaaaataataaaaaaatattttttcaattttctttcaactaatatacgcagtaattaattaaaaataaaccaaggaaagttggaaggtataattgggtgatgcacctcacacttgcaccgaataacatcacttcagctaaccaagcaatgtttccttttcagtacccattttacaaactcacatttacaccaaattttttgactagtggcggtcggtcacgcttagcggcggtcgatctggtgctagccttctcctgggcttgtgtgttggtgatgtcggtgtgtgggtggtgatatattttttcctttttcctgattacgaccctccaaggttgtaatcttgtaattttttcctactctatcaatagaacttcgcaccgtctcgtgcgagtcgtttaaaaaaattggcttgtttcttttcaccctctcttcagatttatagatctagttgtattgtcccgcaaaaaaaatagatctagttgtatttaagctaactctattttaccaataataaatcttcatggtttgtgtcgatgtttggcaataataaaagggtagcttaagaaattaacctaaaagaagatggatgaaaggagacaaaggtttagacatgtttcacactttcccgatgagaggtaacaccctaattccgtttagtgaattggccatcttcaatctttctcccctgtccaatgcgcgatattatttgaacttcactagctacaattgtgtggatgaaggtagtaggagtacatgaaacattacatgaactcacatcaaatgctatttgtaatgttcagaccttagtgttccagctagtcagtcacggactcacacattatgactatgagtttcaactataccgaacgttttgagatatatacttcctccgtaaaagaataagtcgatttttctacctcatcaaagtaatctcaaaagaattgatttctagccccatacctaacattggcagatcggctcatgaatcgagatatattaaataggctttatctcttcaatagccttacctaccttaccttacgtgagaacactacgagtatttattattagacaaaagttgaacatccaacgcaaaaagtgacacttccgatggactccacaatttttgtgtaattggctgtggacactcgagacaatatcttatcactctcgagagaaaagatgagagaaatttcaaaagaatataaatgctctggccttagtcctatgtaagcctgataaggtgtggtaaatcacactcgtcgcccacgctccacaccctcgatccccttccaatctaaccctaggtggtggcggtggtggcttcgacgacggctggcacgaacggcggctaaatactactttcgccattctaaaataataataatttagtaggggatgtgactccacatagtataacaaatctgaacagttctttgtctagattcgttgtactggtatgggagatttttttttctagagggagggagtattcattaatcatcaagtcctctggggacggtgggtgcagaaatactcttaaaaccgaggtacccaggagcaaaataaaacacctccacgagacgggagagattctccaaggaaacaggcccatttctggccacatcaaaaaaccgctataaatttcgcctgagccacgcgtcgctccctctcctcttctccgttgctgccgcctgcgtttctccgatttctcccccctccgtcctcctctcgccgtcgctgcctcgcctccggcccgcgccaccggagcccggcgaggccgccgggcgcgcgccgctcgctccgcccccgctggaacctccgactccgcagctactcccccggcgagcgtcgccttttttgcggcgcgccgtcggccgtagcgttccacccgggcccggacttctgggtgaggccgcctcgggaataatgatttgctctctttcgccgtcgtgttgggctgtggggtgggtgacgcaggatcgcgggtttgagttgtgcggttttgttcgtgcccgagggtggtacggactacggaggtgtcaggttggcggttgggtgcggcgggggtggtgttgtgttgtgttgtgtttgggggttgggttagggtttggagccgctcgatttggggggaattggggttttggggattcggcgtggggaatgggagagcttcggtgcactgaatgggggttttgcggggagcttgggttgatgatttgaaggtggggggcattgggtggtgaactggtggtttacccctaggtgttctcaatccttcaatcggacgtggattggagctgaggaatgactacttcatgctgcattcttgtctgctaaaagtggctactctgtttctaccataaatttgtgcttgtcgaccgaaccgaaggatggaaatgataagtgtgttttgtggctgtgcattcgggggcttgttagttcttgcggtatagggatatcaacacgttgctgctggattaacgaaacatgaagggtgtattgttgacttagtgttagtgcagctacaccaagtaaaagaactagttgctcattggatttatgagtgttgcggtgctgcattttagtttatatttgtgtggttacatcagataaatgttaactcatcgctgtttaattttgttgtgaagattagcatccacgtgaagcgttctaagtcggattgacacaaacgacaaaagaaaattgtattgactttttttaaccatttggtgctaaatgtgataaactatcatatcccatgcagtattgaactaatgttatgaaaaatttgacactatatgatatgccatatcttcttataagatatttatgctttatctgtgatttggctgttgctaatttagagcttcccatgaagaagtgaatagtttaaaaacttatggaggtgtcttttgttgaattacagggatgcaatgcctctcttaaaaaggagaccgttcttcttactggatccgccaaaggacttgaatccagaggacaaggtgttccaagttcggtataccaaggagatattccgagattaccagtatcctctttcatgccttaatggctgcttattgagttgtcctttatatgaagaataatttccattctaatctgatattatgtacttgtattagattatgttgaagtaatatggttatgtccttgactatttattagggaatacctgaatagggtaaacctttatcgtgaaagagtttggacatgtaaggtgtctggaaaatcaaatttaacatatgaggaagcgctggtctcagagcatcatgctgcagagaaggctcaacagttgccaagagagttaatagcgcctgttctacatatgattcaatacagtatgaccaccaagcttttcctaaacctgttacagttcttggcagcgttattatgattgcacatttccagaaaatgcaatggttttttatttctttatggtgcacactgttggtctgtgtccaaattgattagtattctgtctatgcattttctcatttttcctgtgctatatgaagtttgactgagctaatactgtttgaaagatatattaggtccgtagttttccccttggggtgtagtgtaacacgcagaaggctttctgtgtgacaaatctctcttttttataattttgatgagatgtcgtcctgtaattgtgcgcccatgtggaggttgtttgcctagtcctcaacttcactatagtttgcaaaagggacaatctgtgacttattgatctactgtatatttagtatctgtactatattattggtgttttgagtggtatcactgatgtgtatcattagtgttcttatatagttttttgaattctcttctgtgaaggcaagttaattattccctttacaatattttggattatttgatgattttgatagagtggaatttctactacatttgcttcaggcactcttagcttgactgaccttgtcaacaaaatatacagtattctccaagaagacttttttgaaggattagaactaaatggtagaaaagatggttctgtgtctgcttgcaagatcttaaaggttattattggctctggtaacaccaagatgtatgaggtgggttggattggtcaggacaatgcagagactaacacttcagttcttcaagccgatgatctagtaattcgcaagaaggcacgcgctagtcgtagcatgctgaaaatatatattagggagtcaacatcacagaattccccatggattatacatgcaaatcttgcaaagaaatatggaatacccactgagcccccaaaagacttattggtaaccatcttccctcattttatttactgtgttccttattatcttaaacctaaaaaaccatggcttgtagaatggtcaagggttgccaaaactgaggagaggactcgagaatggaaccacagatgatgtcagaaaaaaattgaagaaaggtgacttaacagataaccatgtcatcctctcagttcatttgatgttccatacaactacatttttgcccagcttcttattgttcactttttgcatgactatgcaggtgagccaattgatgatcttttattaaggcctacagcagatgatcccagtctgtcaaaaagacgtccactgtctacagatttcagagtgcctgtagattctgttggggatctacttatggtttgggacttctgcatgacttacgggaggattttatgcttgtctccattttccctctcggacctggagaatgcaatctgccacaaagaaagcaaccttgttcttcttgtggaattacatgctgcactcttccatttgctcattaaagatggaggcgggtattttatgtttctccagaacaagagaaggaaattaaaggtgactttgccttatccatcatttaagcatgcatatttttttgtcctttcttgttaacttgcactatgcgtaggtaacattggtcacctgggctgagtatctatgtgatttcttggaaatgacaagtaaagaagaattctccagtagtttatcaactgtaagaagggggcattatggacttgttcacactgccgtgaagcttaaaattctgcgggaactggtagatgaagccataacaacttctgctgtaagacagaatatagatgaaaagattgaccagcaacaagctattgcagcatcaaaaagagagcttgctagaaataaaaaggaagagcataagctggccatggaaggggtgacagaaaaggaaatgagtcagacagatgctgcagaaaatgtcaacgggaatgtaaatggtcaggttgtggaaaaagaaggaaaggagaagaaaaacatttatgccaacaagatgggagaggggaaagtacatcctgtgagaacctatacccttcttcatgtgaacttgcatatgcacgttcattcttacatatgcaaatgcatgtctctgctgaagctatccatgacagcaggtgcaagtcttgttgctaatctttgctttttctgcatagcagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctgctgcttgattgactgccagctaacgaggcactcgtcgaggaaaaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagctgccgtgaattcgccgccgttgtcggtgcgcagcacgcgcagcttgcggccgcactccgcctctgcagcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggatgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcacagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcctgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacgatcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacagcagaggcaccttggaacagaaatggagaaacaatctgtacaaagcaattcccttggaaaagacaggtactacaacagatattggttttttaggcatgaaggacgactttttgtcgaaagtgcagattccaaagaatggggttactacagcactaaggaagaggtgatcactttgcaaactttgggaatccctatgttttattttctggctaacagttctgtttcaatttgtaatccacagcttgatgcgcttattggatcgttaaatgttaaaggcataagggagagagcactgaaacggcagcttgataagttctataatacgataaggtactcaattttcattcaaagaaaaaaatataagataattcactcattgctgtagttgggtactttttacatgtttgatggttgcttctgttaatttttggaagtgacagattagctggaaagaagttaatcatcccatgtcaattttttgaaggcctacatctaatttttttaaaaaacaaaatgttatttaatgtagataatggtccagaatggtctttactggtggaacattcagttcaaggcctaaataacacaccgtagcctccatttttcactgaatggatgcgctatacttgctagacatgatcgaagctcctaaaaatagatcttgaaagattaatcattgagtgtaggttttttgagacctgtttgccttacagttgcagtctttatttgtacaagtaaaatgttctttgtgtgtttctcaaacatgaaggaaaccttaagcatgggcaccatatgctctcatgttacttttcagcctgtgggcattggacacttatggtaaactctttgctctgtttgtttagcaattgacctttgtgttggccgatgtagcaatgctctggaaaaaagaacgaaggacgtcacccagaaaatgctactccaagaggctgcactgcggcgatcctctcgtgtacaggcccaaccaagggataacccttcgatgttattcctcaagtatgtcaacaaatggaaggaaaactgagctcttactggttgatatgatacttgataggttgacatcttctttttcttttttactccctaccctttgaacccttgtagcggtttgttttgggtccttgatagctgttgatacaccaaaagaggaaacctgtcatttagacatagtcggcttaggcgagctgcttgaaggaaagatcgcattcgagtggactcatgctgctataagctgatgatcccatatccattttggaggattgggtaactgagagttgttaagcagtagaaatcctctgtatagtgaagagagtgcagaggtccatccgttgtatggaactatggatatgattgttccgccttgtcgagttccatgaatctataccattacctgtttattatcaactgttctgttttgttgtctcgttattatgttttgttttaatgagaaaattaggctctaatcttcatattctgttttatcgtgagaagttggttttgttcttgcatttgtactttttttaagggtccacgggagatattggaggaacaggtatctactaaatcctaatgtagtatatttctgtaagagttaatcacatctatatgatcttagaaaaaaaataagaggatttctggtgaatgccaaccaaatttcaaccaccccactgcacaaccgatcgaaatttttacatcacaatatttaaatttaaatattcacattatttcagttcccagagcaaatacattacaccagatttaacttacacccaggtgcaattgagcacatctaaccaccgactaaattctggagtgagggtcatccatattagccctgcacccagaatcgacacactgaaatttaattagcctaccaatcaacacctatgtaaattcatgtacaaaatgcccaatatttcctacccatataaatttacattccataatccgtattgtaatatacattaacaaaactacacaaaccctattctgctaatcacaaggcaagcgccttgtaccattgtccatggaccttctctgatatgactgccatatttatcagcatctccccggccttgacaaccctgtcggcgagcttcgccgcggcgaggcgtcgcagcggcgcttcggccagcttcttgcccttgacgccgccgccgccgaggacgacgccgcggaacgcgcagtagaccgtacgggacaccttgccgaagacgacgtcgccggcctggaggctcttgaggagcatcttggtcgcgagctccgccgtggcctgagcctgcttctccggcagagagagagagccgaccgtcgccagagagctcgccatcgcctccacgatctcctccgtcgaagcgtcggggttgctgtcgaggagcttcacgagagcgtcgtagagctccgagatggcgttctgcagctccggagcagcgaccttcgacaccagaacttgatgcaggacgagaatgctggaacagacagacatggtagattgatttcagttatcacatgcatcaagtataaaaatcagttgttctgaatcgacagatttagttcaaaagttcaaggtggagaatatttatttacctcgtcgcgatcacaatcaccttctgaaactgatcttgcacagccctcaacctcggcagattaatttggaaggtctcaggggttgactgcatgttcaggccctccacattgctgataagttgcaacaagccaacccttgtcagcttgtcgatcttctcacccttgcattctgggagaccagaaccgctagctgcggacgaagaagcctgagccattggagcaccgtgaccagctcgaagtgccggaacaacaacgcgttgagcctgacaagacgggttaaaattcagtgtcagtcagagaaaaacttaagactgctgcctatgctaatacaaccgtaaaaattgttgtgatcgtagagagacttacatgatctgctggcaaagcttggagagactccaaatgtgagctccactcttgttccacgatgctcttcgttgccgaaacccactgcttagttatagggagagacgctgatgcattagcaggaggtccatagcgatccgcgaaagccttctgcaggtactccactccggcagagccttttatgattggttgcatgagctggatgcgagccttgctaacttcagattgcagttgctgttaaatcacagaaaaaatgttaggaaaacacggcgcaaagtaagtgcaatctatgtcaggactaagtcaaggtgttaacattgaacaaacctttatttcttcgagagtgaaacgcaggcccttgatgacagcaatgacaaaggagctgatgccattgtcattaacttcggaacttgcagccaactcgttcaataatttctcatgactcctcttcatgtcatcttcctttgcaggggcagatagtttcctgatcatatccagggagtagtgcataatctgccccagatatcgcgtgtcctgggagcctgactcgagcacctttcatccaaaaaaaaaataacaacattaattcaaaatatactgggtttaacaaaagcaaattaatactaactattttattttgtcaagaccaccgattccttacctgtgacaaaatttcgaggtcaatgttctcgaggatttcctccttcaactccttggaagccaactcatgtaatgaatccctgacttccttcacgaggttaattagttgggtataatctggtttgtcccctttcatcgaatcagtaaccagatcccaaaacgctttctccatcgtcgatttcactttggcctgaaactccttctccgcggaactgacgttatcagagttgccaccaaaagaaacatcgtcctcgtgaagcatctcattgagcatttgctcattgtccgtcggctgtttcatcagagatgaactgcttggcgatgaagcagctccaggcaaagattgggcagtgaagctcgatccagacgaaccaatgctcaaaggagtagatacgtttgcaactgatgcagctaatgggtttccgttctccttcgcctcaaagaactttgaccttgtgtccgaaagagcagagttcatccgctcgatgcctgcatcgccactcagttgatgaaccttctctcgtaacagcttctgatcatcagcaacctgtttctgaatcgccttcatatcatgagagaggccattatgtgactgcccatctgaacttagcttgcacgtctgcatcatcgacagctcaagcttgcacgcagcccggacaagatcgtcctccagcgatttcgcatccttcagtttccacaccacaaagcagtagaggtaagcgcaccatgctctatcgaaatcggccagctgagcactgaacattttctgaccggcagcagcatcagtcgattgcttctcaagcacagtcttaaccaatagctcaaactccttgacaaagcttcctgctgaatccataagtagcttctccttctccccttgtccactcaacactgcacccggatgagccaggatcatgtaggagcagaggactaccctcagcgagtatcgagacgcgctagcagcagcagcaggtggtggtgtcttcttcttctttggagatccaaggtgtttcaggaggtgatcgatgtttatgaccggcgatgaaagaag

SEQ ID NO: 74688 - DNA, 4983 bp, Oryza sativa
gggtctaggtcatcgtagcttaaatatattgcatggtttatctcttcaggcattccatccactaaccatgaaggacttcttagtacctttccccactcaatttcatttatctctttgtggttcaaaagccctgcaatcgctttgatagctagcggtaaaccaccacatctttctaaaattctaaagccagtactctttagcttctcaatcgcatactcatctttcaaagttgaagcaatctgcaagcggttgaagcccatgatgttaatacatataggctagatttgcgattgatcgagaagggtaatttgtgcatttgccaaacatagaattcttagctattatttaagttagcatttctattacttcccggtctaaatttaattagagtaaccttacagttggttgtttacttcatactccctccatttcaaaatgtcactgactctaagttgtcccatttgagatgatagtgcttcatctttagccaaatgttgacaaaatgagcgaccgacatcatgcatgctccattcactattgggcattgcctgtataaggttccttataattaactcattgtaatactcctttcctagctcttccggttcatttgattttccattaacaaaaccttcacttatccaaatttcaacaatcaaatggttattgaggcattgcttcaaatgaggggctagctaggtcatcatagcttaaatatattgcatggtttatcttttcgggcattccatctactgaccatgaaggacttggtactttccccactcaattttatttatctctttatggttcaaaagccctgcaatcgctttgatagctacaagtaaaccaccgcatctttctaaaattccaaagccagtactctttagcttctcaatcgcatactcatatttcaaagttgagacaacctgcaagcggttgaatcccataacgttaatagatataggatgcatttgcttacctacttttttttttactttctttagtaacgaagatgatcattctctttgttttttgatctagaagggtaatttgtgcatttgacacacacagaattcttagctattatttaatttagcatttctattacttcctggtctaaatatatttagagtaaccttacagttggtttgtttacttcataatctgcaaaaactctccaaccctttgcgtactttccaatatgtctgcttcactacagtataacacatcatatatatcttgcaatctctatttacattcattaaacctataaacctatataattcatcccctcttagtgtacttaatagctatttcctgatattccgtgcttccacatcatcaagaaatgcattgcccgttcgatcgaatctggatacccctaataaatactttgtctctctattcacaagcttactattgtaattggacccatctcaatccatattttcctctccttctccacacccagcatgagccaccggcctcatactctgccatgacgagcgcaaatggcatctcctactctcccacatgacctcccgatcgcttcacactccccttaccctccaactccctcccccacttctaaggcccagcgctccaccacaatgtgtttttatacaggcacggccttatcactattggcttctataggacaattttatatgtatgctttgtgtgatttgataattttgttgtgtttatttaattttaggagcaagtggcttatagtatgctcaagcttttccctaagcaggtatttatttggctggatcacgttgaggggtggataaaaatctgacacaatcaatgcgtgctgtatggattctcaaatccttccctgtttatgtgttatgatgctaggcatactcctgttaatgcttccatataatgactgcaagagtataatgtttccttcaaatataagatagcatattgataggttggtattccgttctccttatcttaagctttgtatactcctacaaatttatttgcagaagcatggcatttttgtgcctcgtatgtttatgtgccattatgttcacataactaggcctcactatattgttgtccatgtctactcttatatctccatcttacccttttcacttagaattagtcactttttttaactagctgacctaagttggttctgtagaatacgtcaaacttgctcagagttttgccattcactaactgatgatatgcttattttctcttttgctccaatcagataaaaaaaagtaattatcacccagctcctatattttcttgatttgcacaaatgattctgaacattcccctagagtttccctataaaataccttggattgccactacttcttggaaggatgcgcaagacggatattcaaccaatcttcgataagatcgcagcacgggtcaccggctggaggggaaaaacatgggaccagtagggagatcaactctggtcaagtcaatgatgacagcgcagcccatctacctactcaccaccctcaaggtcaccaaagaagccgtaggcctcctcgaagtgaagagaaagaggttcctatggaaatgcaaaataaactagaaaaagatgtgcctcccaaccttgaaccgggaaaaaccggaaccagctcctcagccggttcgatttgctgcaaggactggacatgcaatcgaaccggtcacaaccagatgaaccgggcagtttttggtgaaaaccggtgaatccgacgcctctgaaccggcggttctggcgagcacgtggagcaggctacaaaggcccactaggcccaagtcatgcatgtgtcatttttactgaataaatgaaaaaagggtgggaagatgggattcaaaccctggttgcctcattacaaactcaataactaaaccaactagaccacttatgcatgttgttcaagggagaatatacatataatatgaatgctccggttctgcagtcgaaccggacgacccagcggtcagacctgtgagccggtgaacaagaagcttgaccggttcgatggccggtccggctttttgcactatgctcccaaccgtgcaaagaggactgggagttcttaacatggagaagttcacgagggccctgcgcctgagatggctctggcacgaatggaaagaccccaccaagccgtgggtgggcctcaagacaccatgtgatgaaacatataaattgctcttcaccacgaccactacaataacgattggggataataaaacgattcgcttctgggactcatcctggctagatgggcaaaggcattatgccactaccctatgcagtctccaaaaataaaaagagaaaaaaatactacgtgaaggaataaaaaacgacgtttggattgatgatctggacttaaatggcagcacccatttcacagtggatctgatcaacaaactcgtgtccctgtgagacacaacccagagcatccttctagatcaaaacaagcctgaccatactgcctagaagctttcaagccatggagaatacttgggagcgtcggctgatagagcgatgcatgggaaccataggtaccaattttaacggcttaatatggaaatcatgggctcctacaaagtgcaaatttatgcatggcttgtgatccaaaatagagtttggacttctgatcaactcgtagccagaggttggccaaatagcgggacatgccccctctaacgtacgtcaactgaaacagcaagccacctggttgcccaatgtagatacaccaaaagaatttggagcctaactaccgcatgggtagcatatcaacaactagacccgagtcactaggacccatgccaaagcgttaacgactggtgggaaatgttagccaactcaaaggaagtacccaagaaaggcatgcggaccctaatcctactcgtcgtctgggaaagctcgaaagaaagaaattagcgggttttcgagcacaaggagatggcaaaattaaaggaggcaagaacttgggctatgggaggagcaaggcagcttcgggattttgtttcgaaccaaccataggtgccatgtagctctgtacattttttttccttacccctagccctaggggttgtattttttacctctatatttaatgaaatagcacaatctcgtgctgattccttcaaaaaaaaatgaaactagttaaatagcacccattccacatggttttattattaggtggtggtgattgtgcatgcataactgacataacatttgatccacaagattagagacaaaaaatggttggcatacctagtatatctattactccttaaaaaacatctagtggaggtgacagtgaatctgccaccccactattgctttggctgttttcagaaattacctacagatattttctaatattgtggaatcatcgaaaatttggtttaaacaagtgaatagcatataatcaaataaacaaacaagtgatactaagatatctattatatattaaaagtcccatgaaacttcctacaaatgctcctaagccaccatgtgtcgctcctacaaacgcttataaaccgccaagtggcactacaaaatctaatcgttcatttttctttaaattagtgggtccaatattttcaaccattagatctaataaaaaacaaaactcccctatctccatgtatccccatctcccctcctcctgttggtacgtacatacttcactcctctcctcatctctttttaatttcttaatctctaatttaagccacatatcttatttttattgttaattaaataaataatttaatatctatgctgttctatgcgccatatgctttctatggcaaccaaatataacaaggaaaaaaaatttcactataaaaaagttaataacatattttatgttactttaaataattctacaaacatgtgtcgctaaattgtatcgacgatatccaatctatctattatatagtgaaagcccatcaaatttcccataaatgctcctaaacgccatgtgacgg

SEQ ID NO: 74689 - DNA, 1112 bp, Oryza sativa
atatgtgattaggaggcgtcagaggcctatagtatcaggtaacaattcgtaatactctgaaagtctgaattcctgataactattttgttcagtttactgggattttttttgccccttgagatgatgacccatcgtttctcccacgtcaactgaatagtcatgaaaaaaattgataagatagattaacatatgatatattgctccatgagacaaattaaacttctacaaattataaaaaaaaaacttctaatgtatgaatactttaatttgttgttttctacaatttgtagaggttaaaatttaactttacatgtactattttttatattttttcataactatttagtcgacgtgcacaaacgagaatttgactttatatgtaatatattttatagttcttttgtttttttaataactatttgacgatgtgctacaaacgggaggcgtctagagaggagaaaatcatccccatagttttctactccctccgtttcaggttataagtcgttctgactttggttaaagttaaattattttaagtttaactaagtttgtagttaaatatagtaatatttataacaccaaattagtttcatcaaatatataattgaacatattttcataatgtatttgttttgagttaaaaatgttactacttttttttctacaaacttaattaaacttgaaatagtttgacttttaccaaaaacaaaacgatttataatatgaaacgaagggagtgctttgatatacaagaaggtgtaaatcaatgcaattatattcaccagatgatgatgcgggcgttccagctgctactgctgctgttcatgctcgtcctaatcctgctttggctgccccttcaattaatctgtctagtgtgaaggaggctacagggaatttctctgaaagcaatatcattggcagaggtggtttcggcattgtctatcaggtctgcacttttttcaacaatttgacacctttatgtacgcaaactaagttacgatttgacttcactaccacaaatcttgaaatgcaaagtctgcattgaaacatctgattttacaatcaccaggggaagctgcccagtggtagaaaggttgctgtaaagaggc

SEQ ID NO: 74690 - DNA, 12587 bp, Oryza sativa
ttttgctatataattatagcatttgggtgcaatccaccggtgcagtttgcgcgccatctaaataccttataatctaacaacaaatattatattactatgaatcattctacattctacaaacatgcatagctaaattaaatatatagtatcgaaataaaaatttaaaaaatacatattcaatttgctaaaagaaaaagaaataattcaacaatataggtcgcagcatgatatgtttgaaaacatgtatagctaaacacactacataagcaagagtaactaactgaaatataaatagtctgagccactatataaaaaatcgagtgccttttagtagagaaaatattaagttttttttctaaatgtgctcaaataatccaaacaagctaaatgatcttctatttaatattccacctttataagtttctcaaacacggtctacgattcatgcccgcgcgaatgcgtgggctaccttccttgtttgataaaaagtatattttgctgtgacatattatgatattattttcttctgcccaaagcaaagcttgggtattttgctagtgtgtacagtgtgttacttttaatgaaactgcaaatacatgttaatgttggaaagtgctttcatggatattaattaagaatatattttatgagtaatcaagtcaaaggttaatcttgaagactttaccaatacataataggattttctacagagggaataattaccaaaataaatactctgaggcaggagtaagaaataaatacgaacctgtttcttgagtaacaaccaggcatcttgccgagataatatgtccacgcggtggtacggctgtatggccttcatctctcgggcaactctttcgtctctggtggtgatgagaacccagctgccttgagcagccgagttaactaaagggattcttaatgaattgttccaagcatggacgctccacatatcatccatcaccaaaaagattttctttccagatattgcttctcgaaggattggctgaagcagggacagttcttgatgcccactgtgctcaccaccggcaccagtgatggccgtcctcaccagctcaggatcactgaattcctggttaatgctcagccatattattttgtcgaacttctccttgatgtcctggtggttgaagatgttctgtgcgagggtagttttaccaatacctccaacaccgacgatggcaacgaccctgacgttgctgctgatactcgccgcacttgcctcttcctcctccctcgttagcaactccaccagtctccttgtatcttgctcgatcttattcccgacaacgcctgaccgatcaagctctggtgttgtccggcgtaagccatggccttgagctgtcctgctgcagtcaccgtagcgatcgagcttgatgaagctgaattgctcggcacgctgcttgatgccatcaagccgctggttcagcgccatgatgcggcttccaatgtggtgggcgttcaagggattccgcagggagagtagcgacgggttgttgctgcgcctactgtcctgatccatggctttgagctgacacagctccaggatgtccgtggcatcgtacatggcatccttgagctccttcacccaaccctgcacgtgcagatcggtgatgcgcctccgctccgcgtcggcgaggaactccttgagcccatcaagcctgacgcggaggctgtcgatcttgtcagagataccaagcagcatgcccacctccttcctcgccatcttggcaagcacattgctcaggttggatgccaaggcctccagaaccacagccatcaaggctgaacgagtagtgcttctgcatctcagatttaaccagcttgtcagtttttacatacatatatagcaataaaacagaaaaggtgctctaaaggattgtgtacctggctttaattagtatgcaacttctccgatcctgttcagaaccaagtagattgatgaaatggaatggtggcacagagctcaatatatacacatattgagccatttttaattaatacaatctattttctaaccctactcaatggctttcctaatcctgacagcaatgtggatgcaggacacctcacgcgagcagccacgtattagattatcaagaatcttagtcaacaacgaaaaggggatcaaatttcaagcgaactgattgttgtctccatccatattgtggagatatctaagaatatgccatctcctaacaactaaacaaaactgatttcaaacaaaactgttgacgcaagttaaattgtactgaaataaaccatctctgcactgcactaggaagttgccgcgtcactttccacttccaacaaaataatctcagatgttctgctgtaaacatatctgtttctttaatagaaatgggagggggtaacatctatagttaaaaaaactaaataatctcaggtggctgcatcagcatcaaccttcacttttagattagcttatcacaatgtgttgactcgggacttctcaatatttttggtcacagtttgttggaacattgcaatcagtgttctgctcttctagcccatgaatctcggccacaactacgccataaaattatcatacatgctgtgaagtttgtacatgacacagaaattccaatgtacctatgtcaaataaatctatcaagaaactaatggggtcgctgctctcccttggagaatcagtagatggaaaaactcttctttttttttctttgaacgaaacatacaaactgttatgtggcaagaatatttcctggtattggatttttttttcttcaatatttcctgctattggatttgtctgacagaacatttgatggttgatataagtatcaaatacatgtgcttcattctttgcccaactaaaggtgccttctctgactggtgcgaattattagtgctaagctattaccaacaaaatttcaatcagagaatcacaatggttttgtttcgataatgggaataaaagctcaatgaacaatgatgtttccatgtttcatatattgcttcagtagttcaaatgtgtcaagataggaaatatcgtagatccaacaaaaaaaaaaggtgcagatttcctaggaaataaaaaaatgaaacaaaattgaaaaaaaatacattaccctgccatgacgtcaccgatggagctgctgccgcttcagctacccttggtgcagagcaaggcaacgcggacgcagctcacccccactatccagcacacgctgggatccccaatccaggcctcaggctgctcatctgcattgccccacggccgcagccgttcctgcagtgttgggagagagatggggaataaccccgcacgagttcaccatggagagcaccacactgcggaaatacgaccacctgctgagggatgactatcttatcggcgccgatggccatctccggctgcctctcctgccgaagtggtttttgctgctgcggatctggaggtggaagaagacccaggggcgaaaatgacattctgggcttgttcactttattgctaaaatcgaccttacctaaattcgacatctttctaaattttgatagtgttttaatgagaggaaacttttgaaactatcaaattttggtagaattccattggtaagatcatgtgtagtttgtaaccttaacgaaatttggtaacacaaaaatttggtaggattgaacataacaataaaatgaacatgcctttcatattagtgttccacgttgatgcgtcttatacgtaggtggaacaaaattaaaagagtcttgtctctctagcgacaatttccttaaaaaaatgagcaattctacggtccttgaggaggtaccatgaggtaccaaaaaaattagtgtaaattatgaggtaccatgaggtaccaaatttacaatagaaaaattggtacctcctcaaggaccgtaaaattgctctaaaaaaattattagggacaaatcttataatggcatttggagattggccacttgagttgcaaatagttaaatttcccctcaaatgcaatatatgtcatgaaaaatcatgaagaaaaaaaaaagaagaccatatagcgtagtgacatatatcatctcaccaaatttctattgtataatcaattgagcaatgagaagaaaaattcggatgcatataatatttgtattgcttatatctcggatttgtctctcatattttttagatgttacgttcgagttgagtttagacttgaacatttgaacatttaagatggtatacatttcctagctaaatgatatcaaatgttttaaaagttgtatctaattagttactatgtatttagaggtacaagggagatctgtcaagttctccgggaatggaaacttatacttctattcatacaatatgtgacggtatcacatactatagtatttcttctaggaatcacatattatagtatttcttctaggagtacttcatatgtctttggttcaaagttcaaactagacaattgttcatacgggtgaaaacagatcggacattcgcttcgttcctaatccgtctgaaacaaggatatggtggggcttgtagaaattcggcgaatacgaacccggatacggatatataatatcctgttatgatccaagtagattgacaaaatggtttggtggcatcgagcaaaatatatagacgtatgagaactttctcaattcatacaatgcgcatgaaggacacatcgcgcgaccaggcacgtattatattatcacgagtcttggtcaacaaacaaaaaggatcaaatttcaagcagaactgattttcagttgtctccgtccatattgtagagatatctaacaatatgccatctcctagcaactaaacaaaacagatttcaaacaaaactgttgacgcaagtgaaattgtatagaaataaaccatctccgcactgtactaggaagttgccacatcaatttccacttccgactaaataatatcaggtgttctgctataaacttatttgtatccttaatagaaacgtacgggacggcaacctctctggtcaaaaaaataatctcaggtggctgcatcagcaaacttcactgttagaatagcttatcaacaatgtattgactcaggacatctcaatattttggatcacgggttgttggaacattgcaatcagtgtttttgttcttctaacccatgaagcttggccacaaactatgccatgaaattatcatacatgctgtgaagttcatacatgacaccggaattccaatgtacctatgtcaagtaaatctgtcaagacactagtgttctgaaactatcaaattttggtagaattccattggtaaagatcatggttaatttgttaccttaacgaaatttggtaacacaaaaaattggtaggattgaacgtggcaataaagtgaacatgcccttcatttccgtacgtgttccacattggtgcgtctacgtatcatgccatatatacgtatgttgaacaaagttaaagagccttatctctcttgtggcaaattacagggacaaatttaagaatggcatttggagagtggccacttgagttgcaaaaagttaaattttccctcaaatgcaatacgtgtcaagaaaaattgtaaagaaaaaaaatgaagagcatagagtgtacgtagtgacatatatcatcaaatttctatttcataatcaatttggatgtgaataatacttgtattgcttatatctcggatttgtctctccaatgttttgacattgcattcaagttgaattaagacttgaacatttaggatggtataccgtatacgtttcctagctaaatcaaactaaatgttataaaaattgtatatattgtttctatgtatttagaggaacgagggaagtacctcaagttctctagagatcaaaagttgtacttccgtccatgcagtatgtaacagtatcacatactatagattttcgcctaggagtacttcatagtatgtctttggttcaaaccagacaatttttcatataggtttaaatagatcagatattgtgtcctatccgctccactccgaatctgttcgaaatgaggatatggtggggcctgtagaaatctggtaaatatacaaatgctgatacggatagtttccagtttagatcgaagtaggttgatgaaatggtatggtggcaaagagctaaatacatacacatatgaaagcattttcaatttataaaatcacttttctatgcctactcaatgactagcaatgtgcatgtaggacagctcgtgcaagcaggtacgtattagattatcatgagtcttggacaacaaacaaaaggggatcaaatttcaagaactgattttcagttgtctccatccatattgtggagatatctaccaatataccatctcctagcaactaaacaaaactgatttcaaacaaaaattttgacgcaaatgaaattgtacagaaaaaaaccatctctgcactgcatgcactaggaagttgccacatcacttttcacttccaactaaataatctcaggtgttctgctgtaaaaatatatgtttctttaatagaaacggaagggggcaacctctctagttaataaaaactaaataatctcaggtggctgcatcagcatcaatttttcagttttagattagcttatcaccaatgtattgactctgaacatgtcgatatttagggtcacaggttgttggaacattgtaatcagtgttatgttcttctagcccacgaatcttggccccaaccctatgccatgaaattttcatacaggggttgtgaaatttgtacatgacgcagtaattgcaatgtacctatgtctaaatctatcaagacactaatggggtcgctgagctccctaggagaatcggtagatgtaaaagctattctctctctaacgagcgtaagagctgttctgttgttgcaacgagctttcctgctattggatttatctgatagaatatttgatggttgatatcagtaccatatagatgtacttcctttctttgacaaattaaatgtgcttgagtattgtaatatgctggcttaaacaaatgtaaacatgtctctggctggtgcaaatatttagagctaagctatatatggcctggcgcaacctcaatcacaatggtttcgttccgataatgggaatagctcaatcccaaagatgtttccttgtttcacatggtacaacaatttggcgggggtgggtgcgatacagtgcaataactcgagaattgaacgttcgagtgcaacaacttgataagtaggtgcgttttagtataagaacttgacaatttagtatttgatacataaacttagctaagcatatgctaggtacttaaaatatacaaatccacgctagtatattgtcaaaataagtacttaaaaattaaatatgtataaaaaagtgctccaaataattaagttgccgcataacttgttaacttattgtatcgaaatcgtacatatcttgcaagttgttgcatttatgtgatcacttataaagttctggtactaaattacacctatctgccaagttgttacgttaaaacgctcatttctcaaattcttgcaccaaattacacccatctgctaagttgatgcaccgtaggtgtaatttactctttcagtagtttaaatgtgtcgagagagaaattagcagatccatcagaataggatataaatttcgcagaaaataaacaaaaaagggaataaaggagggagactggccggagcgccgctcccgccgttcgccacgtggcagcgggccatggagtcactcacccctatccagcacacactagaatgctcttggagcgccctaaggccggcctcaggtttgctcatcttcatcgccctccgtggccacggctgtcggtgacatgggaccgggagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgtaggttttgcgccgcgtgtatgggttaggtgagcgcagcggggctcacctaaccgcatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcatccctagccggggtcggcgtgttagctcctggaggtggcacgttggacccggtcagatatataccagccttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaaaaaaaaaaagagaagacgatcccagaacgatcgggggctggaggggggatgatctggagagggtttttagaataagagctctctggctctccagctctttgtagcttcttcatacacagatccaccagaacacaggagtagggtattacgcttctcagcggcccgaacctgtatacatcgcccgtgtcttgtgctttttccactctcgcgaactttccacagactaggagcttagaatcttacccagggcccccggccgaactggcaaaggggggcctgcgcggtctcccggtgaggagccccacgctccgtcatctggcgcgccaggtagggggctctgcgagtgatcttctgagctctcgcactctttcgtgtgcgcccagcttttcctgttcagcccaatggccgaacaagcaaaggcgcacaacctctctccgagcgttagcggtgacgatggggagccaaacccacgccgtcgagctcgtactccaccgccccctccacgccaaagtcctaggagggaggaggtgctcgagagggtcgaaggatccgcgacttcgacatccacgggtgatggagaagggcgcccagatggggagcgtcgcctcctcgtctacggcgacggcagcgcgccccagggcgcgctccaagctgcgggcgcgctcttgcgtcacccgcctgtcgtccctgacctggagtctccagcccaacgatgactggacgacgtggccaacttggtcatgacggcacagcggcgcctaggtgctggtggttggtcctccgccaccaagacctctggcgctgctaccaccggctccgtgtcgtcaaggcggagggcgcgacgagcggcggctgttgctcgccattcggctgccactccctcgtcagcgcctccgacccgggaagatcagcgtggggggccagatgcccgcatcgatatcgagcgccggcgtaatggtcggcgtgctccccacgcaacggagggcgcctcctcgtccggagagtcacctcaacacagacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccataaactttcaaggtacatatccgcgcccaggtgaagaagcggacttacatgcagtccagcgaagggatgatgagtcacttcgctcatatattcagcggttctgtcaagtccgcaacaccataccatgcatccctgcacacgcggtgatctacgcgttcaggaggggtgtgcggcacaaccgcatgcttgaaaagatcgcctccaaagagccccagactaccgcggagctttttcagctcgcggaccgagtggctcgcaaggaggaggcctggacttggaacccctccggttccggtgtggcagcttcggccgcccccgggtccgctgctcggacagggcggcgtgacaggaggaggaagaaaaggtcggcccattccgacgacgagggtcatgtcctcgccgtcgaaggcgtttcgctggccacccgaaaggggaggcctacgagcgacaaaaagaaggaagccgacgctccctgacctcggctacttggaagagcgaaggtggcgcgcggcccttacagccgcgcgctaccagcagagcctgcggcgctaccatcagcgccacgtccgggcccgatcactctgcgtcgatgacctcgtcctacgccgggtccaagcgcgtgctggattgagcaagctctcaccaatgtgggagggtccgtatcgagtgatcggcgtccccaggccgggctccgttcggctggccacgggcgacggcacagagctgcctaacccgtggaacatggaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccctgggacatggtgaactccgggggggaatcggcaaaaacccacaatcgggtcacccataaccctcggtcaccatgctcccggcctggccagtctcgacatgtggatctccccaggcactagccttgacccgcgtcgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcgtataacaagaagggggcccgaaggcctcggaagaagaaggaaaagctattaagattggcggaggcctaggggctcactccgacgcgcccgggtagccggcctcgccgtcgctgtcgtccgcaccgtcgtcaccgcactcctcgtcggagttgaaggcaaacgcgagccaaggggccgctcattattgtcggtcggttttcccttgctgatgcgcgcgatttgcgatcgccgggattctgcccgaagagagagagagcagggaggagaggcccccgagccgaacggcggcccaaggcccccgacggccggagctggccctctgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctgaagatgtggcccctgacgaagaagatcggccccgccgaaaggtgcagcggcccgtctacttcgttagcgaggccctccgggacgctgagacccgataccttcaggcccagaagatgctttacgctatcctgatagcttcgaggaagttgcgccattatttccaggcgcatcgggtcacggtggttacgtcttatcccctcggccaaatcttgtataaccgagagggtactggacgggtggtgaaatgggcaatcgaactcgctgaattcgatttgcgctttgaaccacgccacgcgatcaagagccaggccctcgccgactttgtggcggagtggaccccagctcccgagctcgtctccgcccccgaggccagctcgggcccatcgcagctgcctcacaccgccctctgggtgatgtagttcgacggcacctgtaggaaccggccccacctatcaccaggccttagaagtggcgtcacgcccgaccgcttccctcggggagggcgatcgccctggcataacgccaggggctactgtcggtgacatgggaccgggagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgtaggttttgcgccgcgtgtatgggttaggtgagcgcagcggggctcacctaaccgcatttattggggtttgga

SEQ ID NO: 74691 - DNA, 640 bp, Oryza sativa
cccgccgaggcggagaacggaacatcgacgacatccgagctcgagaaggattctaatgcggccaaaccttgtcgttccgacatgaaccgcgagctgacgaagatgacttccgaagtgacaaggtcctggtgtcctatccacaaaaccaggaaacacactttgtgtcacatcctgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaactcttaataatacaaagaacagttcagtaattatttgatcattaatgatctaattataattgttaaagagcttttcttgtttaaaaatccttaaattataaattgttgtttaaaaggaattattagaaatgattttaaaagcttataagagaagatctaattttaatttggtaaaatctcaatataaaattgggctagataaaatttcattaaatactttgcttaattctataattcctagatttttctgggatttatttgagctaagga

SEQ ID NO: 74692 - DNA, 10079 bp, Oryza sativa
aaattgaaggtcacaactgcatcaccatctactataggcccaacagccttgtcactatcgtcaacaatcacaaatgggggaagatactgatcattagccttggtctctgaccggagtgttttcacagcttcaacagcgttttggaacttgtgaggtgcttctccaagcacctgagcatcccatccacgtttaacaacatcccagtcattctgcaaaattgagatattaaacaaatagttcaatacttccattagtacatattatcccaagtcagaaagagttgcaataaaaacagaatgcagctgagagataagatatgagcaatccaaactgacagagaggaaggagggtattcatacctcatatcggtccatggtaacatacatccttccaccacctgatgcaatgcacgcatcaatgcccttggcacgcagttgagaaagatcattctctagcgtttcaacaaaaccaacgcttgtgccatccaaaacatcacgtccatcagtaagaatgtgaacacggatttttttcgctccattcgcacttgcaccattcaggagcaactataaacaggaatgacaaaagacaaaaagaattagatactggacagatcaacatgttgtaaagaaacattagtgcctcatactatacaagatgatagcaaactatagaaaagagtacttttatacctgcaactggtcaagccgtgagtggacacctccgtcgctcaacaacccaataagatgaagagtgccttggtcaaaactctccttaatgtacttaaacccttctccttcaaaaatttttccagaggccaaagcagtatccacaagtttagccctacaaaagaaaatggagaacatggtatatttagaggcttaagtctgaggcttctaacttctttcttaaaagaatgatttcatatacggcataatggcaatgtctaaaaggcaccacatggatttagtaatttaaagagaaaatttggaataacttgaagtacacagcaccacgagtagttggcatgccttcaaaaagtcgctgcatgtcaagtataacatacaactcaaacagttgttcataaaagaactacccttcatctctaaagtttgtaaatcagtacacgggatatctttttagttagtactagtagctgctaaaggaagtgcatgatttgtataataacatgagatagtaatgatgatatctctttcatgctcatgtggtaatccacatcatttggagagatctgtgtaaatctaacacttaagatgccaaaaggaaccaatggttgccatttgattttactaaatctggcacacaaataagccaagcaacagaaacctgatgtaataagacctttagaaacaaacgcaatactttttggccatccacagattataactgacagtgtgctaataaaaaagagaaccaggagaaacatgtacccttgagcaaaaatccgaccagcaccaagtgcgttatgcccaacctcactgttacccatgtcatcatcagaagggagaccaacagctgttccatgagcctttacaagcttccacttctctggagcacccttgaaacatagaaaacaagataaaccatgaagttaagtaaaagggtaagaacaatcatcataaagcgtttcaacaatatcatactaaacttgttctaatatatgtcgcaaacaaggtcagaatccattgcctacaactcataatggaatgttagtatgcacggaacatgcaaagacagtgatccaggtaccatacttaacgagtacagtatttcttcactgtgacaatttgtctaaaaataccaaccataccacccacaaaatgtactagagtcaatttactaagacaactacatgaaggagaagcccctagcaaaggtagggcgaagataattggttggaggaaacaaagaatttgtgcttcaggtttcacctgtcacctaaccaccacagattcttcaaaaacaatacacagcaaattacatctatggtggctaacctccaaggccttaactacatactaaaagctaagaaaatataccttcttgagcgaatccattgttggtgtctcagcaacatggatgcagttatactggtccgcatcagcctcaccccatccatccagtacaaccacggccaccggcttccccttagggagctttgggtgatcaggcaatgtccacgagaaatctgagcttcccatcaccaactaaacctaccaaaatcacagatataaagaaatcaaagttagaacatgaaattaaccatctcagaacacatacctgccacacacacacacacaaaaaaaaaaagaacaacaatgtcgcagcaatcccgttctaaccatcacatctcaacaaggtggctatcaagagcgaaccctaggtactcttcttatgggctcttcatgggctattcatgggccattatactaccgttaatcacagccgttggatttctttctcttcccaaaccctaattccccccccccccccaatcctctcgtctactcgacgccgcaacgcgtgcggcgcgcagccgcgcgcctccgccgcctcgtccgtgccttctcacctctctcctcgcgagctcatctcactaagtaacagtgtattgtattgctagtaacaattacagaagtagttggttaatctgcagctgatctcctatcctactcgaagcgatctatagagatcaaaaggggtattcccaaatagggcttagcatcacacattctccagaatcgttcgactcgaacaaaatcaaaccattctccaatcttaatctccatctctaaaccgcacaaaaatgcatctgcattggaatcagactatcgcgcacgcataggcaccgatttggttaaacaagccaaaaaataaaaaaggcaaaatagagcgcaaaaatgtgagggaaacaaatttaccagatctacactacaacagatttctgggggtagggaacaatccaagttaaccagattggagaaatcatagaaaaaaaatcgagcggagagttcaaagcgaggtgagatcgagaagattaccggaagagagactgttttttttttctccttttttttcgttgctatatttttctctggatgccggatgatatgaagccgcttggcttggagaggaggaaggtcgatataaatagagcgagtgcgattctcttctggtatttttgcagattagcccacaagattagctcgatggcaaatacgcccttccgagaaaaaaaaagcccttaattaccatgtttaactgctgctccgtacgaaattgactagagaatgagaaaacagctttgaactctgtgccttaattttacttttgaaattagaaatgtggtacgagttgtataaagagttcgtggaaatattattatgcgatgcgcaaagacgacttgatctcttgctatgcatgatcgacatatttagttaattaatgcttataattactaaattcaatgtttgacgcaattataaaaccagcttatctggcctcatgctttagatcggagatgatgtatttaccggttcataaaatataaggtgcattaggtttttacacgttattttaatgttgagttttgaatctctcattgacaactatgaaattaacatagcaagaattactttcaatgcaatattagcttaaatttttagaaaatacttctaaatattgacttatcctgttatccttaaattcgtgtctcgtacgcattgcctccttggcggcagcaccgctacagacctacagttaccgagtcccctgtgtcagttgaacccgacgaaattcctaaatacgctacgtaaaatgaaataatggataagcacatgattaattaagattatatttgacatagcttcgaatcgaaaatactttagagctggatatttttaactccatgaatctatggatctgaatttacgattacattgataatacatgtatgaatctattttttattttaaataaaatatgagaatttatatcactacagtttaatatacaaacttcaaatccatcgtgaaatgtcaaatagtatctaagtattagctttaaaaatttaaaaatgaattaatactttttaagataatttttctatagatttcttggtaatcgtgtacgaacgaactaagcaaatttggtttaccgtgcgtccgtgccatgcaatgaagcatcatccgtccaaggcgtgcaaatcacaggccaggattagggtccattcggccattcccccaaaccaaattaggcctactccatcctgatgaaattggtcgcctcaattccgccttacaacattttggcccacagatatttttccctcacgcgaggcgctcaacggagagaacttgtggcccaagacaaatggcccaatataaaaggcctaatctcatcgcttggtggcccaagccacccacctctgctatcttccaaaccaaactttcctccttccgcttccaaatcaatccccacagcgcagcagcgcacctccgcctcctcgccaccggcaagccgcacctccgcctccgcctccggcctctccaatggacgcgctatggtgcgacctcaacgccgacgtcctccgcctcgtccacaagcgcctcccgtgcctcgtcgaccggcgcaacatgcgccgagcctgcaagtcctggcgagctgccgtcgcggcgccggcgccgccgcagcagcgcccggtcccgtggatcctcgtgccgagcgccggcggccctaccttctcgtgcgccgtcggcggctgccgcagacacgacttcggcgtcccggactacgcgcgcgaggcgcgctacttcggcacgtacagcggcggctggctcttcctcaacttcggcaacacccgcggccacggccggcacgtcctcctcagcctccgcaccaagtaccgcatcggcctccccggaattgtctacctccacctgaatcctgaattcatcagggacatggtcatgatagccgcgaccctctcctcgccgccggaggacgagcactgcatcggcgccgccatcagctcgtactggccgcccgggatgaatggtgcacgcgtgcacgcgttctggcgcatgcggcgtcaggtcgctgtgatgccgactgctatcgagggcgtcatcggaccaattctggaggatgtcatacaccacaaggaagccttctatttcctcaccgcgcaagagcacctccatgttttcgcgctaccggagttccgagtaaaccgtcgcggccatctgcatatagcacccatggagattcgcagcttcccgcatgatggtcgtgattacgacggacgcgccgttgctcgctacctggtggagtcccgcgagaatctcctgatggtggtcaggttcgtctctgatcctccccaaatgccaccgaggacgtcggcattcaaggtgttcgagatggtggagctgcccatcaacaacggcgaggcccggtacgcgtggaacgagctggaatcgctgggtgggaggatgctgttcgtcgcgcgaggctgctcaaaatcctacgaggtggccgattacccggggttggggttcagcgccggcgtctacttcctggacgacgggagaatctacgacgagttcacggtcctcgatgacaccgcacggcgctacccctgcagagacagcggcaagtggctgctgggggcggcggaggcggacaacttcttgccggagcaagccctgtcgagctactcaccgccggcttggcttctcccctgagcgtgtgctcatgttagtttgatcgtcgtggcacaggtaatgtttgctgccgatcttgttgaaatctgcttacagcgagttgtaacagttgatattttcattcgtgatctgattttgcggctgttgatttgtccagttagtataatccatgatgtttcattctatttcgagccttcgaggcccattcgttcttgcaattgcccggccatcttttctgtaccttctgctaattttcgatgcttcgtgatttcagaatggagaaatggttgacttggattgcattagtgcatcattgtattacagtcgattctgcagtgtgagaatgcgtttagttaacaccagcacttgcctttttcttttctttttttttgaagaaaaggcaagctgccaattttcattgaatagaggagtaaaactgtacaaaggcgaaaacgagctcaggacctttggtccgagctaactaaaagaaagccaattatgaagatttttcgcgcccgctaaggcccaagttttggcctcttccttgattttagctagaagggaggtggtcgatagctctttttgctgaaaggttctgcggtttctcttagtccagatctcccatgcgaccagcaggatcagtgtgcgaagagccttcttgggtgcctcctggatgtttaaggtagcctcccaccattctaacaccgtggaggtttgctgccaccgacatggtttcaacccctcacacgccgtccattccgcaattgcctcccagattctctttgtgtatctacaacccgcgaggaggtgtagggcagtttcttgagatcgacgacataagggacatatggaaccgtttggccatcctctggttgctagtctgtcggaggtccatactctgtttggatgattagccatgcgaaggttttgtgttttcgtggcgcccaggtcttccaaattaggttattaaagttggtggctgtggtgccgaggagttgcacattgtaggccgacgttgccgtgtattcaccatggctggtaagcttccatgttattttgtcatcctcttgctcttctagttgtagtgtctgagtggcggtccagattgtgacaagttggtcaattaagtctgtcgtccatcctgcatttgacggcaggtccaaatcatgaatccattggtcggattgcaaggcttgctggatcgtcttgttctttttcttggatgctgcatagactagaggagctacatctttcattctccttccttcccaccaggccgaatcccagaagcttgtcttctcaccgtttccaattgttatgaaggtggccgccgcaaaacggagtttgtcggtgtcgtcacatggtgtgccggttcccacccaggctttttccgatgatttccattcatgccaaagccaatgcagacgcaaagctctcgcgaacttttctaagtttaggatgcccagacctccggaggcagtgggaaggcaggttcgtgtccaattgactttacattttccccccgtcaaagcttcctcgcccgcccagaggaacttccttctttgcttgtctagaacctcgagggactccttggacgcttttagtcctgtcagaaggaagacaggctgcgaagtgagcaccacctttaccagggtagaacgtcccgtgagcccgacgtgcttccctcgccagccagcaatacgactcatcaatttgtcatagagaggttggagatcgactttgcgcagtcggcctgttgtcaagggaagtccaagatacttcaatggcaggtttgctctggttgttggcgtgtcatggaggatgtcgtctaaatccaggttttcgcacctgatcggagccacatgtgatttttgaaggttcgtgcataagccagttgcttgaccaaagcgaccaaggagatcggtgaaggcttgtacattttctttgttcgggtttatgaagactgctgcgtcatctgcgtacatagaagtacggaagcgtactgctctcccccgcagtttgcttatcacccctagttcagtggccatgtccaataaacgttggagggggtcaatcgctaggatgaagagtagaggtgatagagggtctccctaccgtaatcctttgccatgctgattgcctctcctggtgtgccattcaggacgatctttgaggcggaagctgaaagtaggcccgttatccattcacgccattttggtgggaaacctatgttttgcaagagtgcgaggaggtagtcccacctgaccgaatcgaaggctttggatatgtctagcttgaagaggaggatcggtcgtttggtcctgtgatgcttcctgaccatgtttcttacatacataaagttgtcatgtatgcttctccctcgaatgaaggcgctttgattcatcgaaatcagcgagtgcattaggggccgtaagcggattgctagcaccttgtaaaagagcttcccgaagccatgaacaaggcttataggtctataatcttctattccttccactccttcttttttggggattaggaccacattggcagaattcaggaggctgaaatgcttgttccttgcatcatgcagtgcattaaaagcggccaccacatcgttttttatgatgccccaacacgacttgaagaacttccccgtgaagccatctgggcctggagctttgtcggcaggcatttcttttatcgctttgtgaatctctgcctcagtgaaaggatcatcaagcccggagaggtcaagcggtgtgtaccctaattccggccagttgaggtcgcaggaccttggctccggttgccccatcacatgttggaagtgttcggcgatgacaagttctttttctgcgtgcgtgacagcccaaccattttgcttctttaggcggtggatgtgatttttccttttccttgcattaatcttgcgatgaaaaaactttgtgttggcatctccttctttgatgttagtgatgcgcgcggcttgcttcttccttgctctctcaataactgcaaagccgaggagcctcctcttgaggcccatacgcagcctgtactctgcttgtgtcagctcacggtgctcctgtgctacatcaagacggtacttggctttttcttaatctaaccatgctttgcatcaactgaatttcaacgaagatgaattgcatctcttcagaggatccaagcagaatccttccaacgggtgctacaaatttcatactactacgcagtccttttcacctgttcataacttccaatgggttctgaatttactgataattaacaatgagatgacactatatacaaggagtactaatattgttcttaagacttgctattacaggtattctttcagcagtactctatagtccatagcagaaaacgcttctgaatcagatttacatgaatgcaattttatatctgatctgatgaattccatgaagtcataaaattgctattcatgacatgaattgcattagcgcaacattgtattgctgtcagttataatgcaatttgaaaatgtgctcaattagcagtgcttaatttccaagatagaagcatgttttgcatgaaatgtatttgcattgaaggtgaattattgcttctacagcctgctttcagttgcttgttaactgcccaagatgggactgaggctggctacagcctctcttttgaaggacatggattgcatatatttcataactcaactgctagtcttcttcacttgttcataattgtgattccaagcttctcaaaatatccgaactgagatattttcagcatcagtttgagaagcttggcatcaccgtcgaactactactcactgccggcttggtttcccaagtaagatgagctttctgccgatcgatctggatgagatgtgcttgcctcacatcgaggcgtccgtgtgatgttgttgtcgtgctgatcagtgaactgtttttgttgtttccgttccagctctgaaccttttctgtttttctttgagccaacttctgaagttcacatatttgcagttgttgattgtccagtaatccagttagtacaatgtacttgcaatgctggacctatcataacatcttcaagtattttagtttctggtatgggttggattgcattagtgcaccatgctgcatatataaagtggattttcaatgaggaggaattgtttctgcagctttctttcagttgcttcaattctcttctgaggagatctagtcagaaattcagaatccttggtggatgctacaagttagtttcaacactcagcttcttaatttgttatactgagataacatcgtcatcatgcaccggtttgagctacctgtgcaagaagta

SEQ ID NO: 74693 - DNA, 605 bp, Oryza sativa
ttgaagtcagaatgaggccgttcaagtctcataattcatctaaaaatatgatctacatgtgggattactttttatgtattgtttatttggtttttattagtctttttcctcgttttgcgtgatagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcacttatggttatatttaatggtagcttcacgatggtcaatcgtgattggttaattaattacttgccaactaaaacttgataatggcgggttgtgagcacatggttttgagag

SEQ ID NO: 74694 - DNA, 764 bp, Oryza sativa
attatggatatcatgtattcatgatgtttgtttagtacttaagcacataattattacaatgggtcgttcattgattgttgcattgttgtcccttgcattgttaactcgatggtatattgcttgcatacacacataacatccaacaaatttaatccgtttctgaaccgagtccgcaccatttccaacatctgaaacaatccgctcagccgctctgaatccgtttagaaaatatggtttaggatatggtatgaccactatccatccgaatctgctccatttttacccctatatactagtcatgtcactgctgcggaaaccctctttaaccccggtttgcaaccccctttaatcccgggttgcaaagcgggactaagattccggaactaaagatcgctatctttaatcccggttgaaatacccgggagtaaagatgcatctttagtcccggttgggaacaaccatctttagtcccgggactatggtttttttcttttttttcctccttcggttttttttcttttttttcctcctttcatgatcttagattcacagcacagatatcacaaattcattcacacatatcatcacaaattcattcacaacaccacaaattcattcacagcacatcatcggaaatttattcacataaacattcacaaacacattcacatatacattcacaaatcaacaacatccacaaatcattaaaaaaaatcaagaaaaactcaaacaaatcaaaatccacattggcatgtgccaaccgg

SEQ ID NO: 74695 - DNA, 42367 bp, Oryza sativa
cagaataaagaggagaatgctttcccccgggcactcgacgggccagggaaatatcggtcgctccaaatggtggaccagggttgtgttgaccacaagattttttctcaagatgagcaattacctttttctctcttctcttgctctatcccagttccatgcatgcatgcataaacgcatgcgggctaacaaaatgcatgttgttttgctaacaaaatgcgtgcatgcattaaatctattagcatgttctaaatattttctctaaaattatttattcgatcaacgatccgatcactgctatatttggtgcaattaaatctttacaacaagatgtcatatgattatattacaattaaaaaagaaggtttagaccattgtttttttatgtttcacgtgtcagatgccaacgtttcaattggaatttaaatttgttccacattttaagttttttgtgttggaaagagttgttctttatgttgcgtacgatgctatttgggtgtttcaataagtattttctagtatttcactagttcatttgcaaatgttgcacttcagtgtggtgtttttgggtgttccagtaagtagtttgggatgtttcaaaaattacaaatcaatgtttcatgcgtgatataaaaaatgtttcaattagaaatattataatatattttttgtcataaaaatataatcatgtgagatctcattataaatatttaattataacaaatataacggtgcaaatagattatgaatcagataagtaatgtaaaagaaaaggtgatttaaagatccactaaataaatcaattttagatggaggtaaagggtttggctactcagttttagatggaggtaaagggtttggctgctacaacatgtattaatgcagcatgtatgttctatgatacgctttaattaattggcatgatacatgcaacctttgctgggagccaaccagccagaggcatggggtgtccgatttttttgggtaaaaatcgcacgcccgacgcgtagtggctctagaataaaaaattccctattactcttaagtttcagaataaaaaatgacagaattattgtcatggacattgggctagaggcccgtggggccagcttctggcaagtggatagttcaatgggtactgtagcagcaggttaggagtagataatattagattgggttagttaattaagggtaagtctcaccagctacataactgttccggtaagcaatgttcttctttctaacctaagtcctcatcccctcatcgcagtgattatcctgtcatggcctcaggtcatgacatttatcaacatgatatccacactagtttataaacatcaaggctggcatttactgacagactacagataagggcaatggggcatcttatcctgtcatggcctcaggtcatgacatttatcaacatgatatccacactagtttataaacatcaaggctggcatttactgacagactacagataagggcaatggggcatctatcttacttgtcatgtttgtgttgatgcattagcactcttgtgttaaatgatcccttctaggatacctttgcaagaaactatcaaggatcaaaaatcggctaaacagaaaacatcaaaatactgaacgtggaaattgaatttggccaattactgcctagtttgtctggttttcagccagttaccacccagaatcgctgcctttgtctggttctcagtataacactgattttgtttgaatccacttgtctttctaacaccaaatactaacacatatcaatgggtactaatcaaatcaattatcaatacaaactagccaaaaagaaatcaataatatggttagtgtttgcatgcttaaatttttcatgctaggaaatttgtgaggtccaaattaccatgaaacatgtcattgaatccaatataaagtatagtaccttaaatctgtctggttcagccaattcaaagaccaatgaatcaccatcttccaagttgtggtgcatcgcaaaacctctccatccaccacttaggcctgtacggttcccaatgtagacagaatcaaattcaccaccctcttcatcctccaagaccatcttatactctttgggaggcagatgcaatttgcagaatctagttggaagacccttgtaggatggaaaagaaacatagctatgagtactcattgatcataatatttttaacaaaattagttaatgaattccatacaacgaaaccttacaagccaaaagcagctggacacatgtgatcgaaccatggtcttaacaaacgacgggttctcagggtctagactattttgaagtctctcagcttttttgaaagcacgttgttgctgttcataagaggcaactcttccggtgtaatccctcccctgctctgtgctcctaatcctactgcccctgttcaacacaagcaagtagccaattatattgcctggccacagccacaactatcacaaatctgtaaaccatatggaagtattaccttctacggcatagaaaactgttgagttcatcaaactggcacaataaaaagagcacaacttagtaccaacatttgcatgaaaataatctttcatcacttcacgaacaaaacaaagcttccttgcgctttaactctaagtaattattccctccgtttcatattataagtcgttttgactttttttcctagtcaaacttctttaagtttgaccaaatttataggaaaaatttagcaatattttgtacataaaatgaacatattaacaaaatatatggaatgttagtttaaatgaaactaggatcatgtcattaaggattcatttgggattgtaacccatataaaaaactggactcacaaacttgttctagaacatgactacagtatctgaatagacatcgcaaaatttcttcctaaatccccaacaaaagcaacactaccaatcaaatagcactagctttgaagtggaccaactcacattctctttgtacgaaaccgagttgcgcgccctcgatgaacgcctcacttcagtggccccaacctcaaacttcttccgcggcttggggctggcacgagtgctctgcaagaagacccagagtaaatcaatccacgataccagcaacccaaatcccccgcgtgtagcataggttgccgtaatcaccttctgcaatctcgccgcctccagcaagctcttggacatcttctttatgcccagatcctgcgcagaatcaagcaccgaaatttcaaccaaaaagaaaaaaagaaagataaattgatgctgcgacagtgcatccaatccacacggaatcggcaaaggggaatgcgtggaatcccgcacgaacatccatcctctaaacgaatcaggttctaccggtggaaaaaaagcacctcaaatctatccacgatccacaacgaggaacggagaaagagatgagagccaaaaaaaaaaaaaatctgaaacgcttgtgtgcacgggcgggcgggctcacctcgaggtgcttgaggttctcgaggacccgcttccggcgctcctcctcgtaggcggcgccggcggccgcgctgccggcctccgccgccatggctcctcctccctccgccgaaacccttcttctcccctgcacgcgactacgcgaggaggaaatgggtctctctcttctcctctccgagagaaaaaaaaatactaagagaaaggaaagagacagtggagtcgcttgttgccttttggagacgggcaccctctgggctgaatttgaaatttcgaattccaacttttgatgcctcggggttcgtgcgggggaatccgacgggccgtacggatggtgggcccgctggcagccttcagctgacacgtggcggtgccattctggggtgcgcggcacgtggggccataaaacagcctcgtgcttttgcgggtctcctcgcctcctcctcgtcctagcgaggagcttagggtgcgcatccatctgccactcacgcgaaaagcccagctggcaccatgtagcaccggtccagctaagagcactgtgagaggcctaacagaaccaaccgatacgctaatatgaatcccagcatttcgacctcacatgatcaatactccttctgtcccataatataagagattttgagtttttcttacaacgtttaaccactcgtcttattcaaaattttttgaaattattatttattttatttgtaacttactttattatttacagtactttaagcacaccttttcgttttctatatttaaaaaaaattaaataagacgagtggtcaaacgttgcaagcaaaaactgaaaataacttatattgtagaatggagggagcagaaggtagtatagtcttccaatatctattactacataaatgtcaagtagcaccaaagtacagtggccttgatctctctactaagacataaattaaagtagttcatgtagtatctgcaacaataaaagctactacctccatcccataataattacatttctagaaaattagagacaaattaacaacaaacacaatttaccacaataaccctatttaataactatgctgcatacgtatattccatatgtatacttgattaataggaaggttgaggaacacattccatatgtaaacttaattaaaagaaaggtttgggtacacattccatttgttgcgtcccatcttatcagaaatacaatatttttaggacaaaatttaaatggtagaaatgtaattataataggatggaggtagtaaatcacacgtagcattgatatgtgtctcaatggatcaaagcggtactgatatgaaagccaagtaacatgtatccctgtcatggatcgaagcactactcaatggagtagtattcctgacatctatcccaatagacaagtaaccctcacactatacgctatgtcatatcacaactacttcatctataagtaaacacatggcatctacaagtaactccctcacatggatgtgtctgacacctatccatgtgaccaaaaaaacattgtgactccaaaaaggtggcttgcactgcccaaaaaattgactcctttaccgacctgcatcaaacaaataaattttcagtgctagctgagtttttctacaagtgtcctcagttaacgaggacactctagaagtgtcttacattgtggatgccttaaggggattagcagtgcgccacctatttttctcagcctggggctgtcacataggacgaagacacaagaagaataatacttgccacaagtctcacagtgctacatagcctcaaagagtagccacacaaataaaaaaaatcatttctttctcccttatcctcagtccgctccccacctacgcgcgcttctccatctccgcccacgcgcctcgccccttctcctctcgccgcacttccccttcctcctccggcgcggcggcggcgccgaaccacccagttgcggcgtcgagcggcgcggcggacgggcggcagcgtggagcagcgcagtggaagggtggcggcacgaacggcccgagcggcaacgccagaactggtcaacggggtggctcaagcgcctcccctcctcctcctcttctggcgccgcggatcgaggggcagcggcggcggccggcgggacggcccgagcggcggcggggtggtcgagcggcggctcacatgatcaatactccctccggccacctccctcggctccctcccctccccgtcccctccggcggcgctgggcacaggcctcaccctctcctcttcccggcggacgacggtggcggcgccgccgagctcgccagatccgtcctcggatggcggcggcgccgagctcgctagatctgccttcggtcggcagcaatgacgacgatggtagtggtccatctttccttcctcccttctctccggcgagctcgggtggtggcctcgccggcgacgcccgtcgcccccttgcatggggccatgccctcttcggcgatgctctcctctccccggcagcgtcgggcggtggaagcgagcggggtttggggcggtaggacgacacggcccacgagtgtgggccccacctgtgaaacaaaggaggaacggggagccaaagttggctccacggtcttgggcaagccgcgtggattgccgacgtggggacgaatattccgtttctaggggtgaggctgaatgccacatgggagcattgtgaatggcctaagagcaagtttaatagtataatcaactactaactccaaatcatctatatccaatgtaatagccaatttatacaatagttgcttgctacactattaatatctggtcccacctatcatacacatattacgtcttggagtccgtgctgcagctggctacagatatgtagcccgcttctcttctctctctttttttatctctttaaaatatgtttatagctggcttatagtctgctattgtacctggcttataactactggcgatcaaacactaaagcaatcactataaacaaatagactatagtgaataatgatcatgtatgctaattagaaactaaccaagaagtaattctcactaagcaaatcttaattactcataatgatatttctattaaagcagagtaattaacaagatacaaaagtaggaggagattaccgacaactccgggatttctccgatttcttctaccttactctctccctattctaatatacaataaagtacactagagcctcttgtaattcagctcatgctttggtggttcgtcacccgcatccaaatatacaccaacacttgtgtaaatggttagaaataaatcctaccactacgttggatgctttacttttatggttttatgcaggtattgacggcgttaatttggtatttaacagccgtcaacaacgggatctctcctagatattcgttcgacagcatctacctctcctacgacggcgtaatttggcgtaagtaagtatatgtggtattttcactcaaagcagtttggaatatagggtttccccaaaaaagggagcttttttactatcagtttttataaatttgtacagtttaatatcacaatatttatggtttttatattctccacgcgaagtattttaatagtatataatccacatgttattaaactatataaatttctaaaattgctagtcaaaagatagaaatttcgacttataacaaagaatgacgatcgatttaaaacgcaagtactaattgttgagaaaaaaatactgcggtaaacacacagacacgctatttctactagcacatttgacaatatgggccaacatatcccatgatcaaccacgtgtcaacgagtactctacttataactaaagaattagttagccgtaaatataaacacccacgtaaatctgaggagaactgaggaacttatcatcccttattgatagagatactaaggagtaaggacttccgttattgataaagaaaaaaatggtgagaaaatatacgctcaaagggattcgaactaaataggcgtgctgctcctagcagctccctgctagtcaagctaggccccgctctcaaatctatgagttaaaacttaaatagactgacttcaccataaaaaaactaacagagttatgctctgttcgctgcattgttaactcatcttggttggaagacatttttagctaatgacaaataacatacaagttaacgtccgtgtaactttcaaaagataatttgaggataatcttttatacttctaagtaacaaacttagtatttcatattggcacatcctaatactacgaatttggactatcgtactaggttaattatattatgggacggagggagtaagccgcagctgagttgcttcagtgcaggcgaccagaatgatccacaagtctacagtatcatatcaaatctgaattgttgaggactcatttggatcacataaattttacagcattcttttataggatttagcccaatacctccaaaattactttgaaattcctccctttttgcaggcgtttcgtcttctcgctttgaaagccttgttcagcttagctaaaagaaagtttagaagagcattgtgaatctaaacgggggaataagcctcatatcatctactccctccgtcccataatataaagaattttgagtttttgcttgtattgtttgaccactcgtcttattcaaaaatttttgaaattattatttatttttttatgacttactttattatccaaaatactttaagcataatttttctttttttttgtatttgtacaaattttttaataagacaagtgatcaaacagtgcaagcaaaaactcaaaatccattatagtaggggacggagggagtatttggtagcttatcagccacgactgaaatttaaattttaaaattgattttaggttttcttaatcatattccattttttacattagcttttaaaccactaactaataacggagacatacagaaaaaaatatccataaattatttctactgcttattagccatagctcaaagcctcaaacgatcaacatcttgctttctaatgtgtatcactgtatcctaacatcagcagcaactcagcaatgaaagaccttttggcaaaatttgctacaggacaccgaaagattgtggcctttgttgtgagacacccgaagatcgtgtatttgctcgtggacactgtaaaaagtggtaattagctactagacactcctattattttattattttcggttgaaatggagagagaaagagttgtgtaaataccaaaataaccctttgacactgttcttcctctctctctcttcttttcttttccccttcttcctcgcagtggagcagaggcgcgacggcggccacagcggggcggcggcggcggcgcatcgccggggttcaccgccgacagtgacgacgcacggcggcatcccggtgcatggcttcctctctctctctctcttcttttcttttccccttcttcttcctcgcagcggagcagaggcgcgacgacggtgggacggcggcggcggcgcatcgccagagcgcgtcgagtacagcaccgtcaagccctagctcttcgagtggaaggccggcgccggtgccactgccgctggccatggcgagtgcgcgcgggtggacggcaatatactgacctagattggcaaggatctggcgccgcctggacccttttggccggccacgacgccgcccggagctcaacccagcatgctcgccatggccactcacctgcatgccgttgtcccctgcagccaaactccgtgcggctggcgttgcagtggcggcgatggtggtggcctcctccgctcttcctccgcctccatggacagctgccaccagtggaggtgacagagtgggggacatcgatgacggcgagaagggagaagatcggtaccctttcgctgctgctgcgacttcttgttgtgcttcagccatggaacaatctgctgttctgatgaacaggccatagcctgctgctgctaatgctgcttcatggccacggcggagctcggcggcggtgcaatgagagagatgaacagagaaagagaggaagaagagagagagatattgacaagtggacctatgggcaaacttgtttttaaccaaagtttctctccgtttccaccagaaataataaaataatacggtcagtgtccgccaactaattaccacttttttacggtgtccacaagcaaatacacgatcttcgggtgtttcacaacaaagggcacaatctttcggtatcctatagcaaattttgcacatagaggacatagttatcaatctaagtataactgtaaggctcaagaatattccatcttgacaaatgcttcgatagcagcttgcaaacatgttgctcagacaagtcacccaaggcagacaaatccctggtactctagctcacagtaactaagaattcttcacactatcagtatctcagcactaccagtaataaataaatcaaatgttctaattatacaaccataggggaggatttcgcctcgctactcatccatcatctgtcagttatgagttaaaatgtcacatggagatcaaaattctagcagtaacagattgccgcgcgaatgccaacaccatcatgaaagctttgctcatgaaaaatttaagttgtgaaggcatggattgattgatttctcttggagggtcaaggaggaggaggaacaagcatccagtcattgtttcatccgtttcatgccaccattactgaatggagaagcactaccaggatgtgggctttcctctctaagtggtgagttcaacaaagcaagttctcggagttgctgtctcttgtagtaatcttgcgattcatcctatatagcacagcgtgaaagaattagcattcgaaaagaggcacgaaaagtacgtacgaattatgatttcgaaagacaagtatatgaagtagaaatgtgttagtactaagtagtgcactacaaaacacattaagataaaacagctgccgtaggaagatggaagttgtgaaaatgatagtgggagaaaagagcaagctatgttcagtttattacttattaattgcaaatgtactaacacaaagctcttttttttgttgcgatgtttggatgttaatgaatggaaagaaagataactgactcaagacaatatgcataccactggtttcaacaactcttctaggatttcttgtgcttttgcgagtctagcgtcaatgacattggcaggtaactcggcttcaatcaagatatgcaggggatcatccaagtgttcatacccagcccttcccttaagttgctcctccttttaagaaatgaaaggaaccacatgtgagcatcgttagcttgccaaacaatagaaacagacaatgaaatagccatttaaacacacaaaccgtatccactgcatagttccacattgatattccacaaaaggtgggttttgtttaccttgttagggtctttaattgagccctttcctcttatgaaaacacgacaacctgtagaggcctcaatcctcttcaacgaatttccccttggtccaagaaggcgaccaataaaattgaactaagggaagcacaacacagtgagtaaatattaactccaaatacacaaatatgaaaatgaagagcatacattagggtaagcatctgtcggtatttccaaccgcaagatcttcttgacaatgtaagaagagggactttgtggtgctccttgccaacctggtccttgagagaaacttactctctgctcaatgtgagaataacaaggttaggtgccacaggagttagggtatggagaatacaataaatgtagcactgaacaagaaggccaaacatagctgaagatccacaggaaatggaaccatagaagtaaggaaatcagcctgatgttcttataactagctatgctattcatccctagttcataaaatctactcaagaatatgctatgaaatttcttgttaagaggcatatctatttattcccgtgcgactacgtaatacagaattgagttgcaaaaaaaaattaagatcttgataataagtatggcaatacatccttcggtaaaagaatagttacacttcctaataattactccttaaggtcaatattacttgtcatttccgacaagcaaattgtcctaaaagcgggtcagttcaattgtctgaaacgacatatatttccctccagagagagaattcgttaagcattttaagagttaatcatatgatttgctaaatgttattgaagttcaccaatccagttgcataatataatttgaaaggcacatggaaaaacaaggaacgaaaaacaacattctctgttggaatgtattggtagtagtgccacatagaatggaaagtcaaggtttctcaaccaacttaacttagagctctgaacactctcttcattgcatttgcacaatgcagagactatatgatttggacaagagaagtaacagtttagggcaggttattcgtttggttgcctatgtaaggaagatatctaagtattttgaccacactggcacactgtccaagaaatggccagccaaaattggtaaactttaattttttttgccaggatgagaaaaataatacgacatccattgctctgttgctgtaaagcagtggaagtgttgtaagatagagggacttacatcagagtctctggactgatgattgtctgctattaggagcatgataggtctaacaactaacaccagaagtgacagtgctgaacaaaaaaaatgtgcgccctatggtaaagcacaatgttgaggtgactgagattatgtgttcaagtcacaataaagtcttctcttccttttcttctgaaggaaactaatcctctgaatcaaatatgggtagttccacatacatagcatcatttgttttttcagagcgggcagtgctaatgatacaaaatagttgtatataacaaaatttcttcattctaaaaggattttaacgactcaagcaccagagcttctggactttgaagtttcaatgttgcactcgtttctcttatatcctgaatgaaatagacatggaaagttgcagttcttgatagctctttatataaagaaaatgtatgcatactttagaattcgtgtatgggatgaaatattaaagagaaaggagagtataaactctaaacaacaatccgcgtcttacattgatataacgtttacaggtattgtggcgataacttattcagaagtccaaaggttaagaggcggcaggggagaagtggatcttgcatgacaaaagtcaagatgagctgatcaaaatgttacccattccaaataaaaatcactgacctcttctataaaccacacgaggttcgatgtagaaaagctatatgatggccataggctacctgttgtgacatgtatagtaatcattcttttaagggtatacataatactctttaaaagccagttttacttcaagaggaccttgatggattaaattgatggcaccctataaattgaggaccttgcgcattcatttgtttccatccttgcatatcgcaattctaataagtataacgcaacttatcagtgatattttacatagcagtccttttgtagaaatgtttaacagctcctgcagattagtgatcaaatacgatacatgactgcatatagcgtgttcgtgtacttggataactaatgctcacctctggacgcatcccattccatggaccaaaagcattaccacagaaattgggcacgatgtgcgacggatgcatctgatttgggcttgcaggttgcgacctctcgaagtcccctacgccgggttgccgaaacatcccagacactcgcattatctctgtcagcagcaaaacattagcacatggcatcagcatggacacacatgaaaacacttgattgccactgaagaaaagatacactgatacagtctcttgtcaagaatcaagctacaacctttcaagccctacgaaacacactaggattgcgcatagaccccgatcgagctaagtttcgcatcatcgagcagggacgagcaagagcaaattagccaaggccgtggaatcggagaagacgaacactccaatccgatccaagaatgctatccactcagtaagcagggcgagcagagctcctcaccttgattcaacagcctgctgcagattgggagcacctgcatgaacggccccagcttctgatgctcctgcaacaactccgccaagtactgcctgcttcaccaccaccaccaccaccaccaccgcaatccaatccaatccatccatccatcccgagcagagccaacaccacaagaaacacaaggaacaagccgcaattcagagaaagaaataattccttctgttgtgttctccgcgcaagaagaagaacaaagaaagaaaaaaaaaacacaaaatcaaaacccaatcgtggcgtccggtccttacccgccgctggcagcgtcgggcgggacggggggcctgacctgcggcgacatggcccgcccgggagagaagcagccgtccgtaccgtgcagcccgtccatggcgatggcggcggcggcggcggcggccccagccacccctcggattggggaggaggaaaccaaagaagggacgggacgagggggaggacgggggtggagtcgagtcgagtcgagtcggggagggggagagacgagagagaggtgttggttttcgcctcgtattctttttcttttctcggtacggtggcgaggtcccctttttaggaaaatctcggcaaaaccccccctctgcgctgcgcagtgcgcacgacgtcgtcgtcgtctcgcgcgcgcgcgcccgcgccgccgccgtcacctgcttcgccggtagggtttactataaaacgagagccccgtcgtgagtcggcgagaccgcgcgagagcgatgagatatgctcgtacgacgcggcggcggcgtatctggcctgcgagtactttgccagttgccattttcaggttacctatcttcggtttcgtaattcctaggtctgtttagattttaacttttttcattaaatttttaacttttatgtcacatcgaactttcatacacacacaacctttcaacttttccattatgtcgtttcaattttttcaaactttcaattttgacgtggaactaaacacaaccttagaagtattatttttagacaacggcatgggttttattatattttttttgattttatatattatagtatgcaaaactaaataagtaaacatttaattttattaaagtatttttttgctaatctatatatcgtattgtaggatttaaattaaatattttagaattattgataatcaaagttaaaatagtttgatcttaaaagttaagaattacgtaactaaaaggaaaaatatgtggagtgtttttgtaaagatggagtgtgtattctttttcttttacaaaatagaggggcttttatctttttccagaaaaaatgtgtgtattatagattgaggttagtatgtttttttccttgaaatgacatatttgtgccatgctagatatagtcgatatttattgtatagtactattcgccattatttggatatatatatataaataaaagagcgctacgtaaattctcattgcacaaaagaaaattggtatacatttgatgttatgaatgcggacaataaccatatgtgtcacgctcgatagctgtgatgtgacgatctcaagtgcataagagttgatgatagctagctagcaatatatgacaatgcatatgtgttgtcttcagttgtacgtttggagatatacgctgatcccttgtcactagtgttagcatcgcgctatagtcgagaagtggcggtgttgttttactaacttatactaattccttgtcactagagttagcattacgctatagtcgagacgtggcggtgttgttttactaacttattacttagaaaacatataggggttgtttagattattatcaaaataaaccttaccaaaattttggcaagttgacaatattaccaaaattttggcaggatttcttatgtatttaccaaagtttgacaacaaactaaatgtagtcattttttttacaactttatccaaaaaaataatatggttaaaaatagcatcaatttgaacatgcccataaatattagtgtcatgttatgtgtcaatatatgacatatactattatatatggacatgtctattttgttcttttaaatattgttttgataaaaattcgttttttcaagttaacttttaaggtttctttttttgtccgataaaattaaataatgaagtattttatgtgcacaagagagttccaacattaccttttcaataaaataatgagataataacactggtggagaaaccgtttgtagtcccggttgataacccccctttagtcccggttttccaaccgggactacgaatccgggactaaagatcgctatctttagtcccggttcaaataaccgggactaaagatcgatctttagtcccggttggtaacaccaaccgggagtaaagagggggaatccgggactaaagaggggaagcgacagttcctcgagattttttattattattattattttgttgttgatttgctaatggctagtgttaatctatgtattttctcccgaatcgaatgagatgcacatcccaaatcaacatcacaaatcaaatacatcacaaatcctaaaaactacacacaaattaaatacatcacagattatacaaattatacatcttagatccatgcgatgcaatgaatcacaaaattatacatccagtgaaacacaacttacaaaaaaaaaagaaaaaaaaagaaatcgagccagcgcccggccaccgcctgcgcacagccgcctgcccgccggccgcctccacgcgcgcggccacgccgccgcccgccgccgcctcccccttcgcggccgcgccgccgccgcccgccgccggccggctgatggaagacggagtagaggggaggaggaggaaggagaggggaggagaagaggaaggggaggaggggaggaagagaggggaggggaggaggaagaggattggatatgagaagagcaagagaggggatgttccaatcttatctaaatatctgtctgggacttaaccgatcggatgtgggagagaaatatttactcccggttgataacttcaactgggactaaagatcgatattaccaaccgggagtaaagatcactcgatctgataccaaccgggactaaagtggtaatttttagtcccggttggtagtatgaaccgggactaaagatcctcgaccccctgacatacatctgataggggatgaaccgggactacaaatcatctttagtcccggttggtgttaccaaccgggactaaagatcaaaattttttaaactgggactaaaaatcgtttttagtcccggtttttaatggaatcgggactattgtgaaatttggtcgaccaaccaaagatggtttctccaccagtgtaattacaagctcggacaaatttgaaatttggcacggcctaaaaaatgcttcttcaaaccgatggagagtgaccactgtatgatggcaatgggcagcatcattttcaaacatggagtagcaatcgaccaattcaatacagagtaccattatcttaaaaaaaacagagtaccattttggagtttatcgttcgcgtaacgaaaaccacaggcaaaacataaaccggtggagcatgcaaggctgtataaccagccaaaattattgaactgaattataaggctgtcagctggctcgtgtcaggaaatgatatcacatatttattctgatttttttctctcctctttttcagttccaacctttgatttggttagcgatccaactggcttctgctaattctaccagtaaaccagacgttgtctcgaacaagatgcatctgaattgtctcgatcgagatgacgttggccggagcaaaagacagtccgtcgattaagcctgagctgatgttaactaagcacaccatctcatgatttttaataaggtgtcaatggccaattaggaatctgcaacctaacacgatatatacatggttggtgatcgacagagaattagatttaatgccaaattatcatgcatgtgtgtgtgtaattgtggtaccacttctttgtcacgtgttcctcacagagactgacccagctggtttgagagcgttgcagctgacccaccgtcgatcgatctgcgacacatcgaggccctaaaagtcaacaatcaattctagagtagatcatttactgtggaattcgtcgcatggatcacgatgatgtcttgtgtagtacttttatgatatgtctatcaaacgtgtgtagacgcctgttaagtgacacattacttatatttacggctaattattctttcagtgatatatggcgtatctgtcgatatcgatgcgctcatggtgagtccggggactttattaatttcaagatatgtcggtctaatattaagcgtgtgcgtgttgtgagcgcctacgattatactacagcgaccccatacgtacattgctacaagacatacgtagagtgttgttataaattgtacaacggagtaatatagatcgagtattcgtagaactgactgagatatgattatccaactctaagagaaaaagacttatgcatgttaagaaaaaatatgtaataatctcaatctttggaagcacaactcacgaatatgaattataatcaataataatattcttttttttcctatagcgttaactttcaacaacttctatctccgtatttactagacaaggaaccaaggttatatccaagatatagcttaaaaataactattaaaattattttaagatagaggtaataagttacaattgtattgaacaagtagatagattagggccaaagaaagcatgcccaaaaaatcactctctccttctacagatttcccatttctagatcccaatattttggttgttggccatgtaggcagttagtgggaccgtcgcatccgtggttctacgtcactatttgttggctgaccgctgccttctgcgttattgtctattagttgccatacgtcgcttctattgttgtcgctcaacttacactatcaatatgtacactatacgtcttaaccaatctgattattattcattcagttctgtatttttattattaacatgtgaaaattgtcctgaaaactattgtaatgtcaagcattaccaggtgagattgcatcaaacacaagacaatcaattgacttgtactaccaagtttggcctcatactggctggcgttatgtagagttggggccacactgacaaaggaggtgaagacggttcctgcggtggagagataggtgtgccctgcagtggagagggcgaaaacagccaacgaaaggagcggcaacgtcttgcagcggagcggtggaagcagtatagctggagaaggaagcagtgacgaccaacaacggagaggatgactgacgactgcccttaccttgaacggatagcgaggttgggcaatagcgggcacaatgaacgaggataagccgatgacaacctgacgagaaatttcacgcgacagttaaaaaaaatcacgtgggagttggattgggagcatcgatcgagttgcttcaattctggctcgctttgcaactggtttttggcatgaggtacatttgagaacgattttgggtatctgttggagcccagattttctaaccatcaaaatttagttttagggatatgtttttagcttttcacggagatgctgtaacgacgctgtcacatactaagggtctgtatggatctagggactaaaataggactaaattttagtccctgtcacatatgatgtttagattctaattagaagtattaaatgtagactaccctggactaatttgcgagacgaatctattaagcctaattaattcttgattaatctatgtgatgctatagtaaacatgtgctaattatgaattaattaggcttaaaaaattatctcgtgaattagttcttatttatgcaattagttttattattagtctacgtttaatatttctaattagtgttaaacatatgatatttagtccatgtattccaaacaccacccaactcctacacactaaacatcatcattgcatcaacgtcttctctagtcctaaagcctcacttgcaggagagttcatagcacaggggcactggggatcataatatcatcggatcatgcgagtccaagagcgaatcgcaaatcgcaccccggccagtcgacacgcgcgcgccgtgcatggcgacccaccgacccaccgacccaccgaccgagcgccacgacaaaaacccccccaccatcatccctgattctaaaacccggcttccgtacatcggaaaccggggacgcccacatgcgcaaacccacggatcaccggagctcgcaaatattttttttccttttcggactgggtttctcgcgcacgttcgcgcgtggacgcgtcgtcacctgcacgtgccgctgccgctgccgcacgagtactcctacgtgcaccggcattggatgccctgcgttttttagcggcagcaagtgttgggggagccatgagtatgtacgtggaattaaatttggaaatatattgtttatttaatttttttttctcaaaaatattcgagatgcaaaacttttttcagaaatatatcgtcggtctcgcataaccgttgcacgaaaatgatatgggaataacgttatgggtagtatcacgcggtgaaagcgcgagaccgcgtggcgcgagaccgttcggtctcgctgaagcaataagcgataccgatgccatgccgatttaattagtgattaattatcctaattagtgattaattactaattattatattaattgttaattgagtaattaatcactaatcaaatggagatgctggatagtgccgctgtttgatttggtgaaactgttcggtctcgctcttctattccgcgagaccacgcggtctcgcactttcaccacgtgataccgcccgcgacgtcacgtctacgttatttctgtggaatggttgtgtgagatcaacggtatatttccgtaaaaaaatttacatcccaaatatttctgaaaaaagaaattgaatgaacggtatattttcaaatttaattctatatacgtgtacgggtgtacatgtgggcgtagcagttgggaaaagcggggggtgttgctgatgcaatcactctcccgctagcggctagctgccccagcctcgtactaccaggctaggaaaaagagaaacagtgacgctgtagaggagttgtgaaaaaagcagtggagatggagatcctcgataggttttgtttggttgcttttttgcctgcgacgcccacgcagcttgttgtagcagaggcgaagcagactgactcccaagacaaaagcgtcatctccgccgtccccaccgtgtctgccgctgcttcggcttttcgagctcggctctcgcttcggcggcgtcatggtggcctggcgggtggtgacttttcggcacaaatccagccgaccttgtcatccacccggccgaatccccaacctaccacctccgcatcagtccagtccctgctcccacttgggcgttgataacctaaatgtaaatgctattcctacattagaggaaggtatttctctttgagcagatacaataaactattttagctagtgatagtgtatccacgctgacgttattgatgatcaggatagggaacagggtgtgagccggcgactaattagttgccaactacacacgagctccaaggcgaaagaaacaatacaaaagagcaagatgaagcgatgacggcgggagcaggctgtgacgcgagatgccaaattaaaaaaaatgatatattaatccattgaagtttgtgcatatagccggctgctgtactatcgatgagtgatactcgtggatcagatgagttgagtattggggtacgttggaacgagggtctacgtagtacgacatcaagcagataaaagacaatgattatactggtttaggccccctatcgggtaatagccctagtccaatttatatgggatttatgatgatgagaacagattacaaatagagtagtcgaatcagacgatactgacgagattgtagtcgagggttttgacgagatctcccggcgacttggttccacgtactccggcttcgtaaactatggtgggtgtgttggcgattgaattgtatgcctttcatcccccctgggggtcccttttatacagtgaatcatcttgacccccaagaaatacctgaggatatttgatctggtacgataaaatataaattctatcccttccgaataggactttggaaatcgcttgactcgtagggatattttccataatttggaacatattctttatgacattcatagggatgatccgtgtacgcgaaggtataccctgtcggtatattccataagttgtaggatatgaggtatgccttatctgtaaccctgacatgtacgtattagctttttctgtctccgctattgacgtgttcttttttactgccggcagccatcgcccattattgatcttgctcttatacacacaatcttttcatgtatatttattaatacccacaaactaacaaatatcatagaaaattttatatacatactttaaatagtatgcacctatgtgtaaaattttattttcaaatttattatactttaatcataaaaaataaaattctaacatagttttaccctttaaactgtcagaaataaaagacgatgaagagagaggagaggggacgaagaagaccgttcggagagaggagagagaagaggagggagtgagaatgacatacaggctccacgtgggccccatcaattttaatttttttaactgacacgtgggtccatagtttttttattatttttcagattaaattgccacataaacaccacatcattaccacgtgagatgaagaaatagtcgaataagccatgtaggcaccacgccagccgaaataggagataatactaccgagggacctcgtttggactggttttgtaagttgagggatgagttgtatctggttttttctttaaggaccaaaatcaaactggacaataacttgagaaacctaaatcgaacttattccaatgatggcctaaagtgggaatcacggcccatccaaggcccagaagatacggcccattactctacacccacaagtcgagcaccaccccgtcggcctccacgacgcaggtcccaaccgcttctggcggatagcaagctaggctcgggggaatctcgccgtcgcatcaccgccgccgccgccgcccgccggttcgatctgagaagccgccacctcgccgcccggatcccgatggcgcggcttcactggctggaggcgatgctgccgctgggaatcatcggcggcatgctctgcatcatggggaacgcgcagtactacatccacagggccgcgcatggcagggtacgcgcctcctcctcctctcccttccgcctccgcctccgcctccgcctccacctgatccgggaacccctcgcgttctgacgacctttcgcatggtttggtttcgtttggatggatgcagccgaagcacatcgggaacgacaattgggacatggccatggcccgccgggacaaggtgctcctccatcaggcctcctccgagaacaactaggtgcggatctgaacccatgccgctggagcttgtgctgtggtctctctttgggttttctcgcggggcacggcttatgtgatgggattggtgttgggatgcgggattctagggtttgggttcgatttgggaatgtggttaggttacagcgagtgccttatgcgcatcgattagaagatttagggtggtaatcttaggtctgtggctggaaaatctcaattatcgggccgctcctgctggaaatttgcacatttctagtgaggattccactgatggattgttatggttagtacagactctgtgatcatgttagacttgatactgcgatgatgttaaattgatttcatttcagtgggaataactacttcatactgctgatgacactgctcaggttcttccgttgtatgttggtacgaaatttcagaaaaaaaaagacgtttggttgggttgtcagagtggggtgatgatgttttgtggttaggagagccttttaagctgtgttgctcactatccagtcgttgtgatgaaacctgatcaagctttgcttcaccaatctgccttttccaaacttaatgaatattgttataactacagtctaggttgctgcttagttttctccccagtctccaaaaacccttgcaggattctaccaactcactccaataaaggctcagaagtggcgtgttactgtttatttggtcgctgaagtatattcgagagctggtatccccagtgttaacatattaccacttgtcctttaggtgcttttttgttttgtgcagtactggtggttgtcggcctgtgtttctttttctgtttgaactctgtatcactgttatgggcttggttttcatagctgggtaaggaaattacctaatttctacaagaaataaaaaagactcagaagtcagaacatggatcactaacacaacaactagaagaattgcaacatggtctttgttctatattcttcttgtttttcttttttgctatcttgtgactaaatattgttgcccttaatgtgcaacaaaccttctatgcatgaaccatgaataacaccggtgatcatggcaattctttgatttaatgttaccagtaccactccagcttgctgttgtttggtcacaatgctcaaaccactgtttttcaaagctaagacttaatagtatttgctttatggaaccatttttcttgtgtccccttgcattctgatcaattgctgatgctggaatcacactactagccataatatttatgttgccaaattacctttaatgtgattgaatgtattaagtccccattgcgttttgtatctgcagcatatgggtgggtactatatttgaaatcttcctcagaatattgaatatacagtagagctagttactagtattaaataggccgtgccaatatttggctgatcatggtgaaggaaatctcaacttctattagacagatacatctcatctattggcagaattttttggaatatgctctgatctgaaaaaagaatgtgtattatctttttcttaaagaaaatgctccactgaattttgtgatatttgtgtattgcgtcacttatctaacaatggaaaagataacagtttatgtgtgcattggttacatatttttctatttgttgccgtggtaatgctgactatatccttacccttcatgttgtaggatattgatcaacaatatctagcctggatgttgatgaagttatttcaaatgcccagaattactcctgttagtttccgtgtataatgggaagctgggcttatgtttttgtttacaacttttgaatattggatgaataatgtgtatctggaatctgtttaattacacaaagtgggtgtcgcttgtcaattgtgtacccatttctccccaggagctgatcatgacgaaaatatttgttgttgttgttgttgttgtgtttttttttctctactgtacaaattgagctagtcaccgcggtactggagtttgccatccccagtgacattgtgaactctaccgttgatgccttgggtcgtctcctgatagctgttttctgccaagagtgctgaataaatgaacattagcaggacttgtttcaaatgaaggttttctttaagaatttttcgagtattgaagtttgatatgaaaattttattttccatgacccttggattgtagaatggctttcaaaatcctatgcctaatgtttacatttcctttgcgaagtctaatgcaaagtctcactgcctctcctcttctttccacgctaatatatatttcccttgacattcctgagattttctgtaattcctcggccatgacatccaatcccttacatcttctcaatcatacatttttccatgttgcagaacacctaaataacttgaacatttcattctttatttaaactgaactcctatattcaaatcctaggaaaaagtataattactgatgatctcaagggacagcaagattggttatatggagtgagataatggcccaaagcaggaggtgctttattttcacaattaacatatggggtgagataattacgtgtgctaggaattacatgcaacaaaatgacccaaaaaattaataggcacaataaactctctacatgcacacaacagtttcagagcgatcacaagatgcctttcgtcaatgctcgttcttcatctctgtcacgccattatcgtccttgaagctccggcgagttggggtcgtcgtctctgctgcaccaagatcgtcattggagctccggcgtgcaggcgtcgtcgccgtctccggcgaaccaatgtcttgcttggtcgtcggcgtctctggcgcatcatcggcatcttcttttatgctccgtcgagtgggcggcgtatctggctcgtcgacgtcggcttccttcaagctccggcgagtgggtggcgtctctggcggcgcatcaacgtcggctttttccttcaggctccggcgagtgggcggcgtctccggctcatcgacgttttcttccttcaagctccggcgcatggtgggcgactcggcggcgcggctgttcgacctcgacatccccatcctgccggcgtggcccaacggcgactgcggcggcgtgcccaggccgccgccggcccacaagccgtgcgccgcctcgtgcgcccggagatgacacccgtactgctgatggtcgtcgtctccctcctcgccgtcgccgtcgccggccatgtcctcgtcgtcgaggtcgaccacgtcctgcatgttgagctggtggaactcgacgatctcccggaggaaccggttctccctggcgtacaccgtgttctcgttcgccagccgcgccttctccgccagcagcgtctccagctgctgccgtatctgcatgggatcatggggagacggattggacgtatatccgtttactgtatttcaattaaatagttataattttttttaaaaaataataagatagatcaatatgtaatatatctctacaaacatgtaaatttaaattcaacttctataaattatataaaaaaaataaatttaattgcaaatatttttaccaggtcctcgtcggcgtcgtgcttgccgtcccggagcatgcggttctcctcctccagctgcgcgcaccgctccctggagaaggccatgtcggccttcactgtcttcagctcccgctgcagcagcttcaccttggccgccatggcgctcgccacctgatcaccgccgccgccaccaccacaagcacaccatgaaattcagagagcgcagtcgcaaatccacctccggaacggcaacaaaagaggagggcaccttacgtcgcgagaagccttgatctgcggcgactccgtgtccgacatcgtcggcgacatggcctccgggctggacaatcccatgctgctgttgcggaggtccatgctgcaagccttcctcctgatgtgcagcttccggccatggacgccgtcgcccgtcctgctgctaccctccaccttcgtcaggccctcctacaaaaataaaataaaataaaattacaatattgatcatggcattcataaaatctctgaatgctaatcttgaagagaatgcgacctcgagggcggtcttgatcttgcatccaatgtccaagggagggttctcgggcttccggacccggtcgtaggaccaacgagattgcgatgtctgaaatccatattcagaaacaggttagactgatcactgatcagactgaacaagcaaacggaaaatgtcaaagttgtctgaattaagcctgaatttgcaaacaaagaatcgatttaatttgctgctccatcagcttgctaatcgggtgatgttcttgttgttccagagctctttaccacagagtgattatcatccgtgccgccgttttcgtcgagcatcactatggcttgctgtgccaacactccccagaatccgtgcttcgtctcatttcccttcgcgccgcgcgccgatgtgtacagctgagtgacaggatcctgcaattgttgagtagcatactgtttcacaaaatttcacatcgattttttctcaaattgattcacaaattcagaggaattttctcaaatttagttttgtatcggagcagcgcaccggggtggagccgtcgggctggggagacgaggaggcggcggcgagggagcggtcggggcggcggctgtcgtcggcgaaccgggtggcgcgcggcgacgcgatggccggcgaggaggtgtcccccggctgcggcggctgctggcggtggtcctccacgaaggtggccgacctctggatcccatgcttcctccggtacgccatggccggcgggccgggggacgggggaactcgagcgatcgacggggcgctttgcccgctctcggcttcgccgtccttggattggcgtcctcctcctcctcctgccttaggtcaggtggcgcgcgctcctcccatggccgccttccgtctccgcgccaccgcgcgcaagcagtggatggcatggcattcccatggccgttgcttcgcccgcgttttgaggccgcgcgcttcccgttggatcgcagctcgctctctctaggcattttgcacggaagaggctcctccgacgtactgccctcttacgtggctgatatgtgggtccaccagctgtggggcccatatgtcatcctctcaaagttagggagcagtacgttagaggatcacgttcctgatggtatatatgctggtttgggtaaaaaaaaattaagagtaaatttcataaaactacatgttttatggttcaagttgcagaaaactacacatattttaacacttggcacttaagtatatatattttagtagtttagtttcacaaaacccactattgatgaatggattgacccatgagatgacgtggttgttccatctaggatggggacgtggcatcctatcaatttcgtgtgatggctagtaataggatgccatgtcctcgtcctaggtgaaacatccacgtcatctcgcgagtgaatcaattcatcgatagtgtggttttgtgaaactacacaaccaaaatatatatacttaagtgccaagtgtcaaaatgtatgtggtttttctgcaacttggaccacaaaacgtgtagttttgtgaaatttactcaaaaattaaacaacttgaggaaatcattagagcaagtttaatagtataacctactaatagctccgattcatctatagccaattcataaaatagttgcttactatattattaatacatgattccacctgtcataaacacattacgtcttggagtctgtactacagctggctatatatctgtaacccgctactattctctttcatcttttatctcattaaaatatgtttgtagctggctaatagtcggctattgtacctgctcttaggctgtgttctttacttctttcccatgagttctcaactcatattcttcgtttttcgcgtgcacgtttttcaatctgctagtaaacgtacgcatttcatgtgcacgctttaaataaaaaaatcatattaatccattttttaagttttctatagctaattcttcattaatcatgtgttaatctatcgctccgtgggagggattcccaacccctccaaaagaacattcccaactcacctccttcgtgtaccatgtgcacgcttttcaaattacaaaacggtacgttttttttgcaaaaagttttttacgaaagttgcttaaaaaatcatatttgatccatttttgaaaaaagaaaatctaatacttaattaatcacccgctaatggaccgttccgtttttcgcatgttagaaatatattcccaacactagtaaacgaacacaaccataagttgtggatgcatgattatgactccatatatgaggattcacattctgatgcccataaatattatgtactgtaataggtttagtgacatcggatgtatgctgctggtttctgtctctttgagcatatgctacgaggtgcatttgtaggggtgttagtgtggtgttacgtgcgtagtggtgtgtatatatatctgttgcgtaatcgtaaaaaaacaacttaaaaattaaatttgtctttttaatttgaagttagttataaatatttggcgattatttacgcttcaaaattcgtgcatatttcagaggctcacaggtctcctggtccggggcagttcagtttggccatacgtggcgtcatttcggcctttctgcgacggtcctcggcagggctccccgtccccgcgagccgcgaagccgtaaatccccggagaggcatttcctcgaacacctgccgcgcgcgccgtccgcccccaaaaaccctcgccccaaaccccgcgccggccgaagcggcggctccgtgcggatgccctcccgtcccgtcccggcgcgccccggccggcggtagtaggaagtggggggcgccgagcgtaagatgcggcgcttctccccggccgccgcggcgctgctcctccgacgctcgctcgccgccgccgccgccgccgcctcaccagcgctccgctcgggtccggtaatctcttgcctctttttaaagaaatatttgttcggtggattgaacctagctgagcccgactgcccgaggtttatgcatgggtgattccgaggcctcgttgtgaagggagattgcaatttggacgattggaatttgtagagaatggggttactgtgtgattaagttaggaatttgtctcccattagttatccccgagttaacctggagatcttggtgtcttggtggctcgtgagagcttgcatagtggatttgtgaagtttgagccatgtttaagcatttggggattgtcgtatgatttactttgtgttgttttaaggttcattcgcacagtgtaacatgccttgctttgtggcattcaaattgctcatttgaattctattcgtcttgcctacagagacagctggtgcgtgcctcgcttcttgacgaaagtttgtctacacagacgagttcagcggcttcaaccatggctgtgcagtaccaccaatggtctagttcagcagacggggatgatgatgaggttcttgaggctttcaatcgggactgttgtaccgatgcaggtgctggtgttttggatgattcagcatctactgcctatgttgagaagctctgcacatcaggcaacctccctgatgctgttcagattctccgacatttacatgataggaagatccatgtaggattgggtacgtttaatttggtgctggagcaaacaggcgaagtgaacaacttcgttctttttgccaaggtgttcaggtacctgctgctttccaaaatagctcctgacttgacttcttatacaaatgttgcaaaggcccttcagaagttggatgactatgaactaatacttaaatttgtgagacaagttatggaaattacacatgatagagatcctacagtgatgaatcgcattgttttcaccacggctaaatatggacagattgataaatgtttgatcatatttgaagaactgaagaaagatcaaagagggttagatgttgtcacattcaataccattttggacatgcttggaaaggctggtcgggtggatcaaatgcttcaggaggtgaagctaatggatgaacttggccattctcctgacattgttacatacaatactgtaataaactgcttgcggaggcttggaaggttagatcagtgcaaaatcttcgcaagagaaatggttgagagaggcatcgatccagatttaagaacatatactgcactgattgatattttcgggcgggctggccatattactgaagcccttgaaatgtttgaccagatgaaaaggtcacatcaaccttcaatttatgtctaccgggccctaatcagtgacttaaagaaggctggacagtttgaacttgcacaaaagttatctgaagagatgaaaacaagtgcttcagaattactaggccctgaagattttaaacataagttcaagggtagaaagatcaacaagaacaagtaagaaaactgtcaatgatcttccaggtgtgaatatttcgtttgcatgtgccttgtgctcatccactgtttcagccaaagattctgggataagttgaaatttttcagggaatgtatctcattaacaatgagataatcacatgggcttacaaaagagtgatgattactaacagatacaatgatatcaggccgagagaaccagaatataaatcataaacctctttgaaatatcatggttggaggcttttgctgatgtgcatttgaagagacaggaacacacttctctcatttatatcttcacggatgcaagagattatctagagacaggtcctttgcttatgagacctgaactgtttatctgagattgttccaccatagcgcaaacttgagccaatgaagagttaattctcgattgaattatgtgtgatgtgcttctactggattatcatgtgaatgacttgtgatttgttcagcactcactggttcaatttctgcttgttctgcacttctacaagttcaatttcagcattgccattcatgttcagtgccgtgaagaatagttggagccttgagtaagttgtttaggtccttgtcgtggatcactagatataacaaattaaatatagatcacattcttttattgtcctctactttgccatgcagccaagtagaatattttgtactcatgtaaactgttagtccaaaggaagtggctaaatttctgtcgatttttcctcccattttattagttttttggatctttggattgcatatcaagattcgtgcaaagaaactgaggttccacctgttttgtttttttattcgaaccccctttgttactgcgcctcctcctttttgttttcttttcaccagatggagagaggggggaagctacatgagaggagaggtgatgggggcgatttcgtcgccggtagatcctgcagcggtgagcttcctgatccctcctgtcatttttgtgttgattttgtcttccttgtcctctgcaggtttcagcaatctatgactggaggccagtggtgtcgagcttggccaggcttttgtcggtgtagcacttcttctgtctgtaaggcccccctagcttgtcgtcccttctgaatccagtagctaggtttcaccggtgctctagttcttccttctcatgctttgttgtttatatgcattagggtggttatacaggtttttagtacggttcaatcctcttttcgttttgtatgcttatggactctgttaaatttttgtggcttagagattacactttcagttgtgctcctggctatttcactctttcccctgcttcatttttgttttgatgcataatattgtatggttaacatgcaaatgcaaaaaatcaaccaataaatggtctatgtgtttttctgcaatcatatatgcatttgattagagttttctttaccagagatgtggggttgattcatgattcccccctatacacagattaggtactttcccccccttcatcttttccaattcctgttgctcttcctcttccttgtcttcgtcctctctttttttactgttcctcttattcctgctgattttttcctttttttttgttttctagcaccatgttctgaatttttatatcagctgatcttttaatattcaaatagatgtccagcatcagtaccttgcacaaaatttctcaatacatatttttcatttttttgtggttttatatctgcttcagaaataatggttttactatatttcaacaactctagtggcaatcccttcgaattctaccttttatctgaacctgaattttgttcagtcgcaaacatgcttcgacaattttcatgttttcttgagatgatggtatatatttattttacctgcaatattcaatcaaacatctcacccttttacttcctgataacaatgtgaagataaatgcatttctcgagtacattaaaatgggagtggcattagttttcaagcattattctatcagactgcagttcctgaaaaaaaatgcttgatttgtgattgcatcaggtttccacattagagatacctagctttagatgagctcacctctgaagtcagcatgctcaatcttgagcgtgctaggcaaataaagagtcgactggtcgctatatctggcatagttcacaaggtcagcttgagcattatggtatatactacaagtatatgtgaacatttatacaatgatgatatggtttattgtgactttgtgagtaattctgaagtgtccgagtgctatttccatgaatcgtttgacaggtcagggatgaactacagtgctagctagatgacgacatcgacatgacaaagctcgcttaccactcagctggctgccagtcatcaagatttgacatcgagaaagaagcaagcgagctcgaagatagtaataggtatactcctacaagacaaaaaaaaaaaaaaatcttccacaagttgataagttggtgcttcatccaaccatggacatgacgtgtgcctgaatgcagcgccagggaggacgatgttgataagttgcaaacatgcttccacaattttcatgttttcttgggatgatagcatacggagtataagccttcattttatatttttacctacaatattcagtcaagcatctcacccttttacttactgataacaatgtaaagatagatgcattgctcgagtacattaaaattggagtggcattagttttgaagcattattcctgaaaaaaaaatgttgtttttctcgcctgggctgtgtatgttgtgttgttgagttgtgtattcggctttgtgggccaaaaagaacatgcgaatgttttggcaaagaagaatccagccattcttgaccgaggtggccctaaacaacattcgaatgttgggtagacaatccctattccctagtccaaattatcttatcgtctgttgattatttgttttttccacgtgctttcatgctatcctctgtagaaatatgccatggatttcaaattcacagtacgcttctctagaaaaaaaaaatctcctcttacataatgcacttcaatctactggtcctactaaaccaaaagcaagaatttggggatacaaggctctctattagttggagatatcctgtattttacgatcaaatgtacaagaggtgctgacacaattcctttgcctcatctattgttttcagcagctaaccaaacaaaacatacaatagcaggcctctcgcaattgtccacggcccggaaaatgcaacccgcagatccaacagggtcgcacttccaatcaccttgcactttgcagcaacatgtatttcatgaacatatcatattatgtcatagtgcagttagtatctacaaaagaatcagatgaaacattataaactacaataactcgagggacagcggaaaaatgtacaaccagacacagtactgccgacagcagctaacccaggaggagcatcatattcaggcacacacacccagagggggctcaaaatcaaatacctagaacagcatggtaagatataagataatccatcctgccatggagaagacagcaaaaatgtgcacccagaacaagattgcagctgattccttgccacaacctcttaggtttgcaacagcacctgcccataaaaaatagcagattagtattgcaactgtattatactcaaaggttgattaacatgccaaatatgatgtctcagtcatccttatactttttcgtacctgatagtaccgatgtgggcatagagtgctgcagtaacaggacgaacttgaacatcttgtctccttttggaataaatccaagcttgtcagcaaatgagacgatgccaataccagcaattggaaccaatatcaagcgtgcaaatataatcgcgacggtggtccgaaccccaagtctcctacttccttcaccagggcctaaaaccataataaaccacaagtatggacttcagataaacatataaattgcagaagtataaatgtactaaaagcacacttcatattgcagcacggttctaatgagatttgagaatacaagatgagcttaccgtcaacaagattgccaccaacggcaagcaaaatgcacggaatcatagcttccctgaaatatataaaacagcattgttagcaagagatggtttttaaatgcgaatcatatttgttattacaagacactataggcatattgcaagaagaaactacaagtcatgagacaggtcaatacccaagaatgagacagctatctgttaaaaagaatagaggcgcgtcatctgtgaggatcaaattcttcaagaatggcacaacaccgagagtaattgcaagaacctgttacatgacgcaaaggaacattcagataattgagaaaaatgcaagtattgttttacggcagtgataagagacaaaaaccaaatataccgagcacttacagatgcaatgattggtggttggaggagctgcttcttttgtaggaatctaaccatgcccttgataggaatcattatctgcattaagccataaatggagtattattagttattttggtaacaactactgaagtgcctctattttttttttccaatatgctgaactagcattatgttgtgcccacttcttacttttgaacctaaagaatgaacgtcctgcccctcctcctcctcctcctcctctatagatagcaggggctcttcctcatgtgtattgccatgagcacttgatggatatttcgctacacttgacatggtattaggagccttaattggaagtttatctctctcctcatcgcagctgtcaaaggtctgcccggggggtggagcaagcatcttgaacacatatgtgtaaacaataatggcaccaacctgcaccggtaaacaatccaatagatatgataagtatttggagtagcattttaaaaagggatgtgcaactccataaacaaacggatttggacatacccattgaccaaatgataagtatgcatttccatcttgagtacatttgttcgagtcaccaaacggatttaattggtcgcgacataatgccgagataaggacaagtggtatatttccaatgttccctgcattaagtgaaatgttaaaaatataatgcagaatgcgtgatgaatcagaagctagcgatattcataagggcgtgaggaatgtacaaacctattccaatgtgagtgatggtgaacttgaagtatggataaggcggccgtacaatcaatgccactataagtccaaccaaagatgcagagactgcacccagagcaatgtttgctggaatgaaccacctgcaatgcaacatcatgagtaatgttgaaatgctttgacacaagaagaccccaaatatcgccaagggaaagatacaacttgtggctaatcatctaaatgagtactaatatgttctttcttaccactccatgatcttgtcaattgtgattgatctcccgagctgcgcaaatattaggcaaggaaggagcagagagaacacaagctgcaaaaataacaaaaaaaaaaaagacaagataaatcaacatagctagcctgaattctgctgatgttcccatagctagtctgaattccattatattctgaaaattagcgagccaccatgatggttgtgagaactactgaattaggcgccttaccgcattgagaagcttgcggccgctgggcttgagcacgccgacgcgcttggacgccatgaggaaccccatgaagcagacgacgaacaccttggcgatgggcagcacggcgtacctgaacatgcccaacaccgactcccccgccgcgccgccgccgccctgcgccgccgccaccaccatctccagcaccgacctccccatcatcgccgcccccgcctccgacacgaaaccacaagcaaccggcgaaatcgaacaggattcctccccacctaaaaccgcgcgagctgaactgatcgaacagacgcggctgcgtcgcgacggccaagcagctgcccggggcggcgaacttgtagccaaaaatagcaaggaatcagttcccgaaacggccaactcctcctcccgacttgtacaaccactttccccttccgtgtcaggatccaacccaatcactcaatcagcgtaggaatcggataccaactcgccgaaatttagggttaatccagcattattagaaagaaaaaaaaaggatatccgagatttaggcagcttagtacgagcctaccaaccgccggaaatccgagacttgagctagagatcgcgcaatgtgatcccactcatccgtgcccaaaaagggcggaaaacccgcaggggagagagagctcaaaacgccgccgcgggagcacggggaagaagccgacggcggcggaatctccccgggaatgcggcgaggcgatcgtggtagggctcgtcggcggcggcggcggcggcggcggtggcggaggattcacggccgacgccgccgcgagccgagggaagttgagaagacgaggcggcgacgagaggagaagcgtgccacgtcggacgcgtggggcccatggtccagctacatccccggtcacttttttggggcccacgtgacgtggacgagttcttggttgggagacagagagaggaggacgtgacgtgaagtagacgagtgggccgccgaaatccagcggagctggatttgaggcccatacaggaaaggaaagtaggcccaagtttaagaaaagagataggcctagttaatttacttacctttcgcaagtggttagtggatccgttggtctaccagcttgcactcctactttaagatgccctcaaccaagagcagctccaacggcgaactccgagatcaagtcgccgaggagagcgacgaccacggccacgatcgactttaacttggaaaaatgaatgatttttcaacttatagtagatctgttcttttcatctcctgcttcctactgcaaatgatagcgtgattatatttgcagtttgatcatcttcctatcgagattgtgtggtactatttcgctacaagtatatattggtagcgtgattatgtttcatgatgatcgatgagaacggttaggttcgatccacttatctattaatcctattcatagatatactctaacaaatcttcagaatcgctttaaaatataaagataaaagaatcaaacccctaaaacctaggtctaaagggttcaacccaaaaatggttttacatgtatagatggccaaggtttgtacaaagttaccaaatttaattaaatttaacaagtttttatggtgtgaacatgagtttcaaaaatttgggtctgagttttacacacacgtagcgagaatttctcgatctatttgtaatatattgtggacatcacatgtataaatggcataaagttatttctctgtataataaatcattccaacaaaatttaactgaatttgataaatttttttggtgtgaacacgagcttaattttttttaaagttttacatgcatatattaggaatttattggtctattaataatgcaaatgatccatttgggtaaccctaaataacatatcgatatgatgaactcatggtggattgatccggttgaaaaatgtatctacaaactcagtaaaaatgattatgtttgacacatatcctaactattcctatcctgagttatgtttacaacattcctttttttcatggccatttgctaactttaacgtctctttttttcctgagtaatattttgtattcaaatataagattaatactataaagttctggtcaattaaatgttacgtacacaagtgtacaaagtgaaaagagtaaaaatgtgatgtccacaattttactctttttctattcaatgaaaatggcggattgcatatgttcttaagtttccagcctaaaagcatccttggcatccgtccaatttcttgcttgttagaagagaagataaaacaataaagcaggtagttactatcatacatgagacttggtatattgcaaagataccttttaaaaagatgagatttgaagggagaaacttccctcaaaacatttttttaaaaagaaattgtgagtgcgtgggtgattgaacacaggacatgggattgaaactacacactcttacaactgcactatctgcaagtctatctcacagagagaccttttaatctaaaatcctctctgagagctgttgacgaaaaaaatcgaacacgccggcctgggagatctgcttagctcctgtgcaagtccaaagattggtcagatgcgggcgtgccagtcagtttgattctgcaactgacaagatatgcaaatagtagatcaaaacagtcgatcggctgacaagccgatggagtagttccagccgatagccgacaatagccgatgccgataccagccgatagcgatagggtttaagcaatcggctatacgtccaatgtagattctaacactttagtaaataatgatatataggcaatcggctactgataataaaatataacaataatatagtccagtataaaccaatcggctagcattgatatgatagaataagcactgatctgaaggttaaagcatacgtcggctggaggcccgatgtcatgaaatccacaagattagattaaacagtgaaacctttgttgtcatcggctaaatccaacttatatgtatatgcaatccttatgagtcgatgcaacgttcagataactcatcggctgaaaccccgatgaaacccttattggcaatcaagaagcaggctagagattatgtttctaagcacgacttagtagattaaacttaactgatacaacactaagtatgaaaagaaacataatatctagacaatcaagccgttgactgagttttcagggtggtagatgtctaagctaatctaatctagcaacgcgatttagccgataccagcaaaaaccctaaaacgagaagcagccaatagagctaaattgatatgctaagactagattaacagagacatatgataaataggtaggcaaatatatcatccaaaccagagcaatccaagaggtcgaatgtactgatgcagccttgaacgacgccgacgtagacgatacaattgcctggaccggcggaacattggacttatcccttcgctggagatcgaagacgatgcagccctgcgtcgggtgccaaattccgtcgggtgccaaagggtggcgatgcgccgaattgtattgatcgtagcgatagattacatagaccccgggtatacatatttatacccatgggttgatacaagttcttgtcggacaagaaagaaactttcctaaagataaaaggaaactaacaaactattcctaattaatagataacttgccatgccgcattctctttgaactcggtctcttctggataagcttcctttagtagatcaatttccttagccgaatatagcaagaatccgacaactgacgacttgacaactctcatcggctaatctcatgacttcgaagccgatgctgactctaagcgatgactactccgggcttaccaaatttcactgttaacaagagcttgagctaggacgatggttttgtttaccggagtatagtgttttcttcctgtccaacaattgattatcaagccatgctttacaagtgttacttgcaagagaacttttatggtacaacaaactgatagtattaaccgctggaataaatgatctaatgctataaattgatttgatctcccacttataaatagatggtagtataaaattttacagggtagattcatctttctttgctattctgcaagggtcattttttgttaaaaaaagggaagtaattaatttagataaaaaaatggtaccgtcgcctggggtgtatgagcaagacttagaacgtgtaagacctttcacacacatctgctatgttacaacttacattatttgatcggtaattggtcacttgtaaccaaagtatgtagatttttaatgatgatcagaatcgaccaggaatcgtgccactgcgatgctcgtcattgtctctcgcgggcgtacaaatgagatccaacaacaatgctagtggcccgacacatgaacgagtcctaattggaccgaattgactctcaacaacgaaattactagaaaattttctccaattttcgataggactccaaattttcctatctatataccggcagtatgttgtactgtaaaagttctaatttttcaactaatcatcggctgctaatgttcaacaccttaaaacatttgctcaaacacattaaaaaatttgctgcaatttttctctattactgcatactcattgttggttgaacgatttacatcacaggttcaccaaaactggtatactttgatgtcctgtctatctggggactatggcaagtagttcatcacctctatgaagaacttggagtattcatgcttgatcctacaatcatcactgcaaaagactacatagcctccccatccctactccacgccgcagcaggcggtcatgcactggtggctatcctccggtagcaccagcatcctactgcgacaccctccaaccttccacattgcttcctggatcacgtcctcagtgatcttccagcaccgttggcactcccggttgatcctcttgactccaacaccggtcgctgccttatcgctgtcaccctcgacttggctgatgcacttcttcctggtagcgtgagcctcattggacttgtagaggaggaggatgagcacgta

SEQ ID NO: 74696 - DNA, 9845 bp, Oryza sativa
tcctttttttttttgtaccatggtcatgtacacttcatcaacccaactaaaacaatggaacctttttatttcttattattacatactcatgtttgattgtattgaactgccaggttgatatgtccgtctttgtgctatctcagtgcgcaagtggtaaagctgcatagaatcttcaataatcatgccccttccgcttacagattcgtttgtaataatgttgttttttatacttctccttctacttgaagtgctttgatttgaaatactggttagatcaacataagttgacaaaatctataactattatacataggaagagtgcacacaagaaatctgaatgctttctgttggcagagttgtaccatgtttcatagtgatttgggagggttgattttaggaaagggtgatacatcataaaagtagcccattcacttctctttttattttcttgattattgccttttatgtccaccaatttgatacttttggtacaacatttagccaaaatgcgattaggttttcttctatacatttcctacaatggttgacatataagttatgatatgtttgataatataggaactgtcggttggacctaaaataaattccttaagaaacctggggtgttctgtacctagtattcaaggattcattgatgctaatgaagagccaaattctgaagattcatggttgtgctctccttttcttgccagaaacatttattatgaaggttaaacgatttaggtaacaatattaaggaaattaatttgatgtcatgttaggaataagttgcatgacgtctatccatccattttgagtaagtggagatttattacaaccctattgtcttttttactctaaataacagccactataaaatgcataatacaatattttgtttggtgcttctttgttcattctttatactattaactttcaatcttaatttttctttgacgtgctaccttctctcacacatattaaattgtgcaaaccacattttccactcatagtatccgaatcaagttcttgacatatggtaagacaaatttgttataagaaatcaacaattctcaaatctcacccattcaaaaaaggacattttctttacaattgtataaatacatgcacattttctgaatgtttaaaggatgtactgttgttgtagatgctatacattactaccgtgatgcctgatgaatgcagtttctaaagaaaagcatttgtgttcttgaaatatattcaatacaacatactttaaacatgcatgatactactttgcaaaatgaacaaatgaatgttgaaagacaaggaaagagagttaccatctccccactgtgcttgctgatccattgcttgcagtctggtttttagctcattgttcagagatacaagtccattgttgttcctctgcaaacaatataaaaaattactaagattgtgaaaactccgaatcaaaatgaccacaccttctaataacatacctgcatcattgccacttgtgctcataatgtagcagtctccaactgcaacacctagaatttgtgttgaagctcccctatatacttcatctttttctcctttgactttgcggcagatgatcgattgttcaggatcctgaaaaaattacaataagatggtgattttcactaacaaagaacattgtgtcaaactatcaatccgcatgcacggactagtacacaagaattgaagttcacacacctcttgaccctcctaggatcagtcaagacaatctctgagaggaatttatccgccacaaccttcttcttatcatcctcagtgaatttcacatttggcaatggactcgccttcaccaccatttgcctctatagttagcagaggggggctggacatctgctgtccaacagctccaaaattgaggttccccatcatgaagctgtcaaccgacgagctgtggcaatggtgggttgtactgccagcaccagagctcttagcttcattctctctgcttccagaagggctccatgcctgtatgcccatgtccttaaggacagcagccaccatgccccccgattgatgcccctcggtcgttgtgacctttgtcttaactgatgctataggtagcatttgcgggttttgatgtgaataccctaagaggatgtaactatgcgaccgcctatgccccaccataagcggtagcctgctaggcggcccctggttagatctcgtcgaatgcagtgcaagagaggtcatcggtggcacatctatggcatcatatggaggtggaacgatggattccactgagaaaaaagtattaggaaagaacaagtaaaagtcttcgggtgcaaagccactgccaacttcgtaccatagaagccgatagtggtggttccgagcagggggacaaggcagataccgtcgaagaggtgaagtgggcaggagcagggtggatcaacggtaggaatttcgattggtcgaggcacttgtgggaggcgaggttgaggatggaggggactcgcggtggaaccaccggattctcgctcccatcaccgcaccggtccaacaaagagaggcggcacgagggttcgccctccatgttcggcacaaagcaagggggacgaagtggcgcggccgctagggttttggggatgctaccaacaagcacgaggatttgttgattggtaatgcgagagagggaagcaatgagaaaattgtgaaggttgtatttgtgttgtatgggtggcatgcaaaaatggaaaggcgcgtgggataaaaccggcatcactctctcatcttgtattttgttctgagcacacgcgtatgacttatctgggccaaaagcccataagcaatgatgtggcttactcttaagatggacttctcatggaactactggtctggtgcaagaaatatgtaatgacacatattcaatgagatgagtacagcacatttttttgcataacttttacttttcaattgttccactattaggctggactaaaataatcacaagaatccaatgaccactactattagctaaaacatgagtgtattgttcatctcaaaataggtactgaaaattctcattatgccatatcagttctaagttttgtaagctaagcttaattaagtcattatgcccttgtaagaactattccctctgtttcatttttattttactgaaaatactagtacaatgtttcccccagtagtcatatctccgttttatattataagacactttgacttttttcttagttaattctttttgtcagtttgacaaactttatagaaaaacatagaaacgattctaacaaaaaaacaaacatactatcaaaatattcaatgttagatttaatgaaactagtttggtggtctagatgttgctaagtttctctatacatttttctaaacttaagaaagtttaactagaaaaatattcaaaacgctttgtaatatgatacggagagagtacttgatttccattagtggaaatataggggtttctctcttgatcagaaaaaataaatggctgtcgttgtttcatacactgtgcaaaaatcagtcctctgaatatctgatgcagaccagtcaccagtcaccccctatatatggttaaatttgtaaagaaaaggcaaaatttgctacaggatactaaaaaatcgtgtaattagctgagggacactgaaaaacgtgacactatcgatggacactacaaaattgtgtaattggatgtaggacaccggaggcactattttctaatttctaggctgaaagaggggagagaaattttgaaatgacgggaatgcccccctctactccttcctttcttctcgatgcagctgacatgtgggcccgcgcacaatgctgtcgtcctcctctctccaacgcccgacgccactgcatcccttccaaaatccgatccattccctcgcccgtttccaaaataagttgaggggatttgatgtcctcactttcctcttcgatttccctcaagaatcctttgatatcccaatctaaatcgctcagatttgagtaaagttcgagctttcctttacctacgaagaaccctaattttcctaattctttttcgccgcatccgagtcggattcttcctcgtccacctttaaatagcatgccccagagctcctctctcaaattcccctttagccctggcttgccgctgcccggaatcctctcttcgcgcgttcgagcagatgggggacgatgagaggacgacgacttcctagagcacgctcctcgtggagtacacgtgggtcgaactctgggcagagtgcgtcgagtcatttgatgccatggtatgcaagagatggaggcctgacgagagctccatggttggcgtgcgtacctaggtgcccatggcatcgagaaggtgacggtggtgttcgacgtgatggacgacaagaacgcgtggacaattctcacatgtctcccttcttgcaaggtccctagctgggcgcacgcctttatgaagatgaacgggaacatgtagctgtcgggctcgatgccatgctccaccatgttccaccatgtccatgcagaggaagaagaaaggaaggagtggagaaggagagagaacaagaaaaagggttgaaccgtacttttacatatatttctctctccattttctttggaaataataaaataatgtcgtgagtgtctggtagctaattatcagttttttgtgatgccctacagaaaatactcgttcttgcaatgccctccaactaattacacgttttctggatgtcctgtagcaaattttgacaaaagaaaaatgagtgcttgcagggattcttctttgggtatgctagcaacatcgagggcttgctagacaccttgttcatgttgctatcagaggctcttgggcctaagtagagttacctggatgcaaccaggctgccaagcaggggtagatgataatttgccactactaccctctatgcccccagcttgagatcgccatcaggacaacacgccattcggactccaacttcctgaccgtgctcctttaggatcaaactggtggcctgcaagtcctctttgacaatcggtgggtcgatgtcacgctgatacccggagcactcatcttcaatataggcaatctcatgcaggtatcatgttcagagttcatgaaacacacaatgagaagaataggcattgccttgcagatatcattttcagaatccacaaaaatacaatgaatcttgcagataccatcagaatccacaaaacacacaatgacttaggtggtctcttgctggtatcaagttgagaatccacataacacacgataatcaacatgaaaattcaaaattttgttttgagacaacattaaaaacccaacttgtttaccctacattattgaacatatatttttgagaacacgcaaaacacttgcgcatcatttcatttctgaacatatatcggagacctgttttaactaatgtccatatgatctcgaatgactagttcaaaagcatggaacattcaaacaggggcacaaagttcagggccaagagtatcaatcgcgtgtttacccagcaaatccagcatcgacaaagatgttcagtccgttcaaatagctgttgtttgatcactactacacaaacgatttttccgtgcggtcgaaactcactttcgcgtgcggttgtttcgcccgtctggaacgaagggtctgcgaaaatcgtgattttcgcgtgcgggcgcttaagccgctcacacgggaaaatagaaaatcgaaacaaaaaaaaagaaaatcaaaaccaaaaccctaaccctaaccctaatctagccgcctgtcgggtcccaaaactaaagacttagatccgactaagattaatgtatcaatccctggatcagtaaatattgatgcatataatacagctggttcttcattgcatacgttaaagtttacaatactaagagttttacaagaataggtactcacctaattaaacataggtactaatattacacagcagaagttctaacacattctaactaggaaagtataacctctaaggattttctaagttatcagggtcgtcatagtaataaacataggagtcctcctcttgacccaaatctgaaaaagggttataagagcaagggtgagtattcacaatactcagcaagttaccaaggaaacatgttatgcattggcatagagtagagttctttgcaaaaggcaataatagacaatatggaagtattaaagcaagagtttgtaaaacatatactttaggtttctaaccaaggtaccatatgagtcccggtactcaattccgtgagtacggctattcgaatagtttcatgaatattctactgcagcagatgtacgctttacccgtagtccacgacttgccaattttcattagcttagtcatggcccagtattaggttattaacaattgtggtacctgttccgtgaacttatatcctcatgcgctctgaacgtgacgttaacagcagtgagagcagttctggcgttcccggggtatttaaggggaactgatcgtatgacaccacgtcatctcgatcagggtttagaattaccattatacttataattatactcgagtgtcataaaccaattacctgtacatggtaatggtaaaatttgcccttcgcggctatagttgcctcctgctcgaggacttaaaaataaataccatgatatagaggtaccacattgctaattaacataatgactaggtctgtccccattctagaaactgcggtcatacccattcgtttgacataagtacctgataataactatatcgatcgagacagtactagccaccaagaaatcatcccattctaacgtactgtcccaatttaagtgtaagacattttaaccagattgtaagcagagtaagcaatactaaattgtctgggtttctatggttgaattatgcataaaaatagagtattgaacagaaaggctataaataaataatttgtaaaatataggcttaaatgatcaaaagatgtatagtaacttgccttgctcgatgtccggagattgactgatattatctagtgtgtcagaagaatcctcaaggccaagggttagacatataaaatttaaattcaaaaagggattcaaataaaatcctaaaataggaaaaatataaaataaaatagaaaaatagaaaaagtagtctcaaaagatagagaatgattttaggagaatattggttcaagtttcactgaaattggatctatattttaaaagatatgggcttctaaagtttgaaaatcaaattaaatgtgaaatggcactgtgtacgggtcccacctgtcagtctctctctctctcttctcttcttcaacctccagccgttccccatttacggccggcggtgctagggttagtgatttcggcggcgatagagggagaaaggggttgcggccgaggaggggaggtagctagggttctccggcgacggcgagtggcagcggagggattaatttgatgtgtggatagcctagcggctagggtggcggtgccatggatgagctgagatggtgatcaaagtggtgagagttagacatggctcggagagggttcctagagcatctatgaggtacctagaaggatttaggtagcttgccgacctttggcaaggtgtggaaaatacttgccaacgagcgcctccattagcggcagtcgtgtgcacgtcggcagccaaggaggttgtatggtagtgccaacctattgcgaaaatggaatctagggggtatgtagatggttaaaatggaagaactcaccgagataggctgagacgacggattacggccgaaaaaacttctcggcggtgaagaacagagcagagcaggagcgacagtgctcggctcagtgcggtgaggtgaaactcgacacggagcttcggttaggctttagtaagctagaacatggttgaatataggtgttctaagggttggttagggtggagggtggatggaggggtgtaaagtcgatcgcgcacaaggtgttcgaccgatgggcgagagtggttgatgatatgaattggcaaagcagggcttcggggttgtggggttatggttggtgatgatcgatgatggacaaggaaggggctgaggtcttatttatagggctaggagaagcggatgagttcgggcgccattatcgccattgatgaactcgggaattaggtgtggcaggggtggcagagggctgagagagggagggcaagatcaatttgagtggcgggaggccatgttcaaattcttaccgatgaaggcttgacttggccgcgggtgaaaacggctggcgacatgttggcgccaatccgagcacgacgcgcggcggcggcgatggttaaaacggccagctcggtggtgattggtttgaattgagagaggggaaaccatcgtatatattcaatccaaccgtgcggcaagaattggcgcgattcaccccgggtagaagaaaaatcggactcggcggcggctttggacgggcatgcacggcatcgagcggcgattacttgtggcggaggtcgtcccggcttcgtcctcatcaagattggtgcgacggcggtggtctgagaggagttgtgcggctggcggcgcgtcaaggcagtcgggcacacgcgagcagccctgaagctgaagcgagtaaaggggatggaaaggcaaagaagaccacggccttgggtgggttgtggtccccaaggacccaacctagactttgttaaagattggatggatgttgggctgctctagttggactgggcatttcatcgagcaccttgagtgcgatgaacagtgttttcagagaattttgaatatttttcctagaaaagaatgaatttaaactataaatttgagaaggtttcaccagggtttaaagtatagcaaactctcactactaaaagggtaaactaaggaaataaactaaagtttgaaatttgagagattttgctcaaattcactaaggtttaggttaggggaataattaaagtaggttaaaagaattctaaaggagtaatacttgaaccaataaaataagaataacaaggattcaaatagatttttaaattatattaatctagtcaaaagccagcatgatgcagtcaaaatttagtttaaaatttgaggatgttacaccgccgctgccctagccgaggcccaccgccaccgcccgctcccgttgccgatgccggccaaacaccccccatcagcgccgcccgccatcgacacccctcccctctgccggaactagggagggaaggaaggggaggggagggaagccggatcccgtgcgggaggagggaggccggctgccgtatctgtgcggggacagccgccactgccaggtccgtgcagggacgaccgccgcccaccggatcctgcacctccaccgctgccgcgtggaggaggccgctgcgtgccgccgtcactgttgccgctggcctccggcccacctcgtcatcgtcagcgcccgcctcccgccggcctcccgtcggcgccgccgctcccggcctttgcgccgcccgcctctcaccggcctccatgtcacccaccgccatcgccgtgggccgccgaggagagaggagagaggagtgaggaggagagaagggaggagtgaggagtgaggagaggagaggaagcatgagagagaggactgaggcgtgagagagagcgcacgtgagtgaggggacttagccgcgcggataggggagaggagagaaaaaggaaaatttttaaagtgggtaggagggaaactattttcccgtgcggctctcttaataggtacgcatgggaaaatcgactcattttcgcgtgcggggcatttaagaggacagcat

SEQ ID NO: 74697 - DNA, 13577 bp, Oryza sativa
aactcgcttccttcgctgctttactgttcctctcctctcctcgacttcttcttggtttttctctctctccctcgagagagaagaagttgggtttgttgtgttacgctttcctctgtcgtttgaggtggcaatatatacacagcgggtgtggggggagtattcggaaacggattgggaatcccaaggcggatcggacggcgaggaggggggtccgagacggagatggaggacgcggggaggccctatttttccgggtttttttttcttttctcggtttcctctcggtattttttttctcttttttcggttttttaatacgtgtgtacgtacgcttttttttgggttttttctctccttttttactattttttaatatgtgcatctacaaagattgtataggtacgtagtatctcacacatttacatagtttgtagtttttttattggtttttaatacatatgtaaagtttgtatatgtacgtttacaaagtttatatacgtgtatatattttttattcactaaaaatgtatacatataaaaaattaaatatatctatattttttatatacagtgtatgtactccctcttctcattggatatccattagttgattatgaatagttagattaaaagagaaaaataaattactgttcccttctttttttttttaatttctgcgtgcatgcactccggccgttacatacgcaggttcaaattttttgatatggttgaggaagcacgttactagtatatgtatttttttttctcggcacacaagtacaaactttttgttttatactccctccgtcctaaaatatagctatttctagcacagtatcttgtcccaaaataaagctatttcttcacctacctcctcctctcaaccaatcgcaaccattcttcttcacctactttctcttttcaaccaatcacacacttcctctaattattctcacctactttcttaatacccatgccaacctaaaaaatggcttcattttgggacggaggaagtagtatgtacactattgcctcacaaattttgacaatttgactctttgcaaaaactaattatacaaatgaaccgtggtcaaaacttattttaaaaacgacccttttgttcaaacacctcagcgtcaaatagcatggcgctgaatgcaggttggcacgccgactcatactcccatccacgatggcacgacattcagcgccagttgacgtggcgctgagttgtctaagttcagcgtcatgagatttggcgttgaacaaaagggtaattttgaaataagttttggctacggttcatttgtataattattttttgcaaagggtcaaattgtcaaaatttgtgctactgcctagtagtttatatacttgtttgctttccatatagtattgtacggtgcctagtagtatatccaagaatgaacaatatcagcacttttatactactttgtaaatagtagtagcgatagatatagagaacttttaaagtatagctagaaaggtagcccgcacgaatgcatgggcatatgtcgtacgttaagtttaagatacttataaaagtgaaatattaaccggagaacacctcccatgatttctctataaattgttttcatggcattaattgcttttataagtttataacctattagctttatgttaatcatatttaagtaatatctataagcaattatttataatattcttcattatttgaaaagaaggtagacttattttcttcagaaaacatgtcagtaaaagtaagttggttttctttttttagttgcgtatatattatcatagtttactaaaggatgaattgggtgggacatgaagctccagtaaatatatgggtttatatagtctaaaatgattaatgtagtttgagagatgatccatctgaacattcatttcatatagagtgagtgagaggctccacgcaatctaacatgaatacgataacgacgaaatataattacgcagtaatatttttaaaatatgatgtaccatgaatacacacttgtttttttatatatataagatagatctaatggttagaaataatggtttcacggatttaaaaagcataggagtattccatatatgtagcttttggttgttttaattatgtagttggtgacttacgaacactccggagggcatttaattgattttgattgtgtacaatgatttagtataacacgatacatattttcaattaattttcgtgtttatttagtgttcatgcaaacggtagggtctaccttcaaatgatatattttaacttttatatagcaaaatatagctaatgaatgtttaattataaataaaataatagttatgactatttttatattatgttagttagaaaaatatagaagaggcgataattgcattggagaggagaggatgcgagaggcagagtgggaggagagtggcattacgaaagacaggatgatgggaggagattagatgtttttaaaatagatcgaatgtgcactataatttagagttatctatttttataaatacatttaatattagatctaatttaaatactttgggtgttgtattttctaattaaactacttaaattattctaattttagtgcattttgttaatcaaaaggtttaaaaatatatttgatataataataaggtctagtttgaatttaaataatatataaaaaaaggagggtggacaccggccttggaacacgaaggaggaggcgtacgtctgtttctacaaaagtgtataggacggtgatttagttttataggacggtgatttagttttatttttttaaaaaaatattattataaattgtgatttccatctaactaaaatagcatgaaaatcatgaaaataggagagagaatgaacagaggggaaggcgtacacagatggagttcacgtaaatggaaatgtacttaagcgggacgggaggggatcgatgctattttcttttttaaaaaaaatagatctaatgacgtataatattaggtccactatataactttaaatctaatagctaaaaatctaaatagtgggtccaccggttaattagaatgccacatgacggtttaggagtgtttttacgagtacacgtggtggtttaggagtatttgtaggaagatatggtgttttttatgtacggacatatgcatgttttctttttttttccaaataataatctcatgtacatgcatatatacatacatatattttctccggatgaatagtatagatttatttttctctctcacaaatacacatgagattagaagagagggattaattactttaatatgatttgatctaatctattctacacctgtacatgtgtaaatcaattgttgtatatttatacgtgactacatatacaagggaaagtgatgttacgtgtgggaggaaggaggtggaggtggaaagattttttttttagataaatctgacggcttgaaataatgggtccaccgattttaatgaaaacagatggacagatgttttgtttttttcttagaatttctaggaatttctattatttattagaatgtcatgtggcgacttatgagcgtttataggatgacatgtggcggtttgaaagcgtttttagggagtttaatggacttttagtatataatagatagatagatagatagatagaagatagatatactaacagtatatactacaagtataaccgatctaacggtatagattgatttgatatttcattgaattagattgtactataaaattttaaagggtaaattcgactttgcatgttatcccgtggacgtattttcttaccgctcgacaaaagaaaattgtcgttcggccctccccactccttcttcttcactacgggcgacgagcgaatccacgcgcgccgtgccaccactgccggcgaccgcaaccacaccgcgccgccgccaacgggaatcgattcgctctcctctcctcctcttcttgccttcccatccaccaaaaaacccaaggcatgcgctatctagaggaggagcagccacggcggacgcgacggcgctcaaggaggaagatcagcagcatgcatgcagagggtcgtgtactcaatggcagattttgtcttccaccccgcggcgacaacggcctcgtatgatcgtatctgattgctgattcgactctcgtatgactacggccaagtagcacaacgccacaaccaggctgggtacttaatgaggtttctccctctcgagacggaagaatttaagggcgtcatcgtttcgctttttttctaatacgccaaaacggcttattagggaataaaaatgaatttgtaaataaaatttttatatatgtgttcttggtgacttaaaagccaatgctgaaaaaaaaaactacgttgaaaatatctcaaaatcgttctcaaaattaagtttgaaaatttaaaatttggttttttttggtttatctaggccatccgatgggagcctaagtgaaaaggcatcatgaccggatggcggatgctcatgccggaacagttcagctatttgctcttttggcttgtgttcccaaaagtgaaaaaaaaacacacttgttttcttcatttgcttcaggactgcatatttgaagatacttctgaaccttctttttgatatgcatgatttctgaacttggtgaatgtgatacctaagaagcaaagatgataaactgaattttcagtacaataaaaccaaacaattccatggtactgaaagcagtactataaaatcttcagcacttcacaagcaaatactagcaatattacaagataagcacattcgaattgttataagtgtactgccttttcttgtaagggaagatatgaaaattgtgccatctttaattatattctaaacatccttcatgtgctcaactgcatgaacaattacacaagtttcaagagaacatatggaaacacatggagtaaggccgaatgacagccaagagaatgagtcgcactgctgcctagcgcaccaccgtcgctcgcgagcacaggaatgacgccggggacgaatcacaccgccgcctagcgtgccgtcgtctttcgcgagcgcacgaactgaatcttatttattggattggattaattctaaacgtagaaagctcttttccactttctgtcaaattcctaacatacccttctatataatgtaagtatatactcatagtataatatactgtaaaagttatatttctgtaagaagttaatcacacctatacgatcttaagaacaaaaaaggaggatttctggtgaatgccaaccaaatttcaatcaccccactgcacaaccgatcgaaatatttacatcacaatatttaaattaaaatattcacattatttcagttccaagagcaaatagattacatcagatttaacttacacccaggtgcaattcagcacatctaaccactggctaaattctggggtgagggtcatccatattagccctgcacccagaattaatttttgacactgaaatcagcctaccaattaacacctatataaatttatgtacaatgcccaatatttcctacctcaccccggtaggacaagaatttacagtccgtaatccgtaatgtatattcacaaaacaacacaaaccctattctgctcttcacaaggcaagcgccttgtaccattgtccatggaccttctctgatatgactgccatctttatcagcacctccccggccttgacaaccctgtcggcgagcttcgccgcgccgaggcgtcgcagcggcgcttcggctagcttcttgcccttggcgccgccaccgaggacgacgccgcggaaggcaaagtagaccgcccgggacaccttaccgaagacgatgtcgccggcctggaggctcttgagaagcatcttggttgctagctctgtcgtgtcctgaatctgttcctccggcagagagccgaccgaggccagagagcgcgtcatcgcctccacgatctccttcgttgatgcgtcagcgttgttgtcgaggagcttcacgagagcgtcgtagagctctgagatggtattctgtagctccggaggagcgatcttcaacatcagaacttgatgcaggacaagcatgctggaacagacagacatggtaaattgatttcagttatcgtagaaatcaattgttctgaatgaccggtttagttcaaagtattgggggttgggggggggatgatatttatttacctcgtcgcgatcactatcaccttctgaaactgatcttgcacagccctcaacctcagcagattaatttggaaggtctcaggggttgactgcatgttcaggccctccacattgctgataagttgcaacaagccaacccttgtcagcttgtcgatcttctcacccttgcattctgggagaccagaactgctagctgcagacgaagaagcctgcggcgctggagcaccgtgaccagctcgaagtaccggaacaacgtgctgagcctgtcaataagggataaattcgtgtcagtcagagaaaaacttagactgctgcctaagctaatacaactgtaaattgttttgatcgtagaaacctacatgatctgctggcaaagcttggagagactccaaatgtgagctccactcttgttccacgatgctcttcgttgccgaaacccactgcttagttatagggagagacactgatgcattagcaggaggtccatagcgatccgtgaaagccttctgcaggtattccactccggcagagcctttaataattggttgcatgagctggatgcgagccttgctaacttcagtttgcagttgctgttaatcacagaaaaatgttaggaaaacacggcgcaatgtaagtgcaatctatgtcaggactaattcaaggtgttaacaaggaacaaacctttatttcttcgagagtgaaacgcaggcccttgatgacagcaatgacaaaggagctgataccattgtcattaacttcggaacttgcagccaactcgtttaacaatttctcatgactcctcttcatgtcatcttcctttgcaggggcagatagtttcctgaccatatccagggagtactgcaaaatctgccccagatatcgcgtgtcctgggagcctgactgaagcacctttcatccataaaaaataacaacaacattaattcaaaatataccgggtttaacaaaagcaaattaatactaactattttattttgtcaagaccaccgagtccttacctgagacaaaatttcgaggtcaatgttctcaagaatttcctccttcaactcatttgaggccaactcatgtaacgaattcctgacttcctttacgaggttaattaattggctataatctggtttgtcccctctcatcgaatcagtaacaagatcccaaaaggctttctccatcgttgctttcactttggcctgaaagtccttctccgcggaactgacgttatcagagttgcgagcaaaagaaacatcgtcctcatgaagcatctcattgaccatttgctcattgtccgtcggcggtttcattggagatgtactgcttgacgatgaagcagctccaggcaaagattgggcagtgaaacttgatccttccacagtaggcttggaagtagggtttggaacctgtccagatgaattaatgctcaaaggagtagatacatttgcaacagatgttgctaatggatttccgttttccttcgcctcaaagaactttgaccttgtatccgaaagagcagagttcatccgctcgatgcctgcatcgccactcaggtgctgaatcttctctcttaacagcttctggtcatcagtaacctgtttctgaattgccttcatatcatgagaaaggtcatgtgactgcccatctgaacttaacttgcatgtttgcatcattgacagctcaagcttgcatgcagccctgacaagatcttgttccaatgatttggcatccttcagtttccacacaacaaagtggtaaaggtaagcgcaccatgctttatcaaaagcagccaactgagtcctgaactttttctgactggcagcatcagtcgattgcatcgaggcacctcctggtctatcaagtactgtcttaaccaatagctcaaactccttaacaaagttttctgctgactccataagtagattctccttctccccttgtccacttaatacagcacctggatgagccagtatcatataagagcagaggactacccgcagtgagtatctagaaagcttgcttgtctcggaacccttcgctggctttttcgcagctaccctagatctgctagcaggtgccttcctctttggagatccaaggcgtttcagaaggtgatcaatgttctcggctgatgatgaaccagttggctgagaaagaagcaaacgtttctcgaaccggtcaagcactgccttggtggtctggagagtcgttggagattccatcaacatagctaaattttcaaatggcatagatttgacagacatctcattaattcccaaggcgtcataagcttgaaccagtgcatatgttgtcttgttagatttcaaaaatcttttccagcatctgaagtacaacaaaatggaaaaaacattgccaattagttaaaactttcacatgtgcaaatgcaagaaaataatattccaaaaatcaactgtgtgacaccataccttgccagctttgttgaaagaaattctgcatgcttgatgtaatcagcatgggcagaactacggggacttacccgctgcttcaagtactcagctctctgcctttttgcctgttccattaagttaacttaactgtaagaaatagaatagaagggctaaaacaacaatatcagagtataatatgagagaacaaacataccttctgaagcttgctttctagctgttcttgcaactgtctcctctctgattctctcttgctgcatacagtcttggcagctcgttggatgtgcaaaatcctagcctgggctttcctcttctcagcttccagcaatgccagtcgcttcttttcagcagcattgcgcttttgtaagatcaaagacttgactcgctccgtgtatttcctctcagatgtctgtttccgcacaagggaccgcgccgttctctccttcattgccgcccgcttctgcatatgtgcatgcaaaagacgcatgcgatttgcctctgcttgacgaacacgagactcgactcgagtcccgagttcttccctttctttctcgatccgcatttccacgatgttcttcgccgcttgtcggagttcatccaacttggctagcctgttctgtgcctttgccaagaggctcaacctgcaagatacaaataattagtatcagactctcagagctcctctaattgcataagaccgcaaataactaatatcaggcactgttttttttcattaccttttctgctcggcggcctgaagcttcgcttcgaggcgctgaccttgatcttcctcttgtgatgaccatgatgggctccgcggcttcttcctcgctttgcaggacacccattcatggaattgctgcaaagtgcaaacaacatatgaccataagctatgttgatcaatcatttatcaataaatacagtaccaacatcttaataacaaatcaatcaaatatactagacccaaatacgagtcatacgatacggtcccaaaaagaagaagaaaaaaacttcaagtgaactgaacctaccaaatcacatcaaccaaaaaaagtttcacccctattacttactggtcaccaaattttcagtactacaagtgcgacgaaagttacttctaacttctaagcgaatccaagtgtggtcggtggtacacaaactattcataccaaactaccataatcttttcaccgacgggacaccatgtgctgaattgtttgctcatgaccctttttctacaacaaatattatcttcctaatttgaatataaaaaaaagaaattattttacaggcaacctgtcgtaactcgatgcagacaactaaatatgttactgatatccactgattactctttagcaaaccgcaggtagaaaccaaaagataattatatactgcattaaattattagtgcagtgtatatccaacaaacagataaaaacgggaccttttatatggggaaagtacgctttaatccagagccgcaaaatcatgcggctgagagaaaatcgaatggaaaagaaatcgaattcgaggcacacgtgaacccaacttcatctcacgactacctaccaagaacagaatcccccaaagaatgttacttcaactccccaccaggaatcccaaccaccaaaaacaaaaaagaacctcactgcacagaaatccttccacgtaatcccaactttgcgtctccactaatcagccaaaataagtttccaattaaagtagaacataagtgattaagaaagaactggtcgtgagtacccccccccccaaaaaaaaaaaaactgaaaattaaggactaatcctagtctaaaaatagcagcgaaattcatcaaaaccaccactctgaactgttcatcagcatgtaaagggcactatggtttaatcagtagtaaaacatttcttacgaaactcgaaaccgaaacaaagcaactcaaattaaatcaaaaggctccaaaagcttcgaattcacagttcactctcgtccccccacaatccaccgcgaaggacgaaatgaaagaaaagaaaaacaaaaacaaaaaaagcgacggaaagggaacccggacagggacacctacctgcctccggagctccgcctccttcagcttcgcctcgatctcctccgcgctcgtcggcgccccgcctccgacgcggctcccctccagcaaccgccgcctgatcctcggcggcatcctccccgccgccgacgactccaccgccggtatctccatcgccaccggctcccgcaccaccatcctcctcctcctcctcccccgatcaaaccaccaaaccaacccggcggaatcaaactctactacgggcgaatcccgcaaagcagactcgccttccttcctcgcgctgctttactcttcctctcttctcctcgacttcttcttggtttttcttttttttttttcctctctcgagaagaagttagtttgttctgttacgctttcccgccgttcgcgtgaggcgtcaatatataacggcgggtggagggagtattgggaagcggtttgcgaatctcgaggcggatcggacggcaaggcggggatggaggggtgtttcggtaatttgagtagggggtgtgtcactgacggcgttaggccttagggcgggggtgggggggttcgagacggttcggggcggtggggccccgcgcggttttctcgtttgtggatcgggttttggattggacggaattgcccctgtagtgtaggcggcttcgctttggtgtccgaatccggttttgcaaaggttaggctgcttttgcctgtggccaatgagttgatcactttgttatcctcgtggtggataataatggaggtctacgaggctatggaaaaaaacgtgcatagagaagatgtttttttttattttttctatgtgactaatatagaggtctggctaacacgtatgcgccaccgtggcatatacagagcgggttagacagcattttgatctccatgacactcattagacaaagtttggagacttgcatattacattttaagaatttagcgatctagatgacacacttatacaagtttagatataggcacctgtgtactttgctcattttctaattgtaatttaatcttgatttgaattttgatatttgagaaaaatttacgtgcatctttacttttttcctattaatcataggaaaatactagtaaaaaataatggaacaaagttaggaaaatactagtaaaaaataatggaacaaagttattgatgaaggattatttttacacttaaaatcaaatttaaaatttgagaattagctacataatacacttgtcagttgtggctgactcactgttggcccgacgttgcttcgactttgaccattgataatttttttaaatggttaaattgtgttagataaaagtgcaatggataaaggcggtatatatcggtttgatatagcgaccgataaaaaataccctcctctaaaaaaaagtgcaatggatagtacttcgtactccaacatttgccttgcagtgcatctgcctgagctgctgctgggacgggcacgtcagcgaggctcacgcctggcgtcggaaaccggaagcggataacgtccacgtgtgcctcctccacgtagcctgctggtcagtgacacgtggggccagatctacgatggccccacgggtcagtgaggaggtgcggtatattctcaggtgattgcgtttgctgctgctgctagttggggacacgcgtttccccactatgcaggaggggccaggggaaacgtggcacgaggagaacgcttactttctctcgtctaattacgcaactgccctcacgatcatttctggatttctggccagcttccctcactctgcacgtgtcacttcttttgtctttaggtggtgtttggttggagggactaaggccctgtttagatgagactaaaacttttaagtccttatcacatcaaatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggaagtaaacaccacctaaagtggagctaaactttagtccctctcacaaaaatataagtccctaccatagggacttataattctgtgagagagactaaatttagtctctagttcccaaacacccccttaaaatagcaaaatttgctacaggacacataaaaaaaatatgtaattagctgagagacacagcaaaaacgtgacactgcctatctaattggcctaggacaccagacgtattattttatcatttttaggatgaaagaggggagagaaatttctaaatgactggaatgccccctttactcctccttcctttcttctcgctgcagccgacatgtgggcctgcgcacagtgtcatcgtcctcctctcgccaacgctcaacgccggccgtgtccccgccctcgatgccgccgtcgccttcgcctgtcgacgcgcctacacccagaccacctcccccctcgccccacccgcaccttccctcctccgcgacaccctcacccacacccgcgcttaccccaccggattccgcagcggggacatcaagcgatgtccagatcgtccaattcagcggcaatatcaaattctgacggcgcatcgcccccctcgtcatgtccaagaaatccatcaggctcggcagcaagaggcaacccgtcttcccctatctcgttgtcggagaggcggggctgcagga

SEQ ID NO: 74698 - DNA, 22141 bp, Oryza sativa
ttttttttaaaaaaaaagaaacataaaattgtacgcatgaaacataggcaagctggcaaacggtgttctgtacacgtttaatgttgatactctaataatgaagtatttctgttcacccgtagtaaggttagaatgaagagtctcccttggaggaaatttttatataaaattacaggaatagagaaaacacacataactccgtcccaaaatataacaacttttagcctcagaatttatcccaaaatataataacttcttcaccacattatcttcccaaccaatcacaaccctccaccattcactttttctatatacctccactactcatccaatcacaaccctccaccattcacttctacctactttattaataaccgtatcaaactctaaaacttattatattatgggacggagggagtagaattttaaagtttgattttctaagaatgaagtagggagtttaattgtcctctcataatcatgaaaaaaaagaaatagacaaggaagtaacacagaaaaccccaaagggcctattcattttggaggaatttcaacgcataggaataggaaaaataaacgaataggattgcatacacgctttaatccataggaatttttccatgaggtttgtgtggatgaaaaattccctttgttttctgtataggaaaggaaaacttcctttggttttcctatatttacattcctatgaccccaatgacattcatatgaattagtatttaggaatctaaatgctttgaaattcctccaaaacgaataggcctaaaattaattatcaaaccaaatgcacccagaacataccgttcaagacgccctgagtgtaggtgcactgccggtagggcccaacctcgtggtgtccaaccaccagcggcttctgatcctcggggatcttctgcagagacgacggcctcctcggcggcaggaggtactgcgagctcttccggccatcttcgtgctgctgttgccggcggtcaccttcgtcgtcggccgccgccgtcgtcggcagcagtggcttgatgagcccggagatgatctccggcggctttccccggaacgaggcggtcaggaatgagtttgatagacggctcagcgtcggagtgcccaggaagctcaggttcggggattgcacgctactgtacatgtcaatcgactgcctgttgatgcatagaaagaaaaaaacatgatcaaattcttgtgattcaacgttgcttattaattctgagattgagctatgatggaaactgcatttgaacatttagtgaagaaattatgcgtgcttgttctggttcatataaacggaaccagagtttggaatttcggtttggaatttcggatctacttctgtttaattcttggtaggaatttactctggtctaaattttttgattttgtttcactgcaacgaaatttgcgcatacacagcaaaaactaatttcactgaaaattccattttgatatttctgaaaattttcggaaatttcagtcgccgtgtttcgttttcttaatttctttccaaaatgtaaaatactatatattcagaacagataaaaaattggcaaaggcgccgataatattgatctgaaattctgaatattcagattgcacaacgccccactgattctctctccttctctcagacaaaattattttggaagaacagatggggaccaactgaagctgccaagtcagcaccagggaccacaggaacagtgacacgtagcaccaattccagtactagccgtgacacgtcactatcgtgggcccacatgtcaatggcttctgcaatccacctataggttcaccaacacgtgtcctcacaccccgatgccatcccaaatggctactgcatatcctgaatattctggccatcataggcctatcaggatcagaaggcatctgaaatataatcaactaaaattttcgaagaatatgtcatgtggtatgtctatgccaaataaaaatgtataaatcattgttcttagtttcaaactgttcttgcagagactcttttagtgtgtttggataatgggataagaatagtgggattggaatagggaaatggataaagggctatgataaaacgagggagggataatggatggctaggattagaagaaactctttgtttccccaacccattagccaaacaggcctttgtgtgctagtaaaaagaagttagaatctaaatttgtattttgcttttctacctaccagatgttcattatccaagaaacgtaccaaatgagttgttgagaaacaacagaaaaactgccatactttctttttttttttgaaaaaagtgttgcattgcaaaattcacagttaaaaaaagtaagactagtggtgattaattagtacgggatggcaaactgaactctccagaaaagaatggaaaagactgaaattattcgactgtaaacagaaaagtttggacttttattgacgcgtggcactgcgaaagaaaagaaaaaaatataaagaagaaatgaacttgcgtcggcgaacctgtagctctgaggccactgctgcgtataggagctgggctggctgccgcggccgccaccgccaccgccggcggcggcgacccgcggggtaccgcacgaagacgacgagtccgacccgtcgtccgactcatcgccgccgtggccgcgacgcttcccatcctcgacggcggcggcggcgtcgtcctcctcgtcgctgtcgatgaggaagctccggtccgacaccgaattgtccatctctcgcagtagacctcgtgctgaatgcaaatgcaaatgcagcaacgatggatcggggggagagagagggagagagagacactctgtgtgtgtgtgtgtgtgtgatgaggacgggtttatattgcggcggtgtgggcgctagccgcttagcaagcggccgggatgcattcagtggcggcgacagcggtcgaacgtactagaggtgaaacgaaacaaacaataagatgagcatgtggtgtttattaaccgaggccattatccttagtagcaatgatgtcgaattaacctattactctccctctgtcccaaaataagtgcagctatgagtttccgtatctaactttaatcgttcgtcttatttaaatttttttaaaaaaactaaaaaaaatatgtcacgagtaaagtactattcatcttttatcatctcataacaataaaaatactactcataaaaaatttcaaataagacgaacgatgaaagttggacgcgaaaacttatggctgtacttattttgggacggagatagtaccaaatagaagacacgatactatggatttggatagtagacacgtctactccctccgtcccaaaaaaaaggcaaaccctgggtttgcgtgtccaactttgactgtccgttttatatgaaatttttttataattcgtatttttattgttgttagatgataaaacatgattaatactttgtgcgtgacttgtctttttaatttttttcataattttttcaaataagacgaacggtcaaacattgcgcacggaaaccagggtttgtctttttttgggacggagggagtagattgatatgtcctcaccacaataatttgtagttttcttgatgaccacatgatatcattggcagtcaaaaatagtcatcaagtttagtcattgtcttagcggttaaaagtttgttactctcttcgtcccattttaaatacattcatcagtttccgtgtctgattttgatcgtccgtcatttttttatgattagtatttttttctttttagatgataaaactttatgagtgatttatgtttttattttttttttcaaataagacgaatgattaaggttggatatggaaactcatgactacacttaaaatgtgacggagggaatatattttaagatggatgtactatttatcatcgctgatctgcacttggataactaacaatctagaattattagattaattatgatgaatgaaagcctactacttgtgttaatatttagtatgtaatacgctttaataatatgacatgtatttcaatattttgtaaaattttgaagagaaatataaatggttaaagtacaaatataaatagcgctagttgaagaagcatccacgtgagtagtgtcctaatgatattccgttggagtagcatggaagggtgagggtgagtagcatggaagggtgagggttgcttataatttgagtctcatgatgcccatcctttatactcaagtttcatgaatttttaagataaaaaaagtttcatgaattactttgatttttctctatttcccactaaaaatcatgaattctgctactcgatcccttcattttaaattacatgtcggcctaattctagagttcattttttttctaactaaaatacttttcattttcatattccaattaaacactttaaatgtgaatttccttttatatcctttattaatgcagtcacacgtcaatgtagtcacagctctaatggacttatttcaactaataaaagttaacgactactgcagaaaattcaattgcgtaatctacttaaggaatgggtaacaatgtaatttgtcatattttttttgtggaatttgctagaacaataagtaattttaaatcaaaggggtaaataaaataaaatcccttgccaatgtgtagttttactggtgtacatggtctcctcacaaagtccttgcccctatttcacgcgagccaacattattctgtcgatttagatttcgctggtgctatatatatattttgtagaattagtcaattcgaagtaatttataatgtattttttttctctctctctctcatgtggagcaaaccaagggcatgtgactttgtaacatgtgtggtctgccaccggccggttgcaatgggtgttgtttggttgcaaacttgcaagtgcaatacgcccgagattgcaatagctacttgttcttggcctcatttgggtggcttacgttgcgttcatttttcgaatgagatgattgcaatatgcatggattctccagctcttgtgcattggctttaacttgccctttgcagttgattagggccgcaaaatacaggagtgtgcgcccctgtgaatgtgaggttttgaggtgttgggctgtcccggttgcaataggtatttacgtttctttttctcatcgagagtaatcagaaacaccacggtcatactcacactgcacaacaccacacatctacatatgtggacgccctcggcatttagtgcaattgcaaaatattaaggaataattgctcttttgccactgctgggcgtcctatttggcaatatgccactgaaaaagagctaattgctccaatgccactagaacgagaaaaaaatcatttgagatgccactgccgttttgttccgtcgatggccgttaactgctcggtaaaaaaatagggccaactgttccaaaaaaaatattaagcatttactatatggggttaaaagttctattgaccattcaaatacttcatccgtcccattttaagtgtaaccataagttttcgcgcccaattttgatcgtccgtcttatttgaaaattttttataattagtatttttgttgttatgtgatgataaaacatgaatagtgctttactcgtgacttatgtttttaatttttttttcaaataagatgttggtcaaagttaggcgcagaaaaccattgctgcacttaaaatgggacggagggagtagttaaatttcctctcatttctacttcatccgtcctaaaatgtaagaaagtaggtgagactgattggaggaagtttccttcgtcccaaaatataagaaattaggtgagaatgataggaggaaatgtgtgattggttgaaaagaaaaagtaggtggaggagaatggttgtgattggtcgagatgaggaggtaggtggataaatagtttcattttgggacaaggtattgtgctagaaatagctacattttgagacagagtaatatgaaccctagatcgatccattcatgggcgtcgacggcggtttctgatgagtagggagttgtagctgcgtcctagagaacaagggcagaatggtaattaccccagtcaaacgtgttgactaacagaattatttgatcctaacgacagagtgccattttggcgtgcccaactgtgaaaccagtggcattctaccaattgaccaaaaaccagtggcagaatgacaaatacggtaaaccctagtggcatttgtgtaattggccctattattaaaggtatagaaaacttggaaagtcgactcatgatacccacaccaagggtcggttcactacaaccgctctttgatagtttcctgtctatttatatatattttaaaaaaaaacacagtacaaacgtgatgttgtttatatgccagaggaaacccaccgtctcttgtccgagtgcgtcaaatttgtacaatttctttcaagcaacatgtttaaaagatatggatccatattatttacttttgtgcatgtctgagttggttagctctgcggctgtactactcatctactcgtatctcctgcggtaatccaagatacagtgcatcttatttttctttttgctgatagatatttaatttcttttttcattgtaacaatggggtctcgcaaaaaaaatgtcgaaatacctaattggtgctgcctcgcaaaaaaaaaagtcaaagttaattacataaaaccactcaggatcgaacaaatgcatatcccgctgaattttaattttttaaaatgatttttcttctgatattattttccataattttggggattttatttttttcaacccccatttctcttctttcttcttgtttatccccaattcgaaaatcctacgcgcgcgggtcttttggacgagcaggccttcggaactacatcctctagagtatctgcacggggtagggaagcgtgtttctttgcacgactactctttgtttcgacaaatttgactacttcatctactttgtgttcatgttcgagatgtcgacgaaatagaatggcaacacagacactggcaatgctaatgccaacaccaaccactagtgcacctggatcaaatgtttctggtttattctctgggtatcactactacagaaacacaaaaaggatacggcactataggtgctagaatagctaaaccagcacctatagtgctttttacctctaacgcacgcccacagagcgccatcggctagaaccgacatctttgtgaagaaataggtgtcgtttctagagaaaaaccaaaacaaatactacatgtgctgatttatcaagaaaaaccaacacctataatttattaatctacatgtgctgagttaaataggtgctatttaattaaaaaacagacacccgtaataaccaagctgagccgagccggctaatcgcgagcggatatggagagggaagggcagagtgggtgtccttatccactctagtcacctccgccatctctctctctccactcatcacctggccacgagggcaccgcgaccagcgtcgatctgcccagaggcggtacgagccactgaggccaccgcgcacgaggtgctactatgggtggcgcccacagaggaggcggagcggcgccgacaatttggatctggcgtagatcacggatgggcgttagcggcttcccacggccgatccgacagcgaccacgtcggcggcggctttcccacggccgcggtggtggatgttcttgatgtgttcaatattgtattgttcttcaatgttgttgacgtgttcatgtgtttttggatgttgttgatgttcttggatgccaattattaatattgatggaatctgatcgagctgaagggatctgctcgtcaagccgctttttttattattatttttttgcatttctagaaactaaaggtgtcagtttaggaaccaacacctttgagtcctcctcaaaggtgccgcctactaggtgccggttagaaaattcggcacctatggacggttcccaaccggcacctattccattttctgtagtagtgctcactctagtgttgaacatgttacttgatgctataatctctgctggtaaggttgtgattaacaatagcttactcttttccatagttttcatatttattctcacgttattctcgattaaattatgccgaaatatagatcttcaatatactcgagtacggtcagtgtctcactatatctatcatatgcgaagtgagcatagctcaactggttaggttccttgtggtggaactagccaacccgggttcaaatcctagatttgccacggtactcgcatttacggctaattattcttttagtggtaggtgatgtaaccgttaacagcatggcacccatggtggcttcgtcattctcaagatatgccagcaagtcttccggaagtgctcaaaggggtagggtgtgcgtatgtgcgtccataggagttagtgtgcgtgcgttgtgagtgcttgcgtttgtactatgtttctaaaaaatatatatatatactttatagaatttgagaaacttcatccttttctttaccacttactagaacacaaaataaatagcaacctgtcggcgggcgtaaatggcaccttctgtcaacaagatttaatgcatcatgtgctgactcagatgattaatcatcctttaattagatagtactaatgtactgagattcctccgtttagcatgcatcttgttgaaatatagataccacccacgatgatgaatgtattcttttaattttatacaagaagtcatatggccatatttaaaacactgccagttatcaatgtgattataataaaaagctacaaagttaatacatgcatagatctacaaagctacaaagttaatactccctacgttctatattataacacgttttggcttgtttatctcttataatataatttccaatatacatatgaatttggacacatatatataaagcaaatacatgaattcgatcaaaacacataacgtctatagtgtgtaatgtgaaacgcagggtacaccgaaaggatcttgaatttgcctagaggggagggtaaataggcgttcctaaaaaattatcacaacttcatagcgtactagagagatgagaactttcggttcaaatcggaacttctggtatgggattggaagttctggtcttaacataaaagttcggcggataatggaataaaatactagctatgaacttgtagctcgaataaacaaaatgtatatgaatcaaaaggtggcaaataaggtatctaagcaagatataaggtcaccaactatattaattaagcatgcaagtagatcgggtaaaaacaagctcaagcacaatatgagagatggcaagaacgagcaaaccaagagaggagacacgttgatttgtttcccgaagttcggatccacggatcctacgtctccgtgataggttaaagcttgtcatatttcactcaaatgataggttaaagctttggtttgtctcaaggtagcactacgataggtcacttttagcaccgagacatacacaaacacatcaacgttgcatccctcttaatagtacggcattcctaaactcaaatgtaaatacgaagagaattataccaataggaatgctttctttccatctttctttccttatcttaagggatgccaatgccgaaaccgtttcaccatatattcttcaaattattgatgcggttacttctagtttcaaatggccttgcacggtccatcatgacaaagccgtcgctcgcccttcaccgctggatttggttcttcggcgccaagctccctgcttgcccttcaccgccacatggtccatcactaccgagcatctcttgcccttcaccatcttgccatagtagccactttgtatcccacatcttcaatatccccacttggtattttaggtgtaatcatatcacttgagtgtcaacaccttttcaatccttggaacctatttttctcattcaactcaatgaaatcattagtctcaaatatccggttgtcaacctctacatgttgaccaaccgatcacatgtataaaaggatataaataaatgaggagtattaaattaacaccacaagtgtcatatactcaaatatatgctcaaatgtaaagatcccaattaaatgaaagtgaatagcatggatcgattacatgcataactaaagtatagatttgctccccctaaatgtatgcatacaaaatgtttgtgtgaagcaagagtatgcataaaaagaatgaaacactaggagcctatcctatacaagaatataagtcatttatcaaatataggcattaaaataaatgtataccttaatcatcttcatgttctcaatgtaaagagactaaacaagagaaaaaggctcaaacaaaacattagtctcacatatatatcattattcacatggaaatattatatatgaacatatcaatatgtacatggagagaaagattgatacatgtagcttgatctccatgcttttcatccttgtgatttaggtccaccatcaatgaacatttctatctcaactcatagaagtccgggaatcacctttcacacactccactttcatatccacatgagactaggcgaagaaatgcttataaaaaaattagtctcacataattggatttatcattaatcaccaaaaccaaattaatggcacatgaactttcgtacacaaatacattggtagttgtcctttgcataatatctctattcagagaaaataacgacatgctgtcagtagttaaaccggacaatatatactctactggagaagtgatctttgctaggtcatgcaaaaattacattagacccggttcgaatagaaaccgggactaaagaataggtttagtcccggttcaaaagcccagcggcactttttgatctttagtcccagttggcaagtcccggttcaatagccacaggtcatgtcaagccctcgaacaaacattagtcccggttggtaataccaaccggggctaaatatcactcttccaagcatctcacgcgctctctctcttccttgtctccttggcatccgcacaagcttttcactccttgtcttcctatcttatcccctctcctcctccactccttctcctcctcctccactcctccgatccactcctcctcttcccctctcccggcaacaggccactcctcttcccctctcccggcaacaggcggtggccttggagggccatagcaggcggcggccgggcggagggcagctaggcggtggcaacggcccggaggggtcatcggtggcgcttatgagcgggctgacgcggcgccggagacgacgatgcgaggacttgtgttgtttttctgatgccattgtatatgtgtggtgctattgtggatgattaattttgttgagtatgtgaatttgtgatgctaatgatttgtgaatttgtgttgtcattttgatctgtgatgtttatttgatttgtgaatttgtgatgtttgtgagtttggcatgaaatcaatatgcaaacagcaaaaaaaaaagagacctttagtccaccaaccgggactaaagatgagcatctttagtcctggattgggcatcccggttgcatacccgggattaaaggggttgcaaataggaagtattgtgggtttctccagtagttatataattgaacaagtgaactgtgatagcgcataagtaatttaggagttggtgtgaaatgattatcaacatggaagtgataaaaaaaatttaaacatggaaaatatatgctatgtcatcgagttggcatgtatgcctctaagattttaccatggattttgtatctttttcttcaatgcatatgattttgcagattttacttcgaaatataaggcactattaatcattggttctaaggccgagggctacactagcatgagataggtcatctcaatcgggcggaaaccatcatctgcgtcgggaagggctcccgtcacaaaccaaaagtcacagatgtgagaagtcatctgtatcgggcatttagtcgtcacagatgacagttatctcaaacgggccaaaaatggtgcccgtcacggataggtttgacccagcagatgagtcaaaccaggaccaaactagggcccatcactgatgagatcatctatgacgggctcatacttcaatcacgggattggtatgattcccatcacagatgactcactcaatcgggcttgtttttaaccccgtcacggatgactcatctatattgggttttaatttaggctcgtcacggatgatatcatctctatcggtcttttatttaagtccatcacggatgagtattttacaaaaaaaaattattttttggctagcctcaggcctttgctagccatgcccgctgaaaatgacagaagaagctatatatattccttttcccaacaaccccgttcgcacatccattcacaaatcaaacattcagtgatcacatcgacattcacacacccattcacatatatatgtctgagacatatattcaatgatcacacatccacattcacatatccattcacatatgtcattcacatccattcagcgacatgcatattcaagagtcaagcatcaaaaacctgcaaaaccgagttataaattggaacaaatttataagtgattagcattgcaagtatatatagaaacgtcagaccgcattgtattacataatatatatatatatatatatatatataaatgtttaaccattgtaaaatcacatgtatttgatcgagagcgttcaacccgtcttttgtctttccaggaatatttagcagtaaccattataaaatgaatggccaaggattgatgctgaatgtagcaccctcccgtagctctagaggatcccgctactcctgaatccccttggtgtgccttaactgacaagtggccctatgagtcgataagaaataaggaagttactggagtatttgccatcttttaaaataaaatgtgtatacgcttctagttttgaacatttttactgctcaagaaaagaatcaattatgtttgagccactcatttgtactagctcggccagtgacaaaacaaaattcaaatggcaaaacgaaatatatatcaaaatcgagagtagaaaaaaaaacccatctctgttttcgtgtgctcagtggatgttcatgttgttgtatggttaacaccatgtgccaatatgcacacgctgatcggcaactatttcttgtatgaaaatgacacagcaagagcgtctctctcgttttatggcaatgttggcttcatgtttcaataattgaggtgattgcgatagatgcaagctagattcttctattcttgtgtgcctcatctgctattcccggtggatagggccgcctgctatgcacactctgatgaatgcggggttgaggaattgatgatgacagctcaagggactgtggaggattccagttgcaataggtgtaaagttagatggcttttgagtaatagtgaagaaattgggccaaatgatttggttcgagaatttatctgggcatgtattgcgttcagcattatattgagctaggatgacttcatattcaactgcagcttgatttggaaaaaagatcctacccaaatacctataaatctcacaacaatttaactaaatgaggatatcgtaatcacaaatggatggcatcacttttttctaaaagcaaacattttgaaatgtgattttaagattaattttagtcaagttatttagtcgtcatctttgcaaccatgaaaaataaaagtggcaaataaccccccccccttccaaaaaaaaaataattctaaaaccaaattctataattcaaaatgagatgtggctttttaggggaaaacaatgccaagtgggattgtttaattagtgttattaatcaggagaaaaacatgtgtagtttatcttaagaactagaagcacaccgtgatttagaactatctagagttaaaaattctcttgaaatacttgttcttcaacctacaccatgatttgctcttataaaataaatttcataaactcctagatattgggtcgtccgtaacataaaaccccaattgttgtgttttattttaagtaacctcatattttggggaaaattgtttcaagaaacatatttgtgtaaactactcatattttaatataatttattattagttttaaaaaattcacatttgttgactcaaagtacatatacctctactttatatttttttctcaattttgcactgcacaattttagtgcagtgcacatcttaagtttttgtgcagtgcaaaattcttttggcaaagtttcgtttggcatgtgtaccagcagccttgggagagtcaggttctcaggttgcagagaatggaagtaaagcatagtgttagttatctgtggaaaataccctggcttcttctggacagttgtttaagaacttgattacatctgttagtgaacttggcttacgtccggttggatgtagaggtcggatttatccccttttgttaaaaaaaaaatatgtcggtgaacttacgatcagacgcacattcctgaggtccattggaatcctgatctcaaattacatggtggactcgccacctggcacagtgtaacatgtgcctggaagggttccaaaatgccgaagataactactatctccatctcataatataagggattttggaggaatatgacacatcataatagtacgaatctagacttgtcacattcctttaatatcccttatattatgggacagagtgagtatttggttattgtggttattggccttgttgagtcgtatccacatttattttttttgaaagtaaagagagatttcattaatgagaaaacagagggttacattcctggttcaagagatcaagaatttctgcaggggaacacaatctccagaccgtattagttcctgatcccattaccagttgggctaaagcataagctatcttattagaatctctctttatcctgtgcacttgcacctgagctaaacataacattgccgctttaacatctgaaattatgccactccaatctgctcttgagacattggtcgcgtttaactcagcgacaacacttgtattatctgattctaagataagtggcatattcacccattcagtagcaagccggataccttccagacacaccaaggcttcagcttgcattgctgagctgcaccgtggtagtttcttacaggaagccagtagcacgaggcctcgacaatccctgattattatcccagcgcctgcttcacctgtgtcctatttgaaacctgcatcaacattcaacttggctacacctttggtggagtttgccacttgcttttcgttcagctgttgttgtatgtatgtctcaacaaacattggtccttttcctttcacatcatcaggttgttgccgagtcattagagtgcaatcttcgtagttcttcaaaaagtcgtatccacatttagaagcgcttgaacaaacaagtcaagttgaaaaaagagtaaaaaaaagtttagaaaaattttgttcaactggtttccgatggcaaccgctcggttcaaactgaacttatcatatttactttgcaatctatcaaaacattgttaggatatgttttgccatcgatccagaacaaccctcatacactataactactgtctcagtaacacgtttattacattccaaacacacaaaaaagaagtctcctactacgtttgtcatcttctattttctcttctcatttccaaaatatggattaaaagatattcattgtattattcgatgaattattttagaagctataattctactaggaaatattagttgaatgtatagctataattcctttttttattacataacagatatagataaatatctagctcaaagagatggaccagttgtgtatcccactcaattatagctacacatgggagatctaaaagttgctacagtacaatgccaaattaataactatttgccttctgaatatagctaaagctattcaccaaatgcttattgttttgacgcatatgaaaacttatttgaccatgcaagagatactatggaagtgagctgatgaaggaacagggatcaggaggactggggattgcaactgcaccatcaagcatttgtgtcacctttagcatgttaggtcgcatgcttgggtcctcctgaaggcaccacaatgccactgtcacaaatctttccaccttcttaatattgtagatcgcctcatcatcgccctctaccagcaaatcaatcctcccagaccggtagcagtcattggcccagtaagtcactatcgtctgttcctcatcgacaacctctagctcgacattcctcctacagcaaacaagctctagtagtatcactccgaagctataaacatcaaccttggtagagatcccaatgttcttgaaccactcaggtgcaacataacctcgagtaccccgaataccggtgtttgtccttgtttggtttgtcaaaagaagctttgctaggccaaagtctgaaatcttggccacaaggttgtcatcaagaaggatattctgcggctttatgtcacaatggatgatttgcttgctacattcgtcatgtaagtagagcaaacctcttgccaccccaagcgcgatatgaactcgggtgttccaatgtgggcgactattgtcgaacaaaagacggttgagagggccattggtcatgaactcataaactagcagtctttcggctccttcattacagaaaccaagcaatctaaccaaattcttgtggaatgtctgcccaatggtctcgacttctaccatgaactccttctcggtttctggttggagcttgtcaatctttttcactgcaatgttggtcttgagttcatcctccaactggcccttgtacacaacaccagaggcaccggcacctagaatctcatggaagccagccgttgccttctccagctctttgtaagtgaaggtcttcaagggtagttgggatttacttgatgcttgtgacaatgggatattcttttttgtggctattctacagtaagtaccaaaaaggaaaatggagatgagtgcaaagttcaccaatatggaggttccaagaatcaaagaactccctaggacccagtgcttcctgttcctcttccatttgttggagcttgtactgatcatggattgcgaactattgctacttggcaccttgagaagaacggtcctctggacatagtcagccatattcccatttgacaaagggagcttcttcttccagcaagtgctggtgctctgattgtacaccgccatggcgcagaagcagtcgatcacacacagccttccacaatcatcttgtcctatgggctcatatttctcatagtcagacagtggccaatccacaccataaattggtctcagctcaaactgagcaagtgccgttgcctcatccaagtcgcagctatgcggttgaaagtcttgcttacaccctttgtacttcttctgctcatcgaagaacttgtaccatggtgggcattggcagcttgcaatctgattcctggtgccatcaaaggtgcagtaactgttgaacccacagacgccactgccaacatctgaaactatggcatggcagatattctggggctgcatgctcactgctgtccatgtctcaccacctaggatgcctgcattcgctttcttcgggtacacatattgccggaaaacaccgtcagggtccagtgtggcgcgatggaagtagtctgccattgatccaattcctgcacctgatgagatgttgatctgtgtaccatctgtcagtgcaaagtataccttcccagtctcactgaataccaactctgagccatttccagtcgtgtcagtggaccaatattgctggtatttggatccagagggaacagcaacaagatacagggcaaggtttccatcagtttgcacatcaaggagaaaccgaccactggagtagtcattgatgtcgagtcgggcacggagtgacttgttgcgagtcttgttgcaaggtatcacctgagtaggcaagatggtgtctgacggcatgtcaaaggtctgccactttgtcgtgccgtctgcaccaaggagcacaaaattgccggtgtcgcgcatgctagcatatgccacactggtaacctggggattccagccctcctgaccagaccggtctttcagtgagagtgcaccatcattagtgagttggagaaaagaatcagatggcacttctactatcgatggatcttggtcagtatttttggcataccagacaactgtcttatcgctaatcttgttgaaccagacggcgatgaggtagaaggaggtgttgccctctacaggtcggaagccaaatgcgaagtcgccagagggtgatagccatgaagaggcaggactctggggtgccaaagtggagcccaatgtgatgttcttctgagtttgtgcacaagttggggacagtagctgcaacagcatgggaaagagtagcagagcaaccattgttctttgcttcaggctcttgcttcctacccctgataacagctggtgagctgccaaacttgtgtagttatagagctatcctaacacttgtcatggaaaggtcttcgtcaccatggaattctacatatacttgactaatcaagcacttactggaatttgccacgcagaaagcagcaatagggaattcgtgtcacgatagcagtaaatccgtagaaattcttgtccagacaaaaacaacaggtaacagctagtgagaccaaatagaccaaggcatcaagctagtcaattctggccattagtagcaccacggggaggatttgctgtcgtcgacattcttgctgaagtagacaggcttgacaggtgttaactagctatagattgccgagaaaatgtttttctaccctacacttcagggcagaagaaatgtttgcatacattgaactcctctaaaaaaaaatgaagcagaaaaaatgtgtgacatgtgtctctgaatcttttgccaattgcataatgactatcagtatcaggtctgagtaacaaatgtttgtactaaaacagcttagtatgcgataaatttcaggcatgcttttgcatagattatgtcaaatacagtgtaaagagtaatattttggtccgattttataagttcggaagttccctaggtcacttcaattctacatgatgaacaataagtagctgtatttggactcactagtcctgggatatttctatcatataacgaacttgaactgaatcacagtttactgaactgaactgaaaacagtaacgaatcgaagtgtcaaactattgggctctacaagcaattcatcaaacaaatcgtatgcattctcgacctaacgactccactgttggcatccaattcactgagtaaattaacaggagggaatcaggaatcaccactgaaccagtactctttgcagaccagttggcagttgccggcttgctgccgctgcgagttgaagcccctcgcccgtggcctccctccccttgccgtcgccgcggccggcggctccgttccggcggatcggcgcgcgccgccggcgatgccatgcatgctacaggctacggccgctcggctagggttggtctctcgctctcgctctccctctccctctccgagacgccgtgcctgccgcctgccgccgacttgacgagtctgaccatcggcgttgggctgcctgagcgagtgagcgggttgaggattagctaggcagttaacagctcattcgcccttcgctctctagctcactaattaccagtttaccacatctttagttagatattctctccgacccataatataagatattttaggtgtatttaatgggaataccctggatcggtccctcggaggagggagaaatatcgggcgctccctccccaccccctcccccgacgcgcgctgcctgcccctgggcccaccacatctctgccctcacctgccacttatctccatcatatactccattgcaacaaattacccacatattttggaaatattctattaaggaaatttagtttatttttgttccaccgataatgtttcatccagtgcactcacaatgtttcactatgtatatatctaatgttgcagtgaactgaaatactctattgcaacaaatcacccacatattttggaaaccctctattaagggaattcgttttattttttgttcgactaaaaatgtttcacctagtgtactcacaatgtttcactatgtatagatctaatgttgtagtaaactaaaacattctttcgctatttgttgaaacattgtttttatataaggtgaaacaacacccgatttaaacgggtgaaacattttcgatctacgtagtgaaacaatttcgatatacctggtggaacatcgtgtaacatttaaaaataattcaataataagctaatttttttatcgaaatatatccatgtgtggtcttgtttttaagatttaattgcaacaaatttaatggtgtaatcggatcatgatttggataagtagtttaagagaaaaatcaatttaaagttgttttgcacgtatacgtggcgttgacggcgctgacgtcgtgctgacgtcagtgcccgattttaaccccccatcgggcgcccgtgccgaagtcattcccgtatgtaacacatactagtataataaatctggatagacatatatgacacatacaaactagaacaataaatcttgacatatgtgtcacatcttcccaaaatcccttatattatgggtctgtctagattcattgtattaatatgtgtcatatctaccaaaaatctcttatattatgggtctgtccagattcagattcattgtactaatatgtgtctgtcgcgtcctaaaacgaccctaaaatacatcctctaaatgatgcctagaataattaaaatacttgtgaaagccttcaaaaattaaaatgtgcaaagttaaaagtcaattaaggcttggaggatttttgtatatttcctaaaagcctaaaatgtgtaaataaattttagtggaattttcagagcataaataataattattaagaaataaacaaagttaaaaaggttttataaaaagaaaaccctaaaaatcccccttccctctcttgggccgaatccggcccatctcccccccctctctcctctcccccgcggcccatccggcctctccccgcgcgcgcgccgctgacgagcgggcccgcccgccaccctcgctgacgggtggggcccacccatcatccccttcctcccgctgctcccgccgcctcgcccgcgcctagcgccgccgccgccgcgaattccgccgcctcccgtcgtccccgcgtgaaatcaataggagggaattactccccgtgatcccctctccctttccccccattttcccctctctctccctcattcaaacgggcggatttgcccccgcaaatttcgccggcgccattgatggcggccggacctcccggccggtttccttccatccccggccgccctctctcccttccaaccccatttaaaccctccctgcacctccttcgcccgtttccaccctttgccgtgccctctcctcgccggaatcgagctcgcgccgtcgccctctctctcctctgtcgccgacgaccttcggccggctctctccgctcgccgggaccgtctcccgccccagtgtcgccttctccggcttcgccgcaccgccgccgtccccgtccgcccccccgtcgagctcgccgaccgccggagtgccgccgtccccgtccgcccgagccgcgccgccgccttcctttttcgtcgtcgccgtcgacctagggtgagccgtggaccgccgtctcgtttccccctttccctcccctctctcggccgccgctccaccgtgcctatggccgccgccggcgaccataggggcgcgggcgcgccgcctcccgcaggccgcgccgatgtggccgccttcgggcgcgccgagcggctgccgcgtggggcccggccgtcagccgcccgcgccctcgggtacggctgacgcgtggggcccacggcgccggccggtgtgagcccgggtgcacccggtccaccgtggaccgtgaggctgccgcgtgggccccactcccgtggacccggt

SEQ ID NO: 74699 - DNA, 6614 bp, Oryza sativa
cagctgccgctcaagactacttttgctagaagctgaacagaacattgttcatgccgatcaagaagctcagcatcaggaagaggaagagcttcacatggtggatgatgcaacaatgaccctcgagcctatggatgaggaggataatggtttcaacaatgtcatctgcccatgtccttcactggagttggaggaacacagtcactcagctacaccagccatcgatgagtgtgatacagccactcctgctccaggctctgcaatcccacagcaaagcactagtgttgatcaagatggacatctggaaaatcctaacgaaatgggccagattgaactaatggtggaacctatgtatgtggatcacaatgattccaacaatgtgctctcatccagcacgtcagctcaggcgctgttggagaattgtgaagtagcagaggcagtcaatgaaaatgtcgatccagccacccaagttactggctcatctaccccagaacagggcacggatgtcatagtagatgctgaacaagaaaacccagccacaacagagggcaactaacttcaatgccgtcccctcgtctgcaaaggtgacaggcgattctgatttctccccttatggaccaattcgtgccacctatgtatagtgcttagatgccgttgtccgaaggttcagcatattgctgacatattgccctggttgtttgaccatgatgggctccactggaaattttagccgtaattactgatgtagcttacatatctcttgctttccaaagtcattacacttatcattatcaacatttttggtttttttttgtttttgaacatgcattcgattttcaattggaacttaacgctgccaatgcatatactatgttcttatacaaagaacaagaaaaagaaaaggttggaggtaggtaatggcgtaactagttgggccacgcacggcgaaactagtatatgatgccaatgccatgatggtcaatattgctttcatattaaagttttttttacattttgagttgattttttaaaagtcaagatgaaaggggagaccacagttgaaagtttcatatgatttgagttggaagttttatgatttaagttgaaattttcatattaaataagtgctatgaaagggaaaagaagtgtggctgtgtgctaggcgaggcgctagcaatctcgtgggggaagcgaagagaggcccaaaccgctggttgcctgcttggcccatgggtttgagaagaccatgggctcgagcggcccaagaccatggacttgaggaaggagtcgtagtcgtcgtatcttgatgacacgtgcgaccggcccgcgcgctcgtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggcatggatttcaggaaggtgctcgaccagaccgtccgggagatgtaagaatcagaatttttatttctccttctccgccccttttctcctcctggtgtactcctatcttgtaaagatatttttcttcttgtactttcagaaggagggaggtaaatcttaaggtgctcaaggtgccggaaatcgagcagaaggtcaaaatttctttcgattttgccgtcaagagtcaaaatttggaattttgggtggtcagatggtttgctatttacctggattttgtgattggcgattgaagttttttccccgatctcgtatgcaggttcttgatgccaccagcgacgagccgtgggggccgcatggttccgatttggcagatatcgccagggccaccaagagctagtgagtagctcaaagctaaaaaaaaaaatcagaacttatttcccatttgtttatgagaatctagcgtgtttcagtttacgacttgggggcgttgcacattttgattgttcgcataatcccattgctttcttgtttcttttccagcggtgatagcgaaattataatgaatgtgttatggcaacgcctggggaacacacttgcgaattggcgtcacgtgtataaggtaataagataggattgattgtgcagtgatgtgctgtttggattgattccttaataacaggatgtttcaatcattacaggcgttggctgtgatcgagtaccttctagctaatggcaccgaacgtgcagctgatggcattgttgacaatagctcacgaattgcagtatgggtccttcgctagtttttctagacattgatatttcattgtttatagtacttgtcgtctgatgctgatttcttttgggaagaaactcacaagatttgagtatttggagcctaatggaaaagatgttgggctcaatgtgcgtaagaaggctgaagctgttctagcaattttggatgacagggagaagcttcaagaggtcagagagaaggctgccgttactagagacaagtaagacattctgtagcccattagcgacattattgcatttcttgtacatttgatgcttacttcttttcatgaaccattggtctaggtattttggcttatcatcaactggaataacgcacaaatcgagcgcagcatcatttggcagtggcagctactcatctggtagccactatgggagcacaggaggttcaagggaggtgggatcattcaaggatatacacacaggcacagaatggaaaaagaacaagaaggaaacagtgtcaaactacagcagcaatagagaagggtctaaagaaattactaacagtgcaaccagttataagtcaaaaaagagtgaaaggcatggtagaaggtacctcccagttctactccgtctttttcaggttttaccatcaacaatagatagtagtggtgccttgaaattatcaagttattgagcaatgactttggaatccaatcttaagttactaaatctgatacttttactgtgtgcatgaaagaaatcaaaattccttaacattacactcgaagttatctgcaaatattagcaccacatctgaagccccaagctcaaagaaaggggaaaatgaggatgatgatgatttcaacccacgaggattttctacatctagtaagtatttatctgcagtatcttaaatattcatttgcatttatgattacaatggtttacctttttgttgcacacgtaaagttctaaggatttattcttgtttgaccatagtcatcatgttgccatctggaaattcacttggctgtatgtttggaactcagctggaacaggtaccacaagatctaatcacctggatctctttggtccaagcttgatggatgatcttgttgattctactacatccacttcaacagcaacgccaaatgttagcacacctgctgtgccagaggttgatttatttgcagatgcagctttccaatcagccaatgctccattggaggcagcaacggtttctcacactcaggtttatactttactaatagccttttttttaccatgattcatttttcatatccctaaatgtctgtgagaactacttactcaaatatgttaccaagaaagtggaaaaataccccccttaagattcataatttgcatgaactatattgttgaaacttgaaacttcattcattatatgtttccgtccatgtattttcaaataaaatacttggggaattcgaaatacatgagttcattattctacaactcattatttattttcaaatttcaatgtaggacaaaattgatttgtttgctggcagactgtcttctgctgattcatttacttcagacacagagttctcagtacgcggtagtcctaacaagtcatcggagaaaaaaatgtcttccgttgtgcatccttctacttctgcttttgatcccttcaaacaatcttttgccacctcatttccttcagattcagagttctcagttcatgatccgacaagcaaatcttctcaaggaaaaactcccacaccagaacattcaagtacagcagcttttgatccttttgctgcaattccactgaagagttttgatggatccgaatcttttggaacattttcttcgaacacagcctcaaacattactgaactgccacgggattcttctgggggtcccaaaagttctgaccatggtcctttggaggatgccaattttgatgccttcacttcacacttgggatcttccacaacaagtgcaactgagtccatgaataagcccatcaaaaagcttgggcaggactcgatgtcagcatcaaaatcagttgcaaagaaagaaacttttcaggtcaaatctggcatatgggctgactctttgagccgaggattgattgatttgaatataacttcgtgtaagtatttttgcactttttcctgtcatgcatgtagttcaagttcggtagatgcaaagtagcaaacataaattgtaatatgtatgtccgaatttgcaaggttcaattcattttagataatggatagaaattcggcctctataaaagtaaaagattcctagtgaactgtatattagattattagtatccttacaataaaacacaagcataagaataggaagggtcatcaagcacaactcaaaaggctaattatcctaggtgctaaaaaggaagacgcatcatagctcatactgtattgttgtaatatgcagcacaaaagaaggtcgatctctccgatgttgggattgtcggaccgctgagcggcggatctgaggataaaggcccgggggcgacgatgggcacagcaccaggccttgtcagttctagttttccatctaaaacagaaacatccagtggaagcggtcattttcagcaccaacagtttggaagctttaagtgatttttatccaggatatgtcttttgttctatggttcttgcagagtacttcttggagcattcgtacagctccatgcctataagagtaaacgtgtatatagctaccaaactctgtgcgatgatcaggagacgtgttgccaactaaccagcatcttctctgcccttgaggcattaatatttttttacttatggcgaaatggatatgttttgtgtacatgagtaaagaaccaatgccatggtagcaattgtaaaaagggttcatcaattatgtgtgatacacgctcatatgaattttgaaaaatgaataacgcaaagcattctggatgctggcagtggcaaatgttttttttagcgaaacagtacttggtgtgcccttttcattgatacagcgggaaaaaaaaactgtaccaaagccaaaactttacagaaagaaaaatactagggatgatctgtgtttggctactgccaagacccaagatttgcccgccttcctaattttcgccgctagggaccgtgctaagagttctttatgttgaaacactctgtgaaagagcatgtagcctagtggttgcagtgacttaagtagcatccgaaggttctgagttcaaatcgttcttaacttaaaaaaaaaaaaaaggcaccccaaggtcctgagttcaaatctccgtaactaagttcctatttttttaaaaaaaaactgaatatatctggttggatatagaagtcgggtaaaaaaacttttaaaaaaaatgttgaaacactctgattcctttctttccatatctcctaagcaacacggacggtggagactcttttcttagtcatctctaaggtactggccaacgttgtcatatctttctttccatatctcctaagcaacacggtggagactcttttcctagtcatctttgaggtactagccaacattgtccaccaagtatggatcaaatatttccatatctcctaagcaacacggaggagactcttttcctaggcatctctgaggtactagctaacgttgtccaccaagtatggatcaaagtaacggagttccaacttattggcttgataagtgttggtttctcgcccttcatggcgtggccctggctctctctctctctctctttcttttttttttgggggaaggggggatagcattggcccccccccttttttggggttttggaaaaaaaggggttttaatatgttttagctgtttaatgtaagatatatttgaacaatatgccactgtaattgatcagacaatacttggtcgattggtcctaacacaaattttatttcgattagtgtcaaatgaattgtcaaatcaatccaaccatccttaacataataggattgcatcaaatcatagaaaatcaattgtgctcaatgcatgtctcaacctagtcaaagtttgattccccaatcccaaccatcttaacatcaaagaattgcatcgtattagagtaaatcaaatcaaatcaatcatgccctattctcataacatagtgggggtcgaagtttcccccaacacccaaccatccttaacatgtactcgtagtaaatcaatcttgtggggtcggagttcaattccctgaacccccaacccatcgtcaaataccataggcaattgcaaatttactacaaatagttattacaaaactgccactagaaaattata

SEQ ID NO: 74700 - DNA, 7057 bp, Oryza sativa
acaatgtggtagcatgttatacaactattagcattaagtgttctcagaatatcatatagctgccaaaaaaaaaacctagaaaacaaagtgcatcaactctaacaggtacctccatacctgagaatgtattttgtgcgggtgctggcgcaggagtaggagaggaaggagatatcacgggatatggttgtccaggaactgcacatgacatagttttacaggaatgaagccaaaaaaaaaaaaaaggtaaaagcaagaactatgcccaaaagaaaccttacaagctagaagagaggtatccaaaataacaaaataaaacatcataaaagaacaaagtggaataatatcattgtatttgtaccaaaaagggagtgctatacagatatgaatgataacattgaacaaggttaacccgcaaaaatgcaaaataagaaaataagatgaagcacctagctaaccaaaaaggccaatattgccaaatattaaacgtattgtggtccttgcctgtaacttagggtctcattctattaaatacatcaaacagatagtaccttatgtttggtgacaacacaatttggttaaattcttagtaaaacttagaagcatggcatgtgtttcgagtacaatcattcgatatcacaatgtgcctccttgtttgtgccaaatttgtctgtagcagcacatcatcagatgccaccaaccagtctaggaatgaagggattattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgtgttcatgctattaagttgcatgcaccagccagttgcacctaaaagcctaagctgatagggaaaggcgggcaattcactttatacactccaacacatgctccttcctatctgaggtgatctcaagcaagaaatgaactgttaaatccagttcaatatagctgattactatgtaatgggcaagcatctctgttcctccctcattaaataacgctgcatctataaattattagaccaattaatttcaccatgttcatgaaataaatggtaaattctcggttcagccaaaaagaaaaatgcagtataccgtgtgtaaatagggaagtttgattgatcaaattgccggagtgaatgatcgctaaacatttgttcacctgagttgagtgggatgtagtacacctttcccgtggttataggatcagggccggccatgccattggcggcctcgatggcgtccatgctggccccgaaccgacttgatagcgattgcaccgtgtctccgtcgacgccgacgtagctgaggagatagttccaggggccggatgagcagccacagagcaggtggagagccaccacggcgccggggcgcggcggccgcagagccggtccgcccggcggcggcacggctagccccgcgtacgccgcggcagccacgtcggccgccgtggcgttcgccgtcgccccggcggcggcggaggggacagtgtaggtcgtattggcgaggtatgtgcgggaggcgaggcaggagcagttcttgcggacgaacgcgtacccggggctggcggccgcgtcggccgtgatgtcccccggcgcggcgtcgaacatggactccagcacggaggcgttcgcggcctcgccggccgccgggaacgcgacgaacgccgtgcagacgcgcgagagctcggagcaggggagcggcgccgaggcggtgacattgccgggggcggcgtcatcaccggcgacttcgccgggggaggcgagcgccaggaagatgaggaggatgagaagcccgggcgcgggcgggcggcggcggggaggcggcattgaggggggctagggttctgggctcgaggtggcgaggtggtggtggtggggcatggaggtggcagtggcgagcagcgagctggatgcttcgcgtggtcgggtcactggagcacactctgggggacggcgcttttagtaagacgacggggttaattagcaagcaaagcccgcaccgcacgcacggccatgggtactggactactagtagatcactgtctccttcattccttgtgtgttatgcccatattgcccttgcacgcatcaataatccgcccgtttttgcttccgtcggtctgggaggtggtaacggataatggtttacgacgcctcaacttgttgagtgctatctctgtttcaaaataaatttactttcaagtaaaatacatcagcggtccttaaaattatcgtgaggtttcacttaggtccacaaacttgtaaaacgcacattgagatctctaaacttggtttattgtatcatttcggtccaaagtctcgtttgaccgtagtcttgcctacgtgacacgccacgtggacgatgacgttgaattttttattttttttctcccttcttttcttttttttctcccttcttcattttttttctccggcggccgctgcaccgcgagctccacagcagcgcctccatctccttctccatcagcctccgctccgctcgccgcagctttgccacccgcttcctgtgacctcgtgtggcctcctctctagctccatgccagacaccccgctgtcgtcttcctcgtcacggcgacgatgcctaaccctccttccagctcgatgaactcaccgtcgtccgaccactcctcttcctgcagcggcttctcgacctcgatgatgacaacgacaacgacgacgtggtgcgaagctcgcgacgttcattgtgccggcggagatctacccagcgaggctgcgtgcgacgagccacgggatatcggcggcgtcggggaaggtgggcgcgatcatcgggtcgttcgggttcctgtacctggcgcagagccctgacccggccaaggcggcggcgcacggctacctgccaggcatcggcgtccgcaactcgctgttcacgctcgccggctgcagcttgctcggcttcctcctcaccttcctggtgcccgagcccaagggcaagtcgctcgaggagatgtcacgcgagaacgaggtcggccagccatgatccacccgttaattccaccagcatctgtatgcaagatccatgcatatgcacggttagtccactatgagatttttgttctcttttttctagaatccattggaagcatatgttttcttctctttttttttctttttggggtttagagcggtgacaattagaggcagtatgatgaaataatggccgccaattaattgttgacgacaatgtagtttagcatcaggtgggtcatataatggacgatcattagggttcatgctgattctgtttcggcacgagggatcctcgggttcgctccttttttctgttgatgatctcctccaaaaaaacaaaacagaacgcatctctctctataatcaaaaggattccagctcgatgaactcaccgtcatctgatcactcgtcttcctgcagcggcttctcgacatcgcctttgtctggcgaggaagccgcacggccgacgccatcggtgtccgcgaaataacccgaagcaagacgagtcgagatcgacaatgacaacgatgacgacgacctggcagccacctccatcatcgccgtcgccgccgctgcaatggtcggcgtcgcgtcaatagatggcaaaactccgagaacacaaccacgagacgacgtcgacgttattgcgtgcacaccacttgcgagacagagagcgcgcacgtgcggtggagaggtggaagaaggccctgacaggtgggcgccggccctcagcggcagatgggagaggagggaggcaaagtggaaaaaaatagagaagggagaaaaataaataaaaattacatgtcatcgttcacagggcgtgccacgtaggcaacatcacggtcaaacgaggctttggaccgggatgatacaataaaccaagtttagagatctcgatgtgtgttttacaagttcgtggacctaagtgaaacctcatgacaagtttaaagaccgctggtgtattttactctttactttttatattttacacgtatgaatacaaaactaaaagtactttatcaaatctcaatagaactatttctcatcttatcttcttctaatacaactgtttcctattttcacaaagcatgatacaatgattactttaaaaatttattttttaaaaaatggaagtaactataaataaatttaatatcagaccgaagaagtaaaaagcttaacataatgatgatcattgatcagggggagcgaaatgaatgagcttccaatgtaaattttctttccgcaaaattttattttgtaatggttcgttgtcgtcttattaaccttacgatatgcaccacaatgtgtttttaacagtgaaaagaaatatgtattcccttcgtttcaggttaattataagatattttaagtttggtcaaagtcaaactgctttaagtttgaccaaatttatagaaaaaagtaatattttcgacccatgataaatttttattataaaaatatatttaattattaatttaataaaactaatttaataatataaatattattatatttgtatataaatttagacaaacttaaagcagccttataatctaaaacggagggagtagttgtgatacagcaacattggcgtgtgttggtgttcaaaatcaaaaactaaggcttagggtagcatctctggataaattactactggaagtgtggttatattacaaaaactggatcattggatgatggatccaactatcacaacatcgaaaatccccccggttacatctatcaacaaatgttggtttctgacagttcccttcatatcgatcaatcgtccgattgcaccaaattaacaacagtgataaaatttggtaagaactaaagataggctagtaagctacgataatataataaacttaaaacttactaacaaattatggcatgtataatatcgtctttcatgataatcttctaatgcgaattaaacaggtatttgattaattagttaatcaatatatatcataacaaatataaaaaagtaaactcgggcactgtaaatatatccattcctaagatcaaagaaacttcggggagcgacgtgggaattgtaaatctaccctgcgcgtggatcaatccacgtacaaaacaatgggagcagggccaaacccaggaccgcacaattaacgagcctccgtttgtctttgatacactattttcactctttgaaaaaggttagcaatccaaaagctcccgatgatcaaagattccattagccggctagttagtgttccaaattaaagaagagggggtaacagggtagcaactgtaatgctgcctcttcctcattcggacacttttgcggtgagtattctatcccccacggcccacgtattatatgctgcatactgttcagtgatgttcaccgagagagagagagagagagagctactgctccatccactgtttggtttctcttgccatctctctgcgtactgctacgattacaggaggatgtactgcaacttatggtaccctgagcaatgaatccaccatgtacagaatgaaatcgtttcgcagttacaccggcactattgcactaaccattaattagcagcatagacgggctgagtaaagcagggtagtagtactactgcccgcaataaggcctggtttagttttcaaaaaaaaaaatttcaaaaagatcacatcgaatttttaacacatatatgaagcattaaatatagataaaaacaaaaactaattacacagtttatatggaaatcacgaaacgaatcttttgagtttaattagttcataattagtcataagtgttacagtaacctacgtgtgctaataacggtttacttatgcttaaaagattcgtctcgcggtttgtaagcaagttataaaattagttttttcgttcgtgttaaaaactctttctaacattatcaaacatcccatgtaataccaaaaattttcttttcaaataagacctcggtggtagctgggcgtcgttatggcctgggccgagcggcaacgaaggccgatgtagccaaaaggccccgcacgtgggggtggccgacagctggttgcccggtactactaccatggaactatggcagctaacgccacgcgaggagggagccccgagtgggcgaggaggtgggtgccgtggtggcgcaccgccacgccacgcgacgccactgccagcgtcggtacagacaggcgagaaaagaacgatttcctcgctgagttgtctgagcgttttcgtacgagcacatccactcagatctcccgggggtttattttaagcgcctcgcccgcagctcacaaagcctgccgccgtgcgtgcatgcgggctgcgcaccagcaccagctttgcgagaaatataagatggttttcttgattatacggcggggtttgcgtgtgctacgtgctgtccgaatatttccgtggatacggtggatgtatagtggttacagtattatcccgtactactactactgtgtcctactgtccttgtttagtactccgtaggaatttagggcaaagctcaacacagaaacagaaaagtaggtgaccgaattgacgcacgcggtgctgttgctgttgctgaacgttagtaaggccgagtttagttcaaaactttttttaaaaaacttttaacttttttatcacatcaaaacttttctacataaacttttaattttttcttcacatcgtttcaatttaaaccaaacttttaattttgacgtgaactaaacacaccctaataagcagtcccggattgaagtggaactaaattggcagtgacacctaggggggacaagaaaaatctcgcctcccatgtcgtgacagctgtgccaatgcttaattcatgcgtcggtaatgcaaa

SEQ ID NO: 74701 - DNA, 3452 bp, Oryza sativa
ctcttgcgattgctttgaacaaaagatgcaaatatggggcttacacaagctgcactaataaattttcctatagtcgagatgtatttgcctgagcgagtgatgcggcaatttgggcttcgccaatccattccaccaccttttcgacctaccctacaggcgctgcatcgtattagtcgacgtggcagagaacgtgagaactgggaagagacacatcatgagtacattcaggaatgggaagcccgccggcagcgcatatttccagagtcagagcagtatgacccatcgtcttatgaggagtacctgcattggtactcaggagttacacggcggtatcttgtaccatcaatcagtgatgatgtggaagcaggaccttcattacagcctgatgattccattgatctgcagtatcaagccaaggctcctatgatccgcaaagcagtaagcctatattatctattcagttcctatgcagtttctgtagttgattggacctaaatttgtgtcagatataagttgtctttgcgagacttcaaatagtttttacaatcactccatgcataatttaactaatatatttaactcgaagggtctgctgattgttgtaggttgataaactgcacggtatggtaaagaaggccaagatggccatgacatccacagctgatacaaccaaacaagccttggtctttgagtttctgcatggctttcaggatgttctccatgaccttggcgagatcaaggaaaatggtggttccgctactagtccacatgttgaatcagctgccgctcaagactacttttgctagaagctgaacagaacattgttcatgccgatcaagaagctcagcatcaggaagaggaagagcttcacatggtggatgatgcaacaatgaccctcgagcctatggatgaggaggataatgggttcaacaatgtcatctgcccatgtccttcactggagttggaggaacacagtcactcagctacaccagccatcgatgagtgtgatacagccactcctgctccaggctctgcaatcccacagcaaagcactagtgttgatcaagatggacatctggaaaatcctaacgaaatgggccagattgaactaatggtggaacctatgtatgtggatcacaatgattccaacaatgtgctctcatccagcacgtcagttcaggcgctgttggagaattgtgaagtagcagagcagtcaatgaaaatgtcgatccagccacccaagttactggctcatctaccccagaacagggcccggatgtcatagtagatgctgaacaagaaaacccagccacaacagagggcaactaacttcaatgccgtcccctcgtctgcaaaggtgacaggcgattctgatttctccccttatggaccaattcgtgccacctatgtatagtgcttagatgccgttgtccgaaggttcagcatattgctgacatattgccctggttgtttgaccatgatgggctccactggaaattttagccgtaattactgatgtagcttacatatctcttgctttccaaagtcattacacttatcattatcaacatttttggtttttttttgtttttgaacatgcattcgattttcaattggaacttaacgctgccaatgcatatactatgttcttatacaaagaccaagaaaaagaaaaggttggaggtaggtaatggcgtaactagttgggccacgcacggcgaaactagtatatgatgccaatgccatgatggtcaatattgctttcatattaaagttttttttacattttgagttgattttttaaaagtcaagatgaaaggggagaccacagttgaaagtttcatatgatttgagttggaagttttatgatttaagttgaaattttcatattaaataagtgctatgaaagggaaaagaagtgtggctgtgtgctaggcgaggcgctagcaatctcgtgggggaagcgaagagaggcccaaaccgctggttgcctgcttggcccatgggtttgagaagaccatgggctcgagcggcccaagaccatggacttgaggaaggagtcgtagtcgtcgtatcttgatgacacgtgcgaccggcccgcgcgctcgtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggcatggatttcaggaaggtgctcgaccagaccgtccgggagatgtaagaatcagaatttttatttctccttctccgccccttttctcctcctggtgtactcctatcttgtaaagatatttttcttcttgtactttcagaaggagggaggtaaatcttaaggtgctcaaggtgccggaaatcgagcagaaggtcaaaatttctttcgattttgccgtcaagagtcaaaatttggaattttgggtggtcagatggtttgctatttacctggattttgtgattggcgattgaagttttttccccgatctcgtatgcaggttcttgatgccaccagcgacgagccgtgggggccgcatggttccgatttggcagatatcgccagggccaccaagagctagtgagtagctcaaagctaaaaaaaaaaatcagaacttatttcccatttgtttatgagaatctagcgtgtttcagtttacgacttgggggcgttgcacattttgattgttcgcataatcccattgctttcttgtttcttttccagcggtgatagcgaaattataatgaatgtgttatggcaacgcctggggaacacacttgcgaattggcgtcacgtgtataaggtaataagataggattgattgtgcagtgatgtgctgtttggattgattccttaataacaggatgtttcaatcattacaggcgttggctgtgatcgagtaccttctagctaatggcaccgaacgtgcagctgatggcattgttgacaatagctcacgaattgcagtatgggtccttcgctagtttttctagacattgatatttcattgtttatagtacttgtcgtctgatgctgatttcttttgggaagaaactcacaagatttgagtatttggagcctaatggaaaagatgttgggctcaatgtgcgtaagaaggctgaagctgttctagcaattttggatgacagggagaagcttcaagaggtcagagagaaggctgccgttactagagacaagtaagacattctgtagcccattagcgacattattgcatttcttgtacatttgatgcttacttcttttcatgaaccattggtctaggtattttggcttatcatcaactggaataacgcacaaa

SEQ ID NO: 74702 - DNA, 779 bp, Oryza sativa
gagatcaggtaccgctaaaagtatgggaatcaggtttcttcttctattgtgggacaacaaacaatctatccccgtttcaacatctgactaagtaaacaaggattagccacaatcaccatcaattcctacacggaacgccccccgcgtcgggcgaatcggatggggggttttgcagcgggaaggatcgggatgggagggtgcggtaccttgagagagcgcaagtggctcccggcgatgcggtacatctctgccgtgcgcgtcgcggaggcttggaggaggcgaccggcggagatgaggggagccgccgccggggaggtgggagacgcgggtgcgaccgtccggtgcggcgcggaggttgagctcggccgggtggagacgtggagtggtcggatccgaactgtgcgtaggttttgtgggaatgggaaggctctggttttgtgggcttggtcatgacgggcttccatagaatcataggccgaaggaataagttcatccgaggtcccttaattttacaacaaatccgattttcgtccttaaaccccaaaaccagatacaaccggtccccaatctgtcaaaaccggtgcccttggcggttttgaaggcggttttagctgatatggcgccatttgactaggtctccgtcccacgtgacattgatgtggcgatgaccgtggcaattatatctcagaaaaataataaaaatcatgggcccacatatcaaccacacaaaaaaaatctaaaaatgatggggcccatatgttagctacaaaaataatatg

SEQ ID NO: 74703 - DNA, 9765 bp, Oryza sativa
cgtccattaatgaagagaaatcaagttgaagggaagagagaatgagtccccacacaaaagaaagagagggagagatggtgcatgtggtatccccttgagatataaaaagaggaccttgtctacttaaagaaaaaaaaagagaagacgatcccagaacgatcgggggctggaaggggggatgatctggagagggtttttagaataagagctctctggctctccagctctttgtaacttcttcatacacagattcaccagaacacaggagtagggtattacgcttctcagcggcccgaacctgtatacatcgcccgtgtcttgtgctttttccactctcgcgaactttccacagactaggagcttagaatctcacccagggcccccggccgaactggcaaaggggggcctgcgcggtctcccggtgaggagccccacgctccgtcagcgcggctgccacacttgggtgccagtggtagccacccttcatggacatgatgccgtggtgaaagaggcgagcggatgagactaaaacagcggtggcgggcggttgcctgtagcctgcagcgtagatgtgtttaaactagaatgctctcagcccatagctagcgcagatgtaaaattgattgtcgcaggtggatatttggctccgagggtcatacccgcctagaaaaataaaagtccaatgtcgctaaaaaatatttttctagtagagtgtgacgccacgtcggctgaatagaaaagcaggcttggactccagtggtggcttacccctatccaaacaatcacgcaggatgttgtagcttttcagcggccacatttcgatggtgatttcccttcctagacacagggattgagaaggtcaagcgctttctagtttagcaggcgacccatcaagtttgtggtattttttgataggggagattctttattggtatgaaatcattgttctatatatggaattttccgggagataaataatctggccgacaaagaataaaatgaggaggaaaaaaagaaatagagaaaaattggggagaatggcatgaaatcaaacgattcacagtcctggtggcatattttgacatgtcttgcgaattgagtgacaaatgcgcaaagcatatcatattatcaaatttgttaagaggagtgtgagataggactggaaatggggaatagtcggaggattagtagtatgatccattagtatatggtagtatggtagtcacacatggatcatatcgtggcagtcatcaaattccgcgcgagaggaaatgagcgcggtggcacagcgagcagcaggccttaacgagcaacaggaatacaggatagcgtgaccgatatccccttcaccaagacaccgaggctgagcctgtcagcgtgcaggcctagaagagcatctcactacaacaagcagggctataattatctgaaatttaatactcctccgtcctacgatacaagtgattacatcattttttataagaaaaagatgaagaaaaaaaaatgatatgtgatggtacaaaagatgatgggtgaaacaataaaataatacaaaagttggtaggtagaggaataaaatggtataaaagttgataggtgtggataataaagtactatcttgaaatcctaaaatctcttatattttagaacataataaaggtgaaaatatcttattctatgagatggaaggagtattctgcttctctgattctccaaacaaacctccggttgttgtgttctgtctctggctaatctctgatcttgaattttgctgtctatatttggcatgagggtcaacaatgcgatgaactagtaaaatggcaggatccatgtgtgtataactgaatatacatgacaatttaaccggtgagaggatggtgagttgtggtttgctggtctatggttctatatatgcgtctatcatggtgttctccgccatcaaggatccatgtgcaagtacatggagcggtggcacgaattggtaacgcgatctcgacgggatgggcagcatcgagctcaggacggtaagagggtggcaaagcgctcgcgacgggaagagaggtggcacagcgaaggaggtggataggaaaaaggaagattcgatgataggggctagagtaaaaggcattagcgatgcacggacttgttaagtgggtataatttagtgtatgaacttgtaaaatgctcattttggtgcatgagcttgtctggtacttgcaaattgaggttaaaatggtatgacaagaccgatttttttatgttgaacattataaattataaattaatatatcacgtatgtgcaccatagtagaaaggtatatttgtaaacttagttttcactttatctttctttttgtcttttttttctatctcttgcatcattacttgtttttttatgcaatcattatgtcttattatatgtttatccatcttagacacatgtttacatggagtttaaatcaaggacaaaatcagcaagattaatcttgccgtgcaattctgaccttgtttgcacacaccaaacaagttcgtgcatcaaaatgagcgtaatacaagttcatgtactatattgcatccacctctcacaagttcgtgtaccgctgatgcaatttactctaaggaataaattgccctcactgatgtggtgggtaattttctaaagtagtataacattgacaaaatacccatataaatgaacggttagattacatacatactacctatacccctactcctattactagaatgatgcactcttaaagaactctctagttaatgttgttgtgaatgttcaccatctaaagatagcaagagcacaagctagaaaaaggaagcatttagaatgaagaacttaattttaactaaaccactatctatctatctttatatactaaaagtccattaaacttcctacaaacgcttctaagccgccacgtgttattcctataaacactcctcaatcgccacgtggcattctaatatatcagtggacccactatttttaattatactagattatctttaaaaaaataccacagcccacctccctccctctcccaccggcccacactgcaactacatacgtacgtacgtacacgtagtatatgtacgtttcctcctctaatacttcctctctcctattctctaaaaaaaaacctccctcactccttcctatttaatcctattatattctatagctaacaattttttaatatagaaaaaatataaaagaaatgaaatatcttactgtgcattttcacttaagttggtgaaacctactattttaaacattagatttaaagatgtacataattcaaatcaatgaatccattaaatctatatttaatgaaataaacaattttgaacatagatcgttattgtttgcatggccaccaaagaagaaggaaacataaaaaaaataacaatatctattaattatgccatcttgaatcatttttacataataaagattgattaaatgtcctctataacgctcttaagtcaccatgtctcatgtctcatgttttaagtttagacattcaaagaaaaaaaataaaacatgtaactatgggttttcagttaaatcggtaaatccactgttgttaaccattatatcttgcagctgcaaaaggtcgggtcttgaagataaaaaaaaatggcatttcagaaaataaaaaaaatcaccagtttccacttggatcgtttagaaagactagaaaaacgaagtccctccaccatcaccttccatcacatgagtataataatgctcgcctatttccatgtctcgctcgagctctacgctattcattcctcttcagactcccctccctattatcagctatatactaaatgtgcaacaaccaataattgcagatattgacaagacaataattttaagctatacttataattaaaccgatccatatgcctatattttggcatttaagaaatattgtcaatatctatttttgtcattatacatcagtctagaaacaggagtagagagcaaaataaaaacataaaaaaaatataaattcatgtttcaatcagtgttcttaatgatggacaatgcaacttttgtatggcacccgaatcgccattaaatactttaaaataattaaaaaaacaaaactataaacatgaataactaaaaatatacatttcactcagtacataagaaaaaaaacagctcaaatgtgagtaggccaagccactacataaaaaaatggactaatttgctaggcatgtgttctaaacaaaataagtctactttattgttagatgatgaagatgactataaataattgacggggagattagtaaaattgcaatgctaatgaaaagattatggagtaattgtacttttgaagtgcgataaatgttcttttgtttatataccacccttattgtgtatgaaacgctttgttttacaaccagaaacaccgttagtaattgcaatgcatggcaacataagttacgctttgtttgtaagggtagaaaattaactggattatttatatcataatttaagactaagatatctccaaaattcctacaaacgctcctaaaccacagtgtggcaacctacaaacgcttctaagccaccacgtggcactacagtaaattagaggcattcctaaaaattttgacaaaaaaacaaaacaagtaatcattgattttcattaaatttggtggtaatcccccctcctctccccgccacgtggcctactcaactacttcctctgtttttcctcttttccacctatttcatctcttatttttatgctttattagttagaaaatcaaaaaaaaaattgtgtcgaagaactaagcaaccataacatctaaatcatacaactaatttttatctgcttatatctttaaattatgcatgactaagtttaaagtttaagaccaaatttcattataatgtaatttgggttatattttttgattttttgcgtgtcgttcaagcaactataataataataataataataataataataataataataataataataataataataataataataataataataataataataatatatactggattttatcatcctacataacttcataatgatcaaattatatataaagtcataaaagtaaaatgaaaactatgagtaatattcccaaaatatattagttaggaagcaaaagttattctaaaatgtaagaaaaagcatactaatatttgattcgttgtaacccataaaataatattataatcatctcctatcattcaattcctccatcttctaatttttaactaattaataaaaatgattaataattggaaagaaaaataattataattcttaatttatatctgatttttagtttattttagttattgttttatttatagttaaataaatatataagatccatattagccatattttactgtataaaaataaaaatttgtcatttgatcatagacaccaatcctttgtgtggtaaccaaatagcaaaaacaagataacattataaaaaaatgacaaatgtataatatcacaagtacatcctctgtagcgcacttaagacatcacgtgttacgtcttaaataaaaataaaatcttagaaattgtaagaaaaagattaaaccatcagtttttacttaaataggtggatccattatttttaactaatagatatactttaaaaaaaatctgaaaccgcgccatgtgttacgtcttaaaaattagaaaaaaaaatagaaattctgagagaagtattggattattgtttttcacttaaatcatttagaaaagaaataaaccaccactacacttcaccctcccccgcacatgcacacaacacaatactaccggtccccttttctctcagcttgagctctccccttgaatgttctttatagcgagaaataataaaaaaattaaaatatacatactgctttctaatctagctatttttgtattcataattgaaccaacaatttgaagatccataatacctatatttcgaaatgatataaaataaaacaagaaaaataaaatgtcaataaattgaactatttggttccaaccagaaggactaacttgatggtgcaattaggacatatttattaacaataatagttatttaggattagttgaaaaagccactaaactttcaattaaacaagacaaaacaccttacttttaatttacacttaatttgttagacacgtttttccaacaaaccaaatctaactccataatgaagagatagataattgtttatatggatgtattaaatattatatattttagaagctaacagatagattgaaaaaattatctaagcaatgtcgatgaaaaaaattatggagaaacaatacttttgaaatatggcaggtgtcattcaattgatattccacgtatataagtttttcaaacacaatttataatacatgcccgcgcgaatgcgcaggctacctccctagttgttttaaagggagtaatttactatttaactattcagacacactcaaactctaatttaactctcgcactcaaattaacaacttaatacatatagctatatcacaaccctgatattgtccacatgctaactcacacacacgaacaggcaaactaacacaaccatactaggcacacgttctaccgaggagaaggacttcaatatgagtcatacttagagagacatctcttcatcctctgtttcacccaattccacaactgaatggctcatctgaagctaagcgtcctcttgcctatttggaatcttcttcttcatcaccaacaattaatgttgtgcataaatggggaaatgatcctaagtggaacattattgttattcaacacgcaggtcttgatgcaatgatgccagctgtaagcatggaggaagatgaacccttcctatccgtggtgcggatcctagctagctcctctaggggatgcttctacctacagttgtgccagctcctccttcaagtgatctatctggttttgtcctctgcagatcttgatacacttgtcattaattctcctattcatgagccgctatcagcctatcattacatcagtccattgtccattgcactcaacatcctcacaaagtattgcatactccgtccgtcccaaaatatagcaaccgagaactagattggacatcacctagtacgatgtactggacatgtagattgctatattctgggacggaggaagtagtagagcatgtccagatacggtactaggtgatgtcccatctagttctatattgctatattctgggacggaggaagtagtagaattgttctccgtctctggttccagtaattgttgtactcatcattgtgggccatagatggatcgtaacaataataggtgtccctcaagagctcactatacctatgacaaagttctcggatggccaccaatgccacctcttgatacatatgggcaaaagttccttcctccagtttcgaagatcatgaacaagatgccttaacgatcacttaattgtcgccgtcagacgaacataacagttattgacgatgaatatgacccctctcatttatgtcaggggcaggggtgatgcgtttctacttggggttagcttgaatcctatgtgcagctccgtaactataccaccaacttcgaacaaatggatagtctcattgattgagttaggttaactgaaaatacagaaataactgaaaactagtgaaaataaaaactaaaaccagaaagcgaaagtaaatcaaacaaaattcagaaatatcttttaaagttttcttattttttgaaataaattatttttcagattttaaataatcaatttccggaataaaataaatccttttccagaataaaacattttcagattaaagaaattaaatcttgtccttttcaaactggttgattttttgaaacgatgggtcttactgtacgtacaaaaccaaaaaaaaagttcttttttcaagaacgtgataatactaaaagcaaattaaggatcgtacggtaccaatttctaattaattttttaagaaagcataaacaggacagtaagaagtacattactatttagaaggaaagagtatgcgcggcaccagatttataaaagaaaaatgcaaaattttatttctttagaatattttctcagaaaaagaagaaatcaaagaaatgatgtatatatactattaaagaggaatggagaaaagcggtcctaatttttcaaatctttttggaaaggcttctatatattttcatttggcttaggctaaagccaaggagcctctcatatcaacttttcactcccgaaatttttatgtataatttcaaacacttatatgtatatttaactctcgttcaggaattagtcgagataagtaataaacaatattaacaacaggtataagtgtttaattatgatagatgtggataacctctcaatcgtaagagttctaagcagtggaaggaaaaaactagcataagcgacgactccactatatggacagcttaaccaggaacagcatatggtagcttattataagaggagcatattgtatactcaacaagccacataacaaatataacaaatatccaaatatgcaagtgtatatcatataacaaacgagagtatactagggctaatttgaacaaatagcatttgataatcaattgataatacaaaaatagttgaataattaaggaaaattaaaccagcactacataatctaacctggttgcacgggcccaccgtaaaaccttaccctgttgcacaaacccaaaacgctccataggcggagatatcaattaccagtggcggcgaatctaggatagaaattgaggataggctcaacctcaaagtactaagttcatgaaaactaccgttacactagtttttcaacacatacatgattaaaaaaatgatgaaatagaagtaccttgccaacgggaaatgagtgattgcatatttgcatcaaagcatcaaccatctaaagtgagcagccacctatgcatataataatagcaaaattagtgacaataggaaagtaaaaaaattaactaaaagatttggccaaccactagtctacaaatacctgcaattgaattacgaggcaatgatattctgcgggttttcaatgcttgaaatctattcatgattgcatcatcatcaatttttttgaatatttgaggcctttttggttgatttttactctcatcagttgaaagtttaacaatgttgttttcttctccatcgctaatctatcaataaatcaaactatcaaatagtgaggctcaattctttaaaatcccatcatctagctgctgatgctgcttaaatcaaaagaaataaaagatggaatgacagtgattgactcaccgcgctggcgcgctcggcacttggatttggatcggctggatcgctagcgcttgctgctctgctagttgctgccttgctgctgctttcctatggcctacccagtgcgggagtgcccacgccgcatcggtgccgccgcttgcggccggccttcggccgttcggcggctgcgcccttgctgctcgcttttgccgccgcccgtcgcaactcgcaactcagccgccgccgccgcccggtctcgtcgtcacctggtagggttggggaattggcttgccgaattgggggcgtcaccgcatcaggcgttgcttctgccttcgtctatgggctgggccatagttgagcatttgggcctaatctttttccagcgctgcgctgcgtgccgcttcgtct

SEQ ID NO: 74704 - DNA, 7068 bp, Oryza sativa
aaaatcagagggtaggctagagcctgatggagcctaccccttaaaatcgccactgtcaattaccgattttctgctgttctgtcggtgattttgtttccaacatgagatgcactacgatagtgcagtgatactgagtacgtggttttggtctcatgtttaatcctcaaatcgctcatgattttttttcaaagaaatatttagagaaatgtatttcccttgatcaaatcttctttttttttcaaacgtgcacggcgcgtgagacgagagaatattaggtactaccaaatagtgctatgctaccggtgctgtcaacccttaaaatacatttaaaagtcacaaaaaatatgaaaaatttctgagacgtgcaacaccataacttatagtatcacacaagaaatcaactcaaaattcgctgtaatcgtgaagaaacaaaaaagataaactcgttccgtaaatagtgctcaaacagttcacatcactattcacaacagatttgtcttttttcttcttcacgattacaacgaattttgagtttattttttatgtgatactacaagtcatggtgttgcacatctcagaattttttttcatattttttgtgacttttaaatgtatttttaaaagttggtaacaccggtagcatggtactgtttggtagcacctgatattctctccgcgtgagacagagagaaggggaagaaaaggaggactccgtgcttttaaggtaggaataatcacaaaataaatattatttagcatgcccatttaaacaaggaaaatcaaattaaatacagaaacacatttttaagctttttattttcgaaataaattagttttcagattttaaataatcagtttttggaataaagtaaatccttttccagaataaaacattttcagaataaagaaattaaatatttctttttcaaacttgatgatttttgaaaacaaaggacagtacagtaccaatctttttcatgaacggtataatactaaaggagaggatcgtacagtaccagtttttaatcagttttttagaaagcataaacagcacagtaatagaagtacagtactcctccttttattcgttttagcgttgaaattctgtgccaaaaatatttgccttcttaagttacaaagcaattttaatcactacctaaaaaaccatttttgcatatgctcaagacctatatattttttcaaatggttcaaccgtccgtctattcggaggggcttgtaaaaattgctatttccatgcagttggtgcaccccaagattgaattttcacatgtgggtggttatctcgtcttcatgcgaaaatgaaaatcaaggaaaaaataaatatcccaaaaattccatccactgccgctcgtcatcgccgtcgccgaagcgctgctcctcgtcgtcattgttacagtccgccgccgctcgtcgtcaccgaggcccggcagctcctcgttgccgtcgccgcgcgggaggaggagctggggatccgccgccaccgagctccctaccatcggatccattgccactgcgtttcccaaccgccctttccattgccgtggagctccccacctctcctgctttgcttggccagccgctccctcctagcggtggaggaggacaagctgaggagcctcccgttgctgcccctccccacacctccaccacctcagtcccaccttggatctgtcccgactagatccatggtcgacggatcgatatctgccgcctcccggtcacccccactccttcaccggctgctccgctcttgcgccctgcactcactgccgtcgctcccaccgttgtctgagccggccgtcgccaccaccaacccaagtccgccgtcagggtccaggaggaagtgggagaggagggttggagtggaagagaaaaataagtaggcagagaggacttgaaatgagtggggagagaggccgtggaaaaacgagaggagctcatctggtcaaaataccttatattttgggacagatagagtatgtgtgtgcggaggatatacgatgaagggtattgtagactaatttaaataaagcattttcttaatatttgagaattgtaaaataattgaatatataagcaatagtaaaccaatacttaacaacctaacgcggttgcacaagcccaccgtacaaccagagaaaatatgtattgcaaatgtagtatatagacatgtgagatttgtccatattactacaagtaaaagttttactctaatatttaatcatgagtaaaaattttatggaactaaagttttaatctggtgatgtggacaaatcttaaacaaagtgtccatttttagatcattcgttagtttctgggtttgcgatatatttttcagcacaaccttacctgattgcacaaacccaaaccactccacacccggagtctactccatacccagagatatcacaaaaaataatgtttagctctctcataacactcaccttattaattcgaatagttttactctaaaatcagatatgtgcaaatttacacacaagatacaacttcacgacctgttaccatatgccttacaatatacctccgaaatgaattgtcacaaacctgttagcattacacaacctaacatgagcacacctacgtcagcttatcttgccacttcttagtctagggcctcacatttgatcatgttatatataccacaaagtcaatttccttttctacgtacgctaactcgtgattagtttggtaaatgttttacaacagtagctcgtgaatcggtctttaatttttatgagctagatcatcgaaaccgtcaaaaccgtgtgctcataacccaataattaagcatagatgaagcattaattatctttatgtgaatctagtgtttttaagcatgactaattaagtaaagttaaaataatctagccaaaacattataaagttctaagctagtccaattataataccggttagaaagaataggtgatcaacaatcaaaggggtacgtcacacgcgtgaacttagatatcgtgagtattggtagaagatatcgttagttccaaactaaatcttgtaaactttatgtacacactgttgtctggaacttcaggattgttaacaatggaaaagaattgcacttttgtcaccattattattaggagaggacacacgagaaagagacagggatcgctcccattaccatctactactaggcatcaaacacaactaatacacacagaaatattgaacgattgttaattagagctagccatggacaacgctcgagagagtgaggatgagcattgcctgtacgcgcaggagctcgtgttcgcctacaaccgctccatggtgctgcgagcggcgatccagctgggcctcctcgacgcgctcgccgccggcggcgacgcgctgaccaccgacgagctcgccgggaaaatccaggccacggacggcgtcgcggtggatcggattctccggttcctcgcgtccttcgacgtggtgaggtgctcaacagagacgagccccgacggtggcgcggctctgatccggcgctacacgccggcgccggtgtgccggtggctcaccaagaacaacggcgaggggtcgctggctccattctccatgtttattatcgacgaagaccacctattgccctggtatatacacattattcctataatcctatttacgattgtcaattgaaccaaatggtacatcatatgcgcgaagtgaatttataatttaactggttaggttccctatggtgtaacatctcatcggagtttaagattttgacatgagtgattgtatttacgctaattattttctagtggtaggcagtaacctaccttcatattttctagtagtagacggcaacctaccatcatagaaagagatttgctccggtctaacaaaaagtaccatgaggtactggtacctcgagatactttttgctggatcgaaccaaatctcttataatacatcataagcatatgcatatccatgtaggcaacacatagcggaggcggtggcgagcggcgggccggcgccgtccgagaggacccacgggatgccctaccacgagtacatagggaagaacaagaggctgggcgggctgttcgaccacgccatggcgcagcactcggcgatccgggcccgcaagatgctcgaacgcttcgaaggtttcgatggcatccagcggctcgtcgatgccggtggaggcgacggatccaccctggggatgatcacctagcggtataagcatattaggggcatcaactatgacctgcctcacgtcatctctcaggccccatctcttccaggtatgtgtgatcgagattttgtgttgactacaagcattgatcagtttgcacgacgaactgatctctactattataaaaattgaatatgtttttaccggtattttggtacgtcatctgtgtatgagctgatttttaagtttgtttgcttttggaaatatatatccgtaattgagtcggtttttaatatcgcttacttttgataatacataaggaatcatgtaagaaatctgttttcaaatctaaagaacttttaactagaaaaaaaaaatcaaacgatttacaatatgaaacggaaggagtaactaaataagtgtgcgcaatatgccctggatgttgatcttatattacaggcgtggaacatatagctggagatatgtatgagagtgtgcccaatggagatgcaattcttttgcaggtatgatagtgtacccactctatatataccgcttcttttgatgacctaagtttatgactagcagaatcatttgggttgttatatatagcagggtttgaaatttcggttcaaaatttacaaaatttcgacccccaccggcatgctcaaatctcacttgaaattttcggttttttgcaattttttgtgaatttggtcaaattttattcaaattcattcaaattcagtcaaattttcaaataattttggctcaaaatttcggtaacccctgtcataaaatccaatttcaaaatttcaaacctgatatatagtcatatggaaagaaaatgtttaaccaaatacaatttgtgacgcatgaaattttgagagtacaaatacaataaaacaattgattctagcgttgtacgatgtctcctatatatggctgtgaaattgggacatttggctagtagaaagaaagaacgttccataaagatggaaataatgcagaattaattcatacatgcatatacatatgcagtggatgctccttatgttcagtgacgaggactgcatcaagatactgaagaactgccaccaagctctccctgaaggcgggaaagtgatcattgtggaaggtcttctgccagagaccccaaatactactccagctgcgcaggattcattcaccatggatatgatcttgtttgtcctcttcaaggtagggaagcacaggacagagcaagagtttgcaaagcttgccaaggagtctggctttaccggtaccttccggtcgacctacatattcttgaacttctacgcccttgagttcaataagtagctacacctataaaacagtatggtcttgaataagagttgctagctcgcgtgtgtacttatgtctctctatgatatgtttatattccaatgtatgtccctattgtgtcactatagctaatctaaatgttaatcttcgatataccatctatatctaggtttccggtggactttcgtccgtcaccccctgtccgcttcgtgatcgtgacatcggtttagatcaggattcaccgctggcctcaatgttggtatggactctgaatcaaacacaataaaatcagctagaaggagtccaaggattaaaagttcgagcaaatcacaaagcaatacacaatatccgaccttgattttcgtcttgcccatgacggtggtgcctctgtatggtggcggcagaatcgatagagaagatgatcacatcggtgaaaagaacgtgatggcgttcactgctccgccgccaacgtgtgccgccgttgtcgaggttgttgccacatgtgcctgcctgccaccccacctcaatgcccgtcttctcgtcaccggccgggagaggaagagagtaggggcgccggcaagggaggaggagagaagggcccctgcgcctggacgacatggaggaagcagaggatccaacgacaaagttaaagacgacattggagggaggcgatgccagtggagatggagagagctagagggaaagaggtgtggtccaccttctacctccaagccgggcccgggccccgattcacgcatgcggtaaggattcgttttttcagtcgctaggctgatgatccctagcgcgccaccatgtcgatctgcctccccatgcgtttcctactccaatctataccttcttaaaaattacgtaaggcttccgatagtccgctttgtccgtcatcatcgtttgagtctgagttcgtctttaacaaaaatccccgagcagatcaaccgattgctcccaatccatttgcccccaatttccaaaatacatgaatcacaaaatcactcaattgcaatcccaaaccaaaatcaagaatcctccacaaaatcaacatcccaaatcaaaaataaaatccaaaacctaaccctagccgcctcctgcagtcaccctcctcgtggtcactgtcgccgtcgtcgtcgtcgtctgccgccgtcgttgtcgtcgccatcgtcgtcgtccgctgccgtcgtcgtcatcgccgttggcgtcgtctgccaccgccgtcgtcgttgccgttgccgtcgttgtcatcgccgccttccgccacgaccggctcccgagccagccttccgccgctctcggcagcgtctccgcgccggggatggggccgacgccgccaccgccatcagatccgctgcgggagggaggcgagaggggtcagagggagttgccgccgccggatgcgtccttagccgccaccaccgccgccggatccacccgcggtcgccgtcgccggacccatcgcgcgagggaggcgagagagagggtgagggaaaggacggtcgggaggaagagggggatatggagcggccccgctg

SEQ ID NO: 74705 - DNA, 18049 bp, Oryza sativa
tccatggtagtgtcacgtttttgcggtgtccctcagccaattacacgttttttgcgtgtcctgtagcaaaatttgccttttagaatatagcggcctggtttagttaccaattttttcttcaaacttttaactttttcatcacatcaaaacttttctacacacacaaactttcaactttttcgtcacatcatttcaatttcaatcaaacgtctaattttagcgtgaactaaacaaatccttagtattgtgttagacatattccagtcaggaatgatattatatgttactttgccatgaacataatcttatttctatcagcagaaatggatcaaccacatttcttgtttctaattacagtgacatggttaaaacatataatcattttgctcataacaagccgtttattagtaattaaaattaactttacaaatataatgtttatatatgtgttttcagtaatttagaagtaaatacttgaataaactacagcgaaaagaacttccaaatcaacttaaaataaagttgtaaaatttaaaattatacttatatttacaaaccgaaggctagatgatggggttgaatacttctacctaagttagaacaagtttataattgcagtagtgcaatagcatgggttaaatatataatgctggattttagtgaggtttgcgagtatgtaagtgtggtgtccgcgtacatatgtcttccatattggaaaaaaaataaagaaaagtcaaaacaggtgttagtacaatgtcattcatctgtcctaaaaaagtccatgttcaatatcttggatgggcttacattctttcctatccaatccaaggaacactgtaggaagtgcacaaaagttgacttcgattttcgagtttgacatttctacgacctgcaaaatgcaggtagcgagacaatatatttattgtataaaagagtagaccgggttttcatgatacacatggatatataatgcgaaggataaacaaagtttgattaattagcttactgctgtacagtcctaaaatatcagtataaattgtgaacctgttttggtctccttaacaattttgtactactaattaatgcacatttctctctgaccaattattcatatgaagccaaacactcaatgcgacggtgccggaccaagtccttgcagggggtaaggtttcacaggtgaccctagcaaaatcaagtactgaaagcgattgtgggtttggtagctcgtcgtggcctcgtgctacgcgtttggtaattggcagggcacggatggctgagataagctaacgccaccaaacttgtctacacatataactacctagttttgagtctaaatacctaatacacataaatcataacatgtatatattttgcctggaaaggtaaactactcctgccatgatattaccaacttctgcagatatattacaacagtagttggagttgtattttaaagaatacggtatgctttttatccaatacaacatgtttccctaaaccggtgtgatagctgtttggcgaagtcgagtttcacaaatttatagtctcttttggaaaaagaaaaggaaattaattcgtaggacctataaaagcttgaacttgttttataaaaattatgtaaaatttctgctgtatagattaaactaaacctagggaacaaattaaaggaaaagtgaagacaactctacgtaaaatgcaccttgctagctaagagacggtcaatgttgacgcttaattagcttaagctacttcttgatcaaatgcttgcacgcatgagcaaccgtttaatttgcacttaatctgctgggatgcgctaactaattggtacaccagtttggtagctagagcacgcactatacgtaattaggctaaaatatatatagtcaagtctctcttgttataacgcttttattgctgagattgatgcaccgactgaacttgaacgaacagtcgcaggaaccacactaccggctaatgctccgatgatcgagcatcattagtcaaccacgtacacggcctacttaaatgtagacaatgaaatggcagggaaaaataattttggtgtccttgcaaattgctacagcgaaatataaagcgttctcaatgcatcgagacatatatacatattcatgcatgcggcacataatttaatttgggggccgttgaaacagagcattcttacacaagaattttgctggaatgttatgacaagcattttgttttttaatccctccatactcgtaaaaaaagtcgttttggacagcgacacgatctccaaaacacaattttgacttcttgtttctataaaaatatttattgaaaaataatatatgtatacttttatgaaagtatttttcaagacaaatctattcatataatttttacattttcaaactcaacaaattgagagttattcataatttatatttccaaggtttgacttaaacattgtcctaaacgactttctttacgagtacagagggattagtacatattaagctcagtgaacatttttttttcgtgtgcaagattaatgcttgggctctttattttcagcttccctatcggattactgccgttgattatactcctcgcttctaaaaacgtgagttctcaaaagaaaaaaaaaacttttattgtgttgtactatttagaccgcttattctaagctggtagtatttgttcaactattttgaaatatttaatatctctaacttaagtagataattaacttgtggttgcaataatctggttcaaaccgcagagttatttactacccaaatcgatgtgtaatctcctgggagttttacctggttccttgtccgaggagactgcaaggtataagaacgtgccctaaaataaaaggcctttcagagggatctccggccggttgcatcagatacttggccccatgggacgggacaggggagatccctgggattaggtgccaagccgcggccgaatgacttgcaagtacagcgtctgttcaagcaaagcatttcctcgttctttagatgggctattttgggtgtgtttagttttttgggtgtaaagtttttagagtgtacggatatatatttgaagtattaaatatatactaattacagattctacctgtaaactgcgagacgaatttattaagactaattaatccatcattagtaaatatttactgtagcatcacattgttaaatcattgcgtaattaggctcaaaagactcgtctcgcaatttacatgtaaactgtgcaattgttttttttcacatttaatactccatacatgtatcaaatatttgatgtgacgtttttggtcaaaattttttgatctaaacaacgcctttatgttgtgtcccgtggttactatgcaactttgtcgagaacttttatggttctttaaagtatctcctaaaaatagtaaaacaactagtactattactatctccgttattacaaaataaattaatctaacacgagatatggcatattctattactacctccgtcccaaaaaaattgtatttctaactccaaggctttgtcccacaaaaattatatttgtagccatgtggggcccagcaaattgattgatctagataagattcctaatgcaagcagcaaatttttggtgccaaatccatttggcgctaaagcatgtaatttggactgctaatgcttgtaattaagtatgctgattatatgggttaattctctcgaatttccttttaatcattttgtatatatggaatgtgtgcatgcagtgggttcattaaataaggccattgtggtcattttccaatcatactgttttgtcctaaattaggtagaaatgtaatttttatgggacggagggagtactatgaatttggacaggtgatatatgtcttaccgttcatagtactagtatatgctacatttcgtactatattaacttattttagggcagagaaaatataacttatcatatctagcgagcgacaactcatgatgatactcactccctctgttacaaaataaaccaacctcctatgagatatgacgcatcatatacgatgaatatggacatgcttatgttcagattggttctttcaagatatgtcacatcttataccactgtaatagagtgtctaaattttgtattatgatgattccggacacgcttacgataatagatcaggctgcaacaaagcagatgcagcaccaataataggaagttaccacggcaacggaacaaacatttgcccggtgtccggtgatgacaacgacgacgatgattgatcgatggtttctgaatccgtgtgcacgcacgcgtccacgtacgcaccccgcatcatatagcccacaccgtacaggtccacagcacacaagtgacacaagaagtccacgtcgctgtagccgccgtggctacctcgccaaagcccgttgcgacggaacagacagctacggctaactaacgtacccccccccccccccccctcttttcgtctcgatcgaccggcaccgcaggaggaccaaccgaaaaactgctgcaccctccgttttatattatattaaatgtatttttattggtcaatttgatcaagattataaaaaaacttagcaacatatttattaaatctaatattaaatatatatttcgatattatgtttattttgtactaaaaatattattatatttttctatatatttatttaaatttaaagaagtttgaaaaaaaattataatataaagcgaatggagtacaccgatagattcaatatggagtatacagtttgcggactttataatcacgttttagagtcatgacgacgcacatgggcgatggatcggttggccacggccagatactgatcagattccaacggataacgcacacgcacacgcacacgcacatatcagagccgagctgccgtgtggccgatgccttctcctcctccttttcttgggtcatcgatcacctgcccattcgacgtgtacatgtatgaaagggaggattgaatgattaatggtcacttaattaattaacagtggtgcgactatgtaagctgatagcataacatacactgtatcaaagctgtcacgctgatatatcacatattccatccgtccaaaataaattaatttaaaatatagtagaatattatctttctatgcaacaaaacctgaacagtattttagggcctattcattttgatgaaaaaaaacttattaaattttagcatcaattttggtaactatactaaaattttagcaggatttcttatatagttaccaaaatttgacagcaaactaaatgtagccaatttttagcaactttaccaaaatttggtaatgttgaaaatgtcatcaaagtgaaacccttatattggtttattttgagataaaggaatagtatgcctgatggctggctggtaacgggcaatggatggacccaagcaaaatgagaggctgtttctttcgtgaagaggaaacgaaagaaccttattcttttttactctttccttgtcatgggttcgtgcgttcttcctgggccggggcccttgcgtgcggggcgagacctcttcgcttccacgcttccgtcccctgggaaggcaagggcgcgcggacagccgcgtttgacgccgcacacggcacatctgcaatggggattgggaaggcagcctcacgtttgcgacgacgacgacgcatactgcaacacaagttgtgggaaactagtaaactgctagcgtatgatttggccggggaactcgttgaccaatgaccatatctactccctccctccgtccttaaaaaaagataaaccctagtttccacgtccaatatttgaccgtccgttttatttgaaaaaattataaaaaaattaaaaagacaagtcacacattaaatattaatcatgttttatcatctaacaacaataaaaatacaaattataaaaaaatttcatataaaacggaccatcaaagttgaacacgaaaacccagggtttgcctttttttgggacggagggagtatctgtttatctgataataaagcaacgtgtgcagtacaaaagaagcatatgggcaagttccagtagattcgcttactgcacaagtatctgtcgttctcaggttgaaactgaaactctgatgtaagagtcatacaaacaacagtaaccgatgttatttctgcaccgagatatctcctcctcttcttctttagttctgattaatttcttcttgtactaaaacagctgctaggcaaagtcagtgtcaaattgtcaattgtcaagaacctgcacatattgtcaagcagattttaaccagagattccatgtggtccatattgtcatggatcgataagcgcaatatccaaatctctccgcaccactctttttagtttatcagtgggcagcaaacggcaacaacagcagatagtgctgaatcgatcgatgatagatagcctgatagacaggctaatgattctggggctgggagtggagcagagcagagttgggagacacaatccgagcaaaaacgagtgacgatccgtcctacatctacattcggatgcacgcgcgcgatactattatgcgaacagaccagaagattaaaagtggtctttgtcatcacgaagggcacacacatctggtccatggattgtgggagagaacgttctagctaggcccagcacgcatcattgattagtgcagattaatcatattgtctcgcattgttcaatgcactgtgtgtttttcctgtatctagcataaaaacacgatgacttttgccatcgttgatagtataaaatatctttgggcaatttgacatcaagagcactgtggacgagtctgatgtacgctgtagcctgtacgcatggcattttggtcctcaacttttggcctcggaacgtcagggcagtacctttgggttagcttaatccaaccctagctagctagctactctatccgtccttaaaaaggaaagataatttagatagagattttacatcctccagacaacgaatctatatgtaagattgttcagattcgttagtataggtgatgtcaaattctcacttatatccaaatttattattttagatggtgtcaaattgctatataaatttgtattatttttttttgggaatgaaaggaaggagtagtacagattgacagattctaggccgttttttctcagcattttctgacgatggaccatcgatcggtctcaccgttcgcctgtgcggtgtgtttgtccgagtgcgtgtcgcggtcgcggggatcggcgccggatgctgcgcgcccgacccatcaatggggtcggacccccacctcgcgtcttcagtgcagtggcgagagaagggaaggcgagggaccatgatggcggccgctgccggagtctggccgggtgcgaggtgtggtcaccggggcgaatgccgtaatgggctaagcctggacagtacgtgtccttgtcgatcaatgtgtcgccgtcgcacggggggctaagcgagcgtgttggtgccgcgtgtcgaggtagattttgcatgtgttggggattcatcgatccaacggccctcgcgcgcgcagttcatgcatagggccggcttttcttttttccttcttcagatgatggctgaaccagttgttcatgcataggtttgatttgtgtgatgcgagtatgcaacgtgaaggattatattgcgcacatctacactcactaaagactaaatcacctggtttcacaaacaaagtcatataacttaacttaagctcaccaaatagatgatgatggcagaacacacgcaattagagaaatgagaaaagaacatgtaagattaatgtaaagtactcggagataagactaaagacttggcagatgggcctaattttcaaattaatacaactcatatcagtaatacagggaagaaataaattcactttgaggacagcgtgagtcgcacatgtcagcagccaactttcttccttctttctctccctttcctctctcttcctcatctctttcctcaccctcctccttcgttatctctaaaacacacatcgacagtcgacctcctattcgagcttttctctgacccctgtggggtcgccatcttctccgatatgcttcgtcgcccccgcatttctatgtcttttttggttcttgatatgtgcgatttcgttgattcttgcccactactgttggttgctgcagcggtggcaacgagcggcagtcaaacaccatgcattcccgacctccttcgcatcccttcgatccctcgtcgaacactgacatagggaggaagagagagggccattaaatagatccagttgctcagaggacaccgccgctaaggctgcaaccatcgtcgaccccatcaagcttgctagcgatctccctcaccgtgctcaccgttgacctcttgtacatgcctcctcaaggaatcccaccgctcgccttttgccacaacccaccttctttgtgtcaaccaccgtccatctctacaccacccgccttccaacaacctagcctggtaagagatagggaagagggggagagaggaggaaggagtggcagctgacatatgtaaggtccatgctgactcagctaggttgattgtaatcaactggtcacattggccaaaaccgggcactatactgctctaaggtctctgatacaccagttttataagctgagggacatgttatatctggtattgcggtttgagaatgtaattcgaacttgacgtcaagatgaaggatcttaagtgaacttattcctacagggaatcacccagcccaaaaaattgggccatctggcccacggaggtaacctgcttcccaatttcccaaatctccgcgtcgcctccacgcgaggggctcgcgcgcgcgccttccccatttccccttcccgccacgccgagttaccgccattgggactccgactccgacttggagtcgacatgggagctccttgccctacatagcggcgtgggcctctcgatccccgcatccattccacctccgcctccgcctccgcctccgcctccgcctccgcttcttcttctcctcctccgacgtagcctgcggcctcgtgctgatggcgacggtgtcctcctcctcctcctacgcgtcctgctccgcctccgccgacgacgctttctactcgacgtgcttctgcggcccgatggtggtggcgcctccgcctccgcctccgccgcgcaccgccgcgtcgccggagtacaccccgtctaccccgtggcgccgggccgcgtcgccggattacaccccgtcgactccgtggcgcagggccgcgtcgccggaccacgccccgtccccgccgtggagcccttcgcgccgcgccgcttcgcctgactactcgccgtcgactcctccgcgtcgcgccgcttcgccggactactcgccatcgacgcctccgcgccgcgccgcgtcgccggattacaccccgtcgactccgtggcgccgggccgcgtcgccggactacgccccgtccacgccgtggagccctccgcgtcgcgcctcgtcgcggactactcgccatcgacgcctccgcgctgcgccgcgtcgccggactacaccccatcgacgcctcctcgccgggccgcgtcgccagactactcgccgtcttcgccccctcgccgagctgcctcaccggagtacaccccgttgagccctccgcgccgggccgcatcgccggactacaaccccagcacgccgcccccgtcgcctgtgccgtccgatgcggggtctcgcacttctccgccgtggcgccgccaccatccgtacctgaggagcggctccagcgccgcctgctcgtcgcgcgcggcgcgggtcgccggcggccggcatcaccatgtcttcctgtacggatactaggcgtcctgtaatagggcagattcatagtttgggttcttgatgtgagtgtgactaatgtatggcacaaaattatcttgtgcttcatctagtctttgataaatcgatctttgtattatatcattgatgtaaattgatccaattcaataaatatctgataatttgttgattttcctatcaattaatctgtgtctgtgattgatgattctttgtttgatcctctgatatataaactgaaatttctgttcgtctttgatgttgatctcaaattgtacaacatgtctgtgactagtgtaattgatatgtcccttgaaagaacttcttctttaagttgtgctgcctgtagtattgaatcatcgatcagttccagagtagaatatcaggctagtttcagataatagaatttcagactagtttaagataatagaatgtcctgactactgtaattgatatattatttgaaagaacttctgtagttgctgtgcctgtattcttgtagtgcagtttcagagtagaatctcaggctagtttcagataatagaatttcagactagtttcagagatcagaatttcagactagtttctgtctttcagaggatatattcagactagttttagagaagataacataatttcagactttgctacagacccactgttctttgtgacataaaaaacaacagcctgacaatctgaatatctgacagagtacattgtttccataaagggcgaatttagagctaacctccatatattggcagtaaaactgaactgaaatccttctcaaacagaattacggcaagtctgcaacttaatcccttccatccaaatgaacccttggagagttcagcaatgaatcgttgaacttcacagttaagaacaagtagcacctaacagcatggaaatcccttcttacgcctaataccctcgccaatcgactccttcatcgacagcatgatttccaagttccaaccttcaaacgaaaagcagtttgataatctgtctgttgctcaagctgtatattgagcattcccatccgttcgacaacacgaaagctctgacattgctcagattgcttcctccatgcgaacaagacaatggtcatagtcatagattcagcttcgttttcttcagaaatagaaattcaggttcagcttcatatttcaggggcccttgactacatgaggcccaacacaaatggtagcctggtaggaatggtcaagatgacaacagggaatcccagatgtccaccccaaaaccaaaacattcactctctccgttcaggttcgtaccagaatgcagtaatttaggatgggtatatccaggttcctaccagaatgtaactatcaaaggatttattaagaaatttcataggattgaaatcctataggaaaatatcctatttgggcctttgattcaaatgattggagttttcgaaatcctatataatttctatggaatgactcattgcatgtaggttttggagaaaatttaacaagaggtccaacctcttggaaaaattcttttgagtctttttctttcatccgattcttgcgtttttcctgtggcccaattaaacgatcattcatgtgttttacaatcctctattttacacttcacatttctgctcgaatattgtgtttttctattcatctattttttttcattcctacgatttaaaagggccctgaatagaggacaataccctaacttccatccatgtattgattgagtttggtcttaaattttataaatcgtcatgaaagtttgtaatttttctttaaatgtaagaggtcacgaaactggagtacgggggtcattgtcttttgccttgggccaaatttgctacaggacactcaaagtgagacacccaaaaaatatgtatttgcttgtggacactgcaaaaatatggtaattagttgctgaacacccacctcattattttattattttcggtggtaatggagaaagaaacattggttaaagacaagtttgcccatggcccacttgtcaatctctctttctctatttctatgttcatcttcttcggttcttcctcctgcgtgcgtgctgctggcctgctaccttcgcaggccaccgcgtcccggtggatgtgctgccccccgacgggaagctcctcgcctcgtttcgcacgtcgcttgggtcgttcctcgccgcccaccgctcgccgctgccgcgggaggaatgtggccggcgtgatgagggacctcacgggcctcctcgggcaccattacctgacctgcaccgtggtcgggaacagtggcgtgctcctcggctccggccgtggcccgttgacgcgcacaacctcgtcattcacctcgacaacgcacgcgtggcggagcagcacccgcgggagaagaaaagagaggagaagaaagacacgcggcatgtggccgctcaagctagtgagctttgttccctcccgaccgctcgactcgatggctgcttcctgcgaccccatatcggctccactcgtcgcgccgcatgacgagagtggagcctcccttcacaaagccggcgacgaagcaaagatggtgacgcggtgcgcggcttcctcgatgatgccgatgacgtgctgttcgggcagctcgccgcagagcacgcaacgaggaggcggcgtgcttggacgcgacgacgtgggcgggccacggtgaggtgatgaggtcgacaaggcgggcggcgtgggagcgcgacgcgaagaagtcgagcccgccaccgccgccgcgcaccgcgccgacgcggagggcgtcgccggcggcgccgccccgtcgtggccgagccgtcccggctcgggccggccgccgtcgctctctgctccacgaagaagaagaagaagaagaagaaggggaaaagaaaagaagtgagaggaagaacactgtataggggtatttttgtaattacacaactctttctctctcaattttgattggaaataataaaataatgggaggagggtccagcagctaattaccactttttttacattgtccacgagcaaatacacgatcttcggatgtctcacagcaaagaccgtaatatttcgatgtactgtagcaaattttgccaatgccttgggcctctgcaactggatccagtcactgggacgctaccacttggtcctaccgccgtggcgctgccggtcgggatctgcatcgcttgcatccgtcgggacatcctcatcaagctccagcccccaccaagcttgatcccgagaggcaacaccgttgtttcatttactagccgtctctcggaccaaccgcgccgcctcgagcttgaactcctcgttgctcagagctcgcgcattcaccagtagcggctgccgcatgggggaggacggagaatgacaaaaacaaaggtaggtgagaggcagaggagagataggaaaaggagaagaagatgctcacaagtcacaagtgcagcccactgatttttattatttttgactgactggattgctcgtatgatccaaaccgctttggattgactagggattttctttgtccggtttaaaaaattcggggtataaattgtttgatttttttagttaaggataaaataattttagaggtaattcagatctcttcttaataaaataatatttttaaagatatatctcagagaccgtgtcatcgtcaaaaacattagaattatagaatcggagggagtatgtagtatcaaattctatacgaggtttttgaaaatgcatctaggcccctaatgattttgatgattgattacaatgcgattagagaggactaacatttttattcaagcaaatgtgaaggttgttaaatcctcaacgtgttgtaatacaatgcatatcctgtgaatgcgacatcacgatgcaatgcggcaatgatcaaatgttatattgtatctttttcctcgcattgtgtcgcaggaaagtcgtactattaagggggatgatgcatagacatataaggagtgatgtgtgtgctcaaaatcaatttctcttttggagcgttctggaaattttcggaagttccgaaaagaatttggaagttccgaaaatacacaggaccgtttgagagctctctggaaattttcggaagtttcgaaaatgattttcggaagttccgaaaatacacagaagcgttttagaaattttcggaagttccgaaaagtgcgttgactttgattatttctcagatctagaattttcggaagttccgaaaattgtttcggaagttccgaaaattacttttattacactccaacgggcagatttgtgctgtgggtataaatacccacctcccctcactttgtgagggctgctggtttcattctaattatttgtgcccttggcttgctctctctctagttcatttgagccttacttcctcgattcatctctccacccgtgtttgattccgatttagtgtgtgtgtgagagtgtggattcgagtttatgtgggtgcttcttgtggtctttgtgaagatttgtgagcacttgcataatctccgggagttctttgcatcatcttttactcttgaaggttgaggactcctagacggctaggtgtcactcccgagtcaccgatctacttgtggttggccgggagaagtttgtgaaggccggatctcgcctccgcaagggaagagatacctcttagtggaaggagtgcttagtgcaacctcttgaggaaagggttagctaagacccggctcttagtgagctcctcaacggagagtagaatcccccaaggatttgaactccgggaacaagtttgcaagcttcaccttggtgatatcttttcatccctctcctctaattttgcttgcttgtgccgctattggtctagttgttgtatgtgcctttcttttcatgtggtagtcttctagatctagatacttctgtttgtgtgcgctcctctgtgcattttcggaagtttcgaaaatcctttcggaagttccgaaaattcccacccaagttccaaaaattactgcttccgcttttcttaagtttttaaattggcctattcaccccccctctagacctaattgaccttttcagtttttacattttgatactatagggagcagtttccttcaactagttgtactactacttattttgagatgtagagaggactatgggtgtgtatagttctttttgtgtaaagtttttgaagtatacataaacacatttgaagtattaaacgtaaactaataacaaaataaattatagattccacctgtaaactgcgagacgaatttattaagcctaattaatccatcattagcaaatgtttactgtagcatcacattgtcaaaaacatgacgtaattatgctcaaaagattcgtatcgtaatttacatggaaactgtacaattgttttttttcacatttaatgttccatacatgtatcaaacatttgatgtaacgttttttaccaaaatttttggatctaaacaaagcctatattaacttattttgggctgaattttttacaatttgaccctttgcaaaaactatttttacaaataaattgttgccaaaacttatttaaatcacctgacgctgaacttagacaactcagcgccatatcaactgacgctgaatgcaatggcaccgcggatgggagactaagtcagcgtgccaacgcatattcagcgccacgctttggcgctgaggtgtctaagttcagtgcctgaacaaaagggttatttttgaaataagctttagcggcggttcatttgtgaaaatagtttttgcaaagattcaaattgtgaaaatttttgtattttgggagtatagactagtagtggacgtttataaacaaaatcctccgctaaatcaccctcaaaacctagatccctgtcttgtcacggacaacccccccgccgcagagcccacctcctccctcccctctctctctctctctcctaccctaccaccatggcgtccgccgagacccccaaccccgacgccgaaatccccaacaccgacgccgccgccgccgccgacccagctgccgccgccccagctgccgccgccaccgaccccgccgccgctggatcgccgtcgcccccgctcccgccacgcaaacgccgcctctcccctacgccctcccccacccgccgctcctcccgctcccgctcccgctccccgcgccgcggccgcagccgcagccgctcccggagcaggagccgcgggcggagcgccagcccgcggtaccccgatgggaagcggaggcggcacaacgacctcaacgtcgaggtgtgccgcgacttcctccgcgacaggtgcgcccgcgccgacatcgagtgcaagtacgcgcacccgcaccccaccgtcgccgtcgacaggtaccgcccccccaccgttcccggagatctcgcctcccgctcccccccccttcctgcggcgcccgtgtctgattttggggggttttgtatgtgcagggacagcaaggtgacggcgtgcgcggactcgctgcggaacaactgcttccggggaaggacctgccgctactaccacccgccccctcatatccaggagtatgcgatgatgccccgttgctgtttgttccgtttgcattgcgtgcttttgtcgacgagggttggtagcgtgtatggtcttatgttctagagatgcacaagctgctgcaagtccatttattgatgcaagtcgattaatactcgattagtgcttccaagcatacagtcttccgtttctagttcaattcctgaaatattaacagcatcatggctacatgagatcatgctctactgtgctatctggaggattaaattagctgcctgacattgtttttttacttgtgcttctgatggaaatttcttggaacaatgttttatgagccactttctgtattaaaattccattatcgtgtttttatgttctcacagtttttatatttcatgggcatgtgtacccatgattccctcggtgtgttgtataggtgttctcacacattttatgtgttcagagtttggctgtttgggagaaaaacttgttttttctactttattctctctgggtaaattgatattattttgtttttttgaacattatgtttactctcacattcaggggcgaagccaagatttgagattaggggggggtgtgggggtgaggataagccatgagaccaaataactaatattgatagcaaaggaggtcaaatagtcaccgtcaataacaatcaatgcgtaaactagtcctttaaaaaaaaacttgaattttagatctttaataatatcattgaaagattgaaactagcctttattgctaaattctttcaatgtaaactattgaataatctcacaaataagtatcatctattttactttgaaaaagatgagaaatcacaaactaattttgtatatcatgtttcttgctaatgtttttggacttgctaactaactaaactgataatactttcaagttacacaaataaactagatgaatacttatcttaattaaccttaatatagagtaaaaacaggggggttgtggtggtggtggtctttggatagcggggtgttggcaccctccagcacccccctagctgcgccactgctcacattacgtagctctttatttgacacacacacacacgtgtatgtgctgggtgctatatgggagaagctttagatttctaggttaaaggagacactggagtggaatgatgcagaatgctgaaatgggaatgcactgtattttatgctagtttgcgattgaaaagaaaacttatatttgaatgttgatggcttgttttgtgacctatgattatctctttggaggcagggtagcatatttttgtaaatgaaatgcaggcattggatgcaaccagctgatcccaactttcttttgtttcttttacgtaggtcattattgagatcaattggtgtggaagacccaaaggtgaagatggtaagtttctcctgtttaacctttcatctgttcatcaatcatgcatcggtttgtcatttctctaagtagttaatggttttttactatctattgtaaagctaattggaaaggttgtttatctgcttcaaacaagaaaaaaaaggtagctaattggctgatgtcgcatggtatgtccataaggaacaagtaatcttttttgaaagctagaacacatagaagggctgtaaaccatctatcacctg

SEQ ID NO: 74706 - DNA, 587 bp, Oryza sativa
tcaaaagattaccatagggtgagcctaatcacggtatatctggttgaccgcatatacccgcgggcacgactacccgaatagttttactctgataaaaggtgtacacctgtacccacaagacacagccccacgacacgtttccgtgcgccgacatgccaccacgacataccggaaagagcccgtaacaggacccttcgcataaccccctctaaccaagcacaccacacctcaggtttcacccccactcctcgcaaggcagcggccagtcccctctcgtgcctacgtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacagtaccattagaaccaacagtctaaacattaatagg

SEQ ID NO: 74707 - DNA, 660 bp, Oryza sativa
ctacagctattagaacctaagtatcatgtgatacctcgcaagtatcacatgacaccacacaggaatcatccgacaccgtacctataggtatcagaacctgatatcgtaagtatcttgtggtacctggtaagtatcacttgatacctcacgagaatcatctgatgcatcgcatgtatcgatgaatatcaagtgatattgtcgtaggctttccggaccttccattatatttgagggatgaagtgaataattcaagtcatcaaacaaacataatgaaacatccgacacctcgagagaagaatattggagacattgctgggcctttaacctgccagtcaacttcaacctgagatgtgcccgtcaaaccactcgaaggcggcgaccagatgtgttacacattcaggagacttgacaaaaatggctaaagatctacaacatctcaaatattcttaactcatactcatgtgaatctagttcccaggatgtgcaatagattcacactttcatctcaagcatgattatacatagcaaacacaaataagatgaaagcgattataaactacatctactttagttacattagccgaccggccaaataaatatatagaacagcggaagcttgtctacccaatccacaagcacaccgactaggggtttacccca

SEQ ID NO: 74708 - DNA, 15656 bp, Oryza sativa
  unsure (1)..(15656): unsure at all n locations
ttttatcatgctaggtaagaaactgagttttcttgttgaaatgatgaatagttgctctgttttatatctcttttatatgggttcacgctagagtactctctcaaagattgaaaaaaagtagccacatattatccgggaacctgaggtaagtgggctgcacttgctgaactaagtctaggttgttacaagatatgagagagtaataagagctgctatgatcccgttctaagtttgacttaaactccggatgttttattttccaaaataataaactttgaagttcctcatttaatataaattcctaccagagccaaaaatattcacattgacaaacattatacattttggttacttgcaattccattgaactttgtcaaattcttgtgacttgtgtagatacttttcatgctctatgattaagatcatacacccacatatatgtacatgctaaactcctacactaggagctagcatttattgattccatttatccacaccaccatcaaaataaattctccatgcttttatgtgctttcttctcctaaaaagaaaatcctttccgagaaaaaagagagaaaagggagggaaagtcatggttatgaaaataataaagttatgctccctcaattatgagcatgatgatggaaaaaaaagagaaaataatgtgtagccatgccctctccttacttataaaagaaggatttttggagaaggaagtaagcacaacggagaagcattttctttatttttccacatttcatttccaccatatatcacacacacacacacactttgcacgatcttgatcttgagtatgtctagtcatctactctagtataagcttttgacttagtaataaatgtgaatacaactatgtcatgtttgatacctaccaagctccacatattaaaccttagagcagaaatcaaaaaggccactttggtgaggaattcatatttttacacttgagtgatcgagagaatcatttgaggaacttgattttcttttgaaaaatcattttaaaacttccggaataaaagttgaataaagattgagtgcttagtgctcaatttactattctatcttttaaccgctcaagacaagataaagtagtgtttcgcaggaatcaggtgtaaaggtaagccacagtgataaaattattcgatctaagagagaatacacataccttgcactggtacatttgaggatatacaatatagtagtagctcctgatcaacaaccaggtctttgttcccttttgtcctttactctgttgacggtcgttatagatcagtttcacccgtcaatattacccaaaataaaggagaactagttatgcttacaatgcatattgtgttagaataaaataaaatccattagtatatggtttacttaccccttgcagagaataagtacaaaatggcggagaatcgacatcaaaatagatgatcaatcaatcggacgatgtcgagaatcagatttatcaatgaatggcccaagaactaaaaaatgacacgaccaattgggccaaaatttacaagtttgaagtaagctataggggaggaggccacctgccaggaactgggctggttgggccaacccaggattcggccgaacaagctgcagcgccgatggatgcagggtttggctggacggctgtgattgatccccaatgacggttggtgggtattactgacctttccaaccgtcattaccaacctatataaacccctcactctctccatttcaagacacacctcaagcaagctctctcatactctctcaagcttagtttagtattctcaagctagtggagtaggaatagaatagaagtctgagttcggaagtcttcggaagagtttgggtatggttctagtagctctcatttcttctttcgtaagacttgtactttatttagccccagttgtatggtcatgacggactatcgtaaagaacttggtagtcaggggtggcttctcgaagtaccaggagggcatcggaaagagggcattagctagttaatcttatagctaggatgtatgtataatatgtatactagaagtataggaatagattcttttctattttctttccacttagctcagataatttaatatgagagtgagtagtcttatccttgtgtgtcactctaccctatgcttatcttaacccctgcttagacataattattacaagtaacatataaatattagcttggttctctctattataatcttcctatgggattaaacaaatacgatacccttggaatactctcgggtgaaatgctacaatagtacatcgtgctcttgcggatgaactctatgaccataatataccagaagtatttttgtgccattgctgagaattatatttctagtaatgtcgttaagaaataccaacagacatcccatataattacaacgccatcttcggccgtgctaccttgaacaaattcgaagctatcgcccaccacaacttcctcgagttcaagatgcctggcccgaccggagtgattgtggtcgaggggatacagccttcggtcgcagaagagggcgaagcggtggcaatatgtagagaagtgtacaatggtcaagtgcaagagggcgaaagagcaacacttgtgctgaagcagtcaccgtatgttaaggtgagcaaggtccaaattgacgaaactgatccaagcaagatgatctccctaaggggtgaccttggtgaagccgaagcaaaaaacatcctggccgtcatcaagagcaacattgatatcttcacatgggggccagatgaagttggaggcgtttcgccatatctcataatgaaccatttggcggtcaagccggacgccaagctaagaaagcagaagctacggaaaatgtcggctgatcgctagggggctgtaaaagcagaagtgtagaagttactcaaggccggcgtaatctaagagattaaccaccctgagtggctggcaaaccctgtgccggtcaggaagtcgaacggcaaatggcaaatgtgcattgacttcactgacctcaacaaggcatgtcccaaggatgatttctcgctctcaagaattgaccagctggttgattcgacagccggctgcgaacacatgagttttttgtatgcatactctgggtaccatcaaatactcatgaatccggacgacagagccaggaccgcattcataactcccaacggcaccttcttccacctcaggatgcctttcggcctgaggaatgagggggcaactttcgcaaggttgatttgcaaagtcctttgctcgcagctggggtgaaatgttgaagcttatgttgacgacattgttgtaaaaagccgaaaagctttcgaccatgtgtccgatctgcaagaaaccttcagcaacttgcgtttggcagggattaagctgaacccggagaaatgtgtttttggtgttagagctggtaagctgttcggatttcttgtgtccgaaagaggcatagaaaccaaccctaaaaaaatcggtactattcagcaaatgcagccaccaaagcgtgtacgaaaaatacaaaagctcccagggcaaattgcggctctcagccgattcctatcaagagcagcccaaagaggtttgccatttttcaaaaccctccaaggggctggcaagttcagttgtacacctgagtgtcaagccaccttcgatgagctcaagtagtatcttcagtgtccacctgcattggttagcccaacggcgggtagcgagcttctgctctatctagcagctttgcccgtcgccgtaagtgcagccctagtgcaagaaaccaaagttggccagaaaccagtgtactttgtgtccgaagccctggaaggggcgaagacaagatatatgaaaatggagaagttagcatatggtttggtaatggcctcaataaagctgaaacattatttccatgcccataaaatcatagtgccttcgcaatacccaataggcgaagtgcttaggggcaaagaaatcactgggcgattgagcaagtgggcatttgagctatctcccttcgacctacactttcttgcaagtctcaagttctggctgacttcttagccgaatggactctagccttcttccccgaacctgagccgatcaaccaaccatgggtaatgtactctgacggcttatggtctcacaaggggtgggagttgccatgatcctaacttcgctaggaggcatgccgatccgctatgctgcccaactgcagttcgacacaacgaacaataccatagagtatgaagctgtgttgatgggcctgaggaaggcgaaagctctaggcgtttggcatttgctgattcgcacgaattccaagctagtggcaagccaggttgataaatcttttgaggtgaaagacgacactatgaaaaaatatttggaggcagttcgctccatggaaaaatacttcactggaataacgttcgaacatttacctagagggcataataaagaggcagatgctctggtggtccacattcacctagggtcttttttgcaccaagtgtgccaaacctcattgaggacatcatggcaatcgaccatgctgagttgggcgaagacccaaaagactggcgaactccgtttgtcaagtacctaaaaaccggttggctacgggatgatgaagccgaagtaaattgcttgcagctccgagcagccaaatacatgctggtctccgaacagttgtattgatctggggttctacacctttgcttcaatgcctctctgctgtcgaaggtgaagatgtagcgaaagagatacaccaaggattgtgcggggcacatcaagtggcgagaactattgcgtccaaagtctttcggcagggcgtatactggccaaccgtcctcaaagtatgtgatgagcagatcaagaagtgcgaaagctatcagcggcatggccgaagtcagtccattccccagtataagctacaaccaatcgcaccagtatggcctttcgctagatgggggcttgatataatcggcctgtttcccactgtccgaaatgggtatcgcttcaccattgtggcagtagagtacttctctagatggatagaagcagaaccgcttagctcaatctcttcaacagcagtacataagtttatttggaaaaatattgtctgtcgattcggtgtacccaaagaattcatcactgacaatggcaagtagttcgattcttaaaaattcagagaaatgtgcgaggggctaaaccttgaaattaagttcgcctcggttacgcacccgtaggcaaacttggcagccgaaagggcgaacggcaaaatccttgacgcactaaagaaaagattggagggggcaccgtagggtatatggccagacaaagtgttatcggttcactaggcccttcggataacgcctacgagacctaccaagattagctccttcatgctcttatacggcgatgaggctatgatgccaagtgagctaggggctaattcgccaagggtaatcttctctgggggtgaagatgggcgtgaagtctcacgcgaactcctagaaggggtgtgagtcaaagcacttgaacacatggcgaaatacggcaatgacactttggcatcctataacaagaaggttcgaccgacnnnnnnnnnnnnnnnnnnnnttgtgctaagaaagaaggcgaaccagatggtcgttggaaaactgaagtcaaagtggaaaggagcatatcttgtcaagcacagatctagaacgggttcttttcagctggcgacattggagggcgaagagctaagccactcctggaatgccgcttcgctcaggcggttctatgtgtaaaacataggtggcacccattcaccagttgtaaatatgtaaatatggtgttgtaagccttcagcacgaaaatacaaaaaaaaggaaaataaaaaaagaaaaaaaaactagatgaagggttattatccattctggaggcccgaaccagtataaaaatccctgtgtgtttcgtctcttgtgtgaatgatgtcttggaaaaaaaaaacctctaaggcaaacacctgcttaacgaaaatgacaggggtgcgaagtgaatcggtcaaagcatcgctcactgaacactaaaattacaacagctcgttttcgatcatgcatcgatcatcgcattaatcggcttacaaaaagcacttagcatttttaaacgtttgctaaagatgagaccgaggtgaaagacgagagttgagaagtcgaacactcatcactaaaaatgaaaaagggtcgaagtaataagccctcaaacaaacgaagcgattaaaaaataacaagaggaccgaaacaggcagacctggatggtcgaagtatattcacatgataaaaaaaatactttacagatagattacaatatccggatcaggacattttcgccttacccctgttacctcagacgaacatggttcgtcatcgctacttattttatatattactctaaggggggaaggaggtgaaatgcacgccaaactataccgacgtcaagcaatagcagcttggcaattggtcatcttgaagtttcgccaaaacatagctacatttttgcggcgttggacatgacaccggtcgtaattttcgaaagatcggccaggatgtcttcgcatccagttcgccactttgacaaccacatagttatttccgttgataaccatttcacggtatacgggcttgcacgaatacctaatctttggtaagcccttaattgtgacaatttactcgtttgcgctttgccagtctttgaaaggaggctgaacgcattctttacgcagtggaacctgcgaagaatgtggaaatacatagcaaatcgccttaagaacaaagtcattcggaaaatttgcaagtttaaggcaagattctggcgaagatttccattccattcacataaacataaatgccatttcggctacataaaagcaaatcgccagcagcaaacaaaagctgaaccaagaaaaatttacatcaaaagaaaagaaggcctcacacctcacgatggtcttgcatatcttcgtctcttagtagttgcagtagtcggtcagggccgcggcctccttcttcgtcttttccaatttggcctttaagaccttattctctaccttcgcctatttaaaggcgtcggcgacaacctcattgtagggatacgcgcaggctatgataacataaatcaaaattttctagcacataaaccaggaaccatataagtattagatcatagatcgttaccactcgacatactgtgtccacattattaatttggtatctctataccatgatccatgagacatgatcatcaattaatacatgtgctgatcattaaacatatttgttccacatatgatatttgatcagggatcctttagaaatagtaacatacaacataaagagtctcatgaaaaaatcacatattcattaaccaataatgagttatctatttcaagaaacaatatcggataaatatgtaaacatagtatgtgatacaatcatctatatgattgcctctagggcatatcactaacagtctcccacttgcatatctaatacccattgccctagtgtgcgcctcatgcttagcctaagggagtggctttgtcaacggatctgcaacgttcaaatccatatgtattttgcatatcttcacatctcctctacccactatctcgtgaatgaggtgataccgccgtaaaatgtgtttggacttttgatgcgatctaggctccttagcttgcgcaatggcaccactattatcgcaatagaggtccatagggctggaagcactagccatcacacccaattgagaaacaaatttgtttatccaaacagcctcctttgctgcttcagaagcggcaatgtattcgggttttgttgtagagtcagcgactatatcttgcttggaactcttccaactcacagcgccaccatttaggcagaacacaaatccagactgcgatctaaaatcatctttgtcggtttggaagcttgcgtccgtgtaaccatttacaacgagctcttcctgtcctccataaactaggaacataaccttagttcttctcaagtactttaggatattctttacagcaatccagtgactcttacctggatctgattggtatcattttgttgcactaagtgcatatgaaacatctggacgtgtacataacatggcatacatgatggatccaattgccgaagcatatggaatcacactcatcttgtttcgctcatcagtcgtttaaggacactgattcttgccaagattaatgccatgtgacatcggtaagaatcatttcttagagtcttacatgttgagcctcttcaacaccttgtcaatgtatgtactctggcttaatccaattagcctatttgatctatctctatagatccttatgcccagaatatatactgcttcccctaagtccttcattgaaaaactatttttcaacgatgtcttaacggattcaagcataggaatatcattcccaatcaacaatatgtcatctacatataggattaaaaaccacctctgccagttgagctcattggtccacatacattagtatgtactagtgccaatagttcacttgccctttcactttgacccgtgaaaggtgcctttgtcattttgccaagtaaacaagattcacatgtctcaaatgattcaaaatcaaaagagtgtagaagtccatctctatgaagcttctccatgcgtttctcatttataagacccaagcgacagtgccaaataaaagtgggattcaaatcattaggacgttgccttttcgcattaatgttatagactgaacatccatcaagattcacaatgtataagccattcatcattggtgcatggaaatagaaaatatcattataatagattgaacaaccattgtccactgatctaaaaccataaccctctgcttgcaaacaagaagcagagataacgttcttacacaaagctggaatgcaataacaattatttaactccaaaactaatcctgacgataaagataatggcatagtgccaaccgcaacaacaacaactcttgctccattgcccacgcgaatgtccacttcgcttcttgctaagctcctacttctttttagcccctgcaacgatttttatatgtgagcaactgacctgctatcaaatacccaagaatcagtagaggaagtagcaagattaatttctataacattaatacctaaggtggaactctttccatcctgctgcatctgcttgaggtgctctaggtatttcctacagttcctcttccagtgacctgtctccttgcaaaagaagcactctgtatccttagcgggccctgtcttttgaaccttggtcttagagttgccagtactcgtgatctcatcagagtttagctttctcttttgaccagtcttcttgttattgggcttgcgcttatgcataaccatcacatggttagagtttttcttaatgctttcctcggcagtctttagcatcccatacaattcggccaaggtcctgtccatgttgttcatgttgaaattcaatatgaatggctcaaagctgggagggagcgactggagaaccaagcttttctagactctcggtgtacccaatcattttgatcacatggggactcactggtttaccttctgcaagcctgcacgcaaacaaggactttgaggtattaaacctctcagctcttgcttggtcctcaaacatgttatgtagtcccatgattatcgtatgagcatccaatgtttcatattgcttctgaagctcaagggacatagtagcaagtatgagacagcttatatcaagataatcattgcatcgcttttcatgatccctacgctgagcagtactagcattgttgggcaagttagctggaaaaggctctttaagcacaaactctttgtgctcttacctgagaacaattatatatatatatatatatatgcaaaattagcaccatgtctacatttaatcttttattaaacaatttaaaaaaagatactcccactatgtgttgtgaaacaaaattccctctagcaagatcctcattttattagtgtctagtgagctttggcatcacagctagacaattatcaaaataggtaagcaacaccttgctaattacatcatatgtgactcttgtgctgttggggtgacatctccatatagcaacccaacctatgccccaaggtccaaaaccgttttgataaccttgttaagtaaaccaataatctccccatatagatgtccgacatctatcctattttatcatgataaaaagtgacactctgctatggcaaacccatcacttataatcacaaccgtaataggtgcaactattagaaaagcataaattataattaatttttccgagggaatctatcctaccatgtcatataaaatatacaacagtaataaagtaagatagataaacatcatatgctagatatagaatcaaattctatttattaatataaaaaccaagcgaaatctaagggcaacgcacatgggggttgaggggggagccgtcccccgcgggtttcagggcagcgtcctgaaaaggtcacggggtacatagatctcatctacgattcgccatatgaaaaccttaatagggtaatcaaattatgctaaaaactaagtcaatctcattggttcatttttctcattggcgtgcagttcgagtggatatcgaactatccgatgaacacaatcttgcttggccgtggtgagtactagacattccagtaaagtcaccaacacatataccgattgatctcatcaacccatgtgcctattggtccattacatgttccgatcatccaagaactcaactactacataatagatctcatctactacgcccgcatatcaactatatgcaatgacctagatcataaactatacaaggcggctctgatagcactgtagggatacgcgcaggctacgatagcataaatcaaaattttctagcgcataaaccaggaaccatgtaagtattagatcatagatcgttaccactcgacgcactgcgcagcggaagaaagcgctaaggaggcgaagcaacccttgcgaagtagcgcgcgtcgatgtagaggaagtagtcgatcgcaccggctcgaccttctcctcctcgagcgttctcctcgccatactcccacgccgatcaacaccgcaaagcagcggcgcctctaccggtatccatacgtatagggacggaatgccacgcgcagatgtgctaccaaccgcgcgcggctagggttttgctcggggaggggagtggcggctacggtttctcacgtgatgcaatacgaccgccagtcacacccctcacgaatatataggatgcatgactcgggactccaaggcccgtaggactcctatttggatccctatccgaattaagctcatattggatctccatccaatccccatattctggcccattaagcgtgcaaccctgtaggttcatgtacaatcggttgtaacccgaaaactccttttcggtccacgtgtcaacagcggcccctagcagaatgtattgacccaccgggcatacataaagatcatatcgactgaatctctagtgtatacaagtatgaacccctttgcctcatgatttcgattaagctcaaggctagatatgtgccatcctctaatagctcaatcattcactcgaacctgtgatagattatataacttgtgattgactcctcaatcacctttggcatggccatgcacttccataatctataacatcgaggggcccagagatatctctccataggaaggacaaatcccatcttgattattcatatcccactacatgtttcatagcatacctgaaaactacttttataactacccaattacggagtagtgtttagcagtccctaagtaagttactacatatgttgggaaccatgacaatctcaggtctaacgattcaacaccaacactaaatgagatcactgatgacataacacatatggctcttgcagtgtcttatgttgggtctatccaacaacatgttccctaacatgtgttcacattattaatttggtatctctataccatgattcatgagacatgatcatcaattaatacatgtgctgatcattaaacatatttgttccacatatgatatttgatcagggatcctttagaaatagtaacatacaacataaagagtctcatgaaacaatcacatattcattaaccaataatgagttatctatttcaaggaacaatgtcggataaatatgtaaatatagtatgtgatacaatcatctctatgattgcctctagggcatatcactaaaactcatgttccaggtctttccgcccaagctcctccattgcctgaaggcggttcttgtaaccatccaggcgagccccgacagattgttcgatgctactttacgccgaaagagcctgcgagcaaaaagggggaaggtggcgaaaatatttagtgcaaaaagaacacttagtaaaaaagcgtgagaatgaaagaatgtgtactcgaagaagtgtgctcttgaccgacgtgcagccctcgtagaactcattgagatccatgaacgggctaggcccacccgccggtgaaacgagttcgttctcccccccccccacgatgaagggcataagctccgccctcaaaatctaaagggacaaaccgggggagggcggtgagggtgtttttagagtttgaactgtcgggggcgcgtttccctttcctnnnnnnnnnnnnnnnnnnnnntgcgcctaaaaagatcaatcttcgcaggcgacgcttatatggcccgcctgcaaagatgcccctatatagtcttcttcctccccgagccctgttcattctccccgacgtttctctctcctaaagtgacttaaatatagggggggaggttttgaacttcaaatcttcgggggatttttctacggtacttagatctactcatttccacactaggtatgcatttttaagcttttagaccttaatttgtgatggatttatgcatccaaaattttgaaggaagagctccatgttttttaattttatttcttgtcatatgtttatgttagatgtatgcgtaatacttgatgcctcttgttgtagtggtttaatgtggtaacataaattctcgttttttaatttttttgctatcatatccaccacctagttctagatctagatctagatcttgtcatgtatagagagagaaaaaaaatttaaatgtctattcattcggtgtaatcaaaaaatagttatagtattttgtaatatgccgatgatttgattttgttagattttcctaatgtactaatttggcatgtctgtgtaaaaaaattgaaataaactatgattttttattactttacacttaacttttagttaattagtttttaatagcgataagtttttcaataaaccctacaaatttggtattaattgtgcaaatattttatgtgtattttttagagatatagaaagtcgggaatggatgtatcattggccgaggtttttatctccatatagaaacgaagtggctaaatttattggtattgccaaggttcacgctgagaagaacaatatgaggaagataatttgtccgtgtgctgactgtaagaatgaaatagcctgggactttgacgatgcttttaaagtgaaggagcacttagtaactcgcggatttatggacaagtacgaaatatggacacgtcatggcgaagaacatgtggacgagcctgaaaatgtagttccgaaacaagttgaagacatggtgcatgacgatggttctgttgaggacaaaatcgacctagaggaaatgttacgtcatgcagaacccgaggtgctgatggggtcggcaagagggctaaataactttgaagctttacagaaggcagcaaaggaagttttgtacgatgagtcgaagggctgtgacagtgatttcacaacactccggtcagttcttgaacttatgaggttaaaggcgagacatggatggtctgataccagtttcgatagtcttttagaactcctgtagaaaatgctaccgaggcctaactcactaccatccaacacatatcaagcaaagaaactcatatgccccctttcacttggtgtggaaaagattcatgcgtgcgtaaatcactgcatactgtacaggaaagagtacgcttctttggatgaatgtccaacatgcggtgcaagccggtacaagtcgaatagcaatactagcctagaaccctctgaagcaactgagggacgacagagaaaaatcccacagcttgtgatgtggtaccttcctgtgaaagaccgcattacacggatatactcaaacccgcgagatgcggaactaatgcgctggcatgaagaagggcgcaagaaggatgggatgattcgacacccggcagatgctcgtcaatggataaactttgatgcgtagtatagagagtttgctaaagacccacagaacattagatttgccctgagtactgatggagttaatccttttggagacatgagcagttcacatagtacttggccagtgcttctcaccatgtataatcttcctacctggctttgtcaaaagcgaaaatacgtactactctgtatcctcatacagggaccccgtcagcctggtattgatatagacgtatttcttgaaccattgttggaagatatggccgatttatggaaagagggattgaaagtgtgggacgagtacttaagggaatacttcacagtgaaggcaatcatcttcgtgaccattaacgattatccaacaatgttttcagtttcaggtcaaattaaaggtaaaacaggatgtgtgatatgcttgaatggaacgcactataggtatctcccgggttccaacaagcttgtgtacatgcggcaccggcggttcctacgcacaaatcacaagtaccgtaagatgaaggcggagtctgatggtactgaagagactgatcctgcaccaaaacctacatcgggagaaaatgtgtgtgcaatgatagagaaaattgtttgcgagtttggaaaaatgactaagaaaccatcaaaggggataaagcgcaagaaacccgagaagaatacgaagggaggggatagtaagaagcaagatgacagttcgaagccagatgataaactccctcccccattcaagaagcattccatattttttaagtacctcctgtactggaaagatctggaggttcggcatgccatagacgtcatgcatctagagaagaatgtgtttgacaacatagttggaacattgttggacatgccgaagaagactaaagatggtatgcaatcaaggatagacctagtcgcgatgggaatcagggaagagttacaccctcaagaaggagaaaagaatggcaaagtatatcttccaccagcctgtttcacactaacacctgaggagaagaagtcattttgcaactcactccgtaatgtcagagtgcccataggtttctcatcaaacatcagtcgactagtttcaatgaaagatttgtcggtatctggttataattcacacgactgccatgtcttgctcaccgtgtttcttgcaattgcaataagagccataaaaccggagcatttaaaggttgctatcacaaggttgtgctactttttcaa

SEQ ID NO: 74709 - DNA, 771 bp, Oryza sativa
gtgctttcagaatgtatgtgaaagtgctcttgatgtgggattctgagattcagatagatggtgggggtaaggatgttgttcttgcatctatgcttgaggccagaaaccttgttgtactcagggtatgttgtttgaaaaaaaaaactcactgtcaactttttgttagttgtggaattttaatttttttttaatgtaactactacagcatgggtcagtcatatcttcgaatgctgctttgggagtctatgggcaaggacttcttaacttgactggccctggtgatggaataaaagcacgccgactttttctctctctgttttacaacattgaagtaagattaattgcatccttttgtaacatttgtggtacagtgtatctttatgctatacattaccttttgtatatgctagataatacctctattttatatgcactttccactaggtatccactaagtcatattatgctgggacaattgatatactatattccatcacaaatatattagtttcttataatttcttaaagaccctataacttacaaagtaaatgtttgagctgggttgcattcagagtttcagactgtctgcaccagaggggcatttttaaagctgtttcttaatataatctactccctccatcccaaaatatattaacctagtattacgattagacatctcctattattaagaatgtgattagctagaactaggtgccttttatcgttctgtaagcttggttcgctgttcttttgaactcgcagtgcccttt

SEQ ID NO: 74710 - DNA, 19059 bp, Oryza sativa
cttgattggtccaatggttttctattctcataaatgagtcctgatagatccgaggagttcttgagctatcaggctggatgaaatcaaactagggtttacttactagagaggaaacaagaagggatatggtaggggatctcaccagatatagggccttcgcggcgaagtgcagcggcagaggttcgtagacgtcgccggctcgccggaggggaagcacaagcgcccccctttctcactgtcacagtggcacagtcccacttctccgagggtaaagaggaggacaatttgggccgaaaccgtaccgggctcaattctatggcccaactgataattgcaccctaaatttttattttcattttgttggaatacaggattagagatgagtgtgaccttgaccccgggtacacttccacagtgaactactccctccattccaaatttttttacatatagtttttttagtttattcctaaatgatctatatatttgtgttcatttattaggtctattcgttatttgtgcattggagaggagtaaatgaacattgatgcatgcatccatgcacacatgtatttataacccacatgcaatattttgatttgctattggctaggaaatagtggggatggtgcatgcattgagtttgttgctagagtaaatatagtatgagagagttattagcttttcttgatcttggtgtacctatgaaatatgtaaatcaatttggaatggagggagtaacgctttacaaaatacagcacaacatgctgattagtctctccctcactctctctctctctctctctctctctgaaagatcacaaacatactgatcacttagctttcttcattatgtctatatgtatgagtttcaattgaaggatggttgaatcgaaaataacacaaaactaaataattcatgctttgtgcggttgtgcctagcaaaaataagcgcacgcccatgaaagagattccaaacaggagctgatcatcagaaagcaacagcacgcgttacttgctgagatcatgatgaatgatgatccagaactagttgacagaaatgtgcagcatgcaggagtacgaatcaaagaaccgataccatagggcatacactgaacagcatcatcgagaaacgagacagaagcacacgctcgcccttacaggataacagtacatgaattcgtctgaaactagaacattctgaaaagaaatggcaagttcatttagaaagcggaaaacggtaatgctactcagaatcggacccaaattgagttcctacgttcttaatggttattgtattcatcaaatggcttccagcaatgtctagcaaagtattgaccagttggcaaacatcatccgtatcctcgtacaagatttcagtacgcttcaactttcgacatcgaatcttcaacaggtccttagacttgctcgacttggtctttcttttccctatatcggaacttttggaggccttcgcagcgcacaatgatttgtataagctatcaaactcaatcaagtgagaataaaaataaatgaaggcaaatttaccttgcagcaccgcatagtgagcttctccaaattaggagacttcttaagaaggtgccacaatatcccgaaattgtcacctagatcacacttttccagcaacaaggttcttaggtttttgaatgtagggaattcaaatggtccctcatttggcatcacctaaaagatagaaaaatagaactcaataaacaagtacttgaaaccaacctgtttcattgtaaaatgaaagagaggaaacttataattttggttttaactgtatggcccaacaaagttactagcatagactttagagtgcagagtaatttcgttattagtgttgctctttttttgagcgaacatcgtgagtttgtaactcagctcgccttgctcacaagtgttacagaacaaaataacaagaacaaatgacttatttggaatatcacagcaaaaataaaactttgagatatcacagcacaaagaaaacttaattaccatctcaaagttttgtaaccataatcacgatgcacattctctaagaccaaaaagactaatcaggaccagggccagtgctccttgctggctttcatcggacaatagaaaaaactaacatacggtaagaaacacacactatagataacaatataattatccgatcttaacaagtacagctttatttagtactggatcagttgtaagaaaggtaaaatcaagcatcaagctagacatgcatcgaaatacaagctataagtaataatcaccacaaaagatcagatgtggatctttggtctaagataataagagttgcaagataaatacatatatcattatccaggatagaaaggcataccatcatattgaagcccaccagcacaagatttgtgacattaagtagattgctaagaagcgtgcattgcttgctgcggttatttttgtgagaactgtaattgttgagatgtattgatgctttcacgaggtaccgcatttggtctgaaatctggaagtttgcaaagctgagttctaggagcagagaagcaagattaggagcttctatagtcagcggaccaagagggcttggacttcccgccggtgatagaattggttcttagggtgaaccttaccaaaatttggcaatgcctaaaatttagataaattggtaacattgttaaaattttgataggattgataccaaaattctatacacactaccaatatttgaacaggcccatagatttttgttagaatgtggggttttttttgttcatgcctgattgatgatttgcagggttggcttattctgcatccatggcgaccgcgaggaagaggagctgtccagacaccatctccaccggcgaccgaccggctgagcgcgctgccggacgccctcctccacaccatcctctcctcactcaagggccgacagatggttcagacgagcgtgctctccaagaggtggaggcatctttggcgctccgtgccatgcctcgacatcgaccagagagagttcgcggccgccagtgagaattgggcaatctcccgaagtgaccttgaaaagtttgaggattttgcagataatgtgctggcctatcgctgtggatcgcccgcgaaattggacacattccgacttcgcatatgtgacagatatcattctctccgttcttcagatactgatagatggattcggcgcggcctcaagtgctccccgagagagtttcacttgcattttgattacagatatgactcctatttgcttgagatgcataagttgggttccaattatggctgcctcaccaagttgcaccttactaatgtttcattgcatgaatgcttcatggagcacatcactactgtttgcacccttctggaagttctagagctcaacagatgtagtctctatctccaagaaattacacatcccaagctgaagaatttggttctgcatgggcctgcagtgtatgatgaagacgaacttccagttggtgcaaatgcaaaatgttataaggagctaattatcagggctccttgtcttacttatctgaatttagtgcttccagttgacatgcgtcaaatttctttaaaggatgccgtctcttgtcagagcatcaatccgtttcagtgttgtctttccgtgcaaatgcaactttcttaacgtgttgtttaatgtgacaagtctagaattgtcgggtttccgtgaaatggtgagtcctctgtttctaatacatgtctcctgtaagcacttatgttagttgagcatctaaatgttttctcgctaactttccactcaatagatcatgtggcaaaaggatatggggtgttgagaaattctgagctgaaatagatgcacaaatgtctcaattgatctttagctagatgcctaccttgcttaatctttgtatcctatgggctatgtgcttttcatttcttgtaagcaatgcaactgcattcatcagaggctacaggctaacgagtatgtttgaatgctgctcccttcttcaccccttgtataaaaaaacatcgctcctagttccttcagttttttcttaggaggaattttagtaagcaatgctaatgctaaaattattgtgctctctttatttatgcttgctactaagttaatgcaactgcaacgaaacatgtatgcttctctttttctaaaaatttattggcaaccaactgttgcttagtttattaactgtaatattatcctaatttcaggtgcggctggagttcaatcaagtcgaattccatgcattcaaaaacctgaggaccttgttgctggatagatgccgtccgagttacaacaatgagttattgcgtcaccttctccagaactctcctaatcttgagaagctcactgtgcattgctgcaaggtatttctttgtatagtccttcagttcacagtaactcttgctgaattgtgtttgctgattaactcatatgaaaccttttgtctagcagttctcaaaaggttccctggagtggaggaaatcatcccagcataagaaccaggtgaactgtaggaagctgaagtctactgaaatcatatacaaggacattgatgatgttcgtgagcttgtcgatcttttgctggacgtctcagggcacctaccgaagaacactatagcgctcaccaaaatatgaaggaattatcagcctgaagccctgaacctgactagtcctcccactatctggtttccatcgataccttctatttgcagatgtactgtttattgcaaatctaatgctaaggtcctattcctgaatctaatctagatggtggtaggactcctaagcctcctgcatgtcttgtttgtgcatcgtggtgaactgtttagtagcgtttaattgcaggctcaaggagaccaacaaaagccatggaaggttttgaggtattatatattcatgggttgtaaaagctactactgactataacaaaataagtttgtaatgcctaagcaatttagccattatcatgagtgctgccagactttggtatagcctgtcaatttgacagtattcttaccaaaccttctgggaaaaaaaagaaaaaaaaagcatgaattgcaaaggtgctccaaaattctggtagcatatttctctcctatctacaggatatggtatgccaggtccatcaaagcccatggatatgtcttgttgagttgtgacttggtgcttttgccctccgagccgctgctccatgaaattcgattcaattgttagcaaaacgtagctctttcgaatgaaatttttggcaagtgaaatgccttgatttcactcaacgcgaagcttcggttcggagcatggccacatgtcctgaggccattcatagtttgtcctgcgattttaccgaatttcgcatgccagctagacgaagaaccacattagccacatacttcacaatgtaagttatataaagtgggtctgtcggtgatatagacccgggggtgccaagcttagaggggagaggccacccccagcgtccacgtggcgctccctcccgagggggtcgggcccgtggatgagtggcagccatccctttcgagcccccgacccctcctcgtggccaccatgggtatggggttaggtgggcgccccccagcgtccacctaaccgcatttaatgtgggcggagcaggcatagcacgccacatttaatagcagtttgcgatcggtctgtgaccggccgaatgacagacgggacggcgacaatctactcacgccctgaccatgtgttaggcagcgtgaggcaggtatgccccatcccatcatgatgatccaatccggagtcggcttgaccgctccggacgtgcccgagattgtgttcctggagcatgcccccaaaagtcctcatccattaaatagtgaatgacaagggcgccccccgtgtcagccgacatgatttgatgggccccacgcagcagccgacgtgcgaatagcttccgggttaaggcacaagacatgcatttaatatagagaatattttttctcttccctaggtagctttcgcagcacatgtggtaacctcttggagtataaaaggaggtcaatgcctagcgaggagggggatccatgggtcgaaggttggggctaactctagcttgtacaccggagattcagagactttgaaagctcggaaaaatcatcatacacaggaatagggtattacgcttcttgacggctcgaacctgtataacccccttttgtttcatcttcaccgaggggcccgaccccctctagaacacactacacttccttccatccaactcctcagttttcacccgatgccccccgccgaactatcagaggggggcctcacagtcccccactcgaggagttcactctccggcaaggtcccactagtatcatctttttcacttttttttatctctctttctctctcccctactttccccatcgcatctcctcctttccccatcgcacagaagctgccgtgggcgagggcggcattgggcggcaccaaaactggggcgacgatggcggcggcgggcggccagatccacccctcctttcctcccccgaagcagcggcggcgtcggcttcgcgggagcggcggatgggcggccagatccaccctcctcggtcgaggccgcccctctcctctcgttgcccggcggccaccgtcgagcggctgctgcacgggtggttgacaacggcgagcggcagcttgtatcggtttaaatttgtccgtaacgaccgtcaacaggcgtcttcattgatacggtttaaattattcttggtcttggtgaccaaatattataagataaccaaattgggatgaaggaaatatttttataatatatttgttttatgttgaaaatattactatgtttttctataaatttgatcaaacttaaaagagtttgaataggagaaaattcaaagtgagttataatatgaaatgaagatagaagtactttacgatatgcttttcctactatacatcatggctgtgttattttggagagattggaaaccctttccctccgtacgtaaaacagagcgatgaattaatgcatgattaatcaaatattagcttaaaattattgaaaaataaattaatattgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgttctggtggatctgtgtatgaagaagctacaaaagagctggagaaccagagagctcttactctctccctctctgatcgttctggatccgaaaaaatcccctttctaagtgggcaaggtcctccttttatacctcaaggggataccacatgcaccatctctctcttttttttgtggggacttatcctatcttttcataaacaaacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaacgtcatgcttgtaatggttaggatgaagcctggtatatatctgaccgggaccaacgtgccatctccaggagctaacacgctggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtctgacccctcggggagacaaagagaagggcggccgtatcaccctcgggcccgaccccccccccccccgagggggttaggccacgtgggtgatcgtgtctgtctcaagtctctaagtcatgatactcccggtcccatgtcaccgacagtagcccccggcgttacgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcttatccacctcatgcaccgcaaacgggcgaatgggattagtggaagcgtgggcgcgagaaacgagggggcaagatagtgggcgcgagaaacgaggagccgggcacagcgttggcaagggtataaagtcgtcgaggaagagatttgcttccttcctctcgccattattccccttgtcttcgccgcttgcgccctaactccttgtttcctgtgccctaccttcgccacacgcgctcgctctcaaacatctcttcttctggcatcatggcacggggctccgctccgcttgacggtagcgtgctgccgccttcccgcatcgtgagcgagagacaggccgggctgccgcgccgcttcatgccggaatctgccatcggccgggagatagtctcgctgggcgagggatgcccggcgccacgctacccggggcggtccgtcttcttcctccctttttctatggcagggctggttccgccattttcttctttcttcatggatgttctggagttttacgatctccagatggcgcacctcacccccaacgcggtaatgacattggccatcttcacgcacctgtgcgagatgttcatcggggtgcgcccatcccttcggctgttccggtggttcttcaccgtacagccggtgtcgccgccgtcggtggttggtggttgctacttctagccgcgggggccggtgctgaaccgctacattccctgcgtcctccgcaagaagtgggatgactggaagagcgactggttctacacccccctcgccgacgaagcgcgcctccgacttcggagccagcctccagcgcaggcctccagctggtgggcgccggtagatctgggagatggctatgacgccgtcctcgaccgcttggcgggcctgcgattccaggggctcacaggggccatggtgtacggcgactatcttcatcgccggatcgcgccactccagcggcgcgcccggggcgcctgggagtacaccgggtccgaagacttcatgaggacccaccagggggtcagatgggactgggctcctgaggacttcaagatagtggtccaacgggtgctgaatctcagctccgtggaggcatcccttattcctcaaggagtcctccccctctgcagcgatccagaccgcgcctccatcctgaccatcatgcaggcggtcggggcatcggaggagcgggctcctcgaggccacgatggcgcgggcgggagccacaggggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgctcggagggggccacaccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtcttttttctgtttcagcgagatcccgtcgcgtccctcccgccattccaagtccggccagtctgaggccgaggacccggcgaccacagaggcccggaggcgggaatctgaccggcgagaagccgcggatcgccttcgggaagccgaggaggccgctcgggaggccgcccgggctcgccagaccgaggaagccgctcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcgccaggccgaggcgacgacgacttccgaggcaactcgcgacgaggccgcgggcgcatcgcttgggcccactcccacgtgcgacgctcaggacaaaccaggtccgggggacatccccgagtctggcacgtccatcagcgggccaagccgcgcggcatcctcttcgaggcggctcttccccacgcctttcgttgctccactgagcgcagaaccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaagacaccctccgccttcaatacgggagctgggaggcagagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgccatccgggaggcaacgctgactgcgcatgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagcgcgggaggagcaggcgtgccgtaatctggaaggtgcccgcgccgagagggccgcgctgaatcagcgggccgctgagctcgaggcgcgggagagggagctggacgcgagggcgcgcagcggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgtttcgggacgccgtctcccgtctagaccgcgccggccggcaggcgggcctctggggcaggcggactgcgaagtacgccgccaaccaggggggcctcgcccagcgcctctcggagatagccgggactctccaacggctccccgaggagctcgagaggacgattaagtcatcctcgagggacctcgcctgaggagcggtggagctcgtactggcgagttaccaagccagggatcccgacttctccccatggacggcgctggacgagttccctcccgggaccgaggacggcgcgcgcgcgcaggtccgggacgccgccgaccatatcgtccacagcttcgagggttcggcccctcggctcgcgttcgccctcaactccgacgaggaggacgaagacggcggagtgggcgacagtggcgacgaggctggcgacccgggtgcatcggagtgagcccccaggcccccgccaacctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggtagctctgtgccatcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagagcgcggctcggagggccgcgtgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggtgtttccccggttgctcggcttggcgtggttcggttcgcccagagcaccgctggcaactcctcgatccacgaatcgccgtgcttcttgaggatgttgaaggtcttggttttaaggcctctgaggatttccgcattagcgcgctccacttggccgttgcttctggggtgggcaggtaaggcgaagcagagcttgatgcccatgtcttcgcagtaatcgccgaaaagttcactagtgaattgggtgccgttatccgtaataatacggttaggtactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacgatcccaggatatcgagcccccagacagcaaatggccatgaaagtggtatgatctgcagggcctgggccggctgatggatttgcttggcgtggaattgacacgctctgcatcgccggaccaggtcgaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggcctgttaggcgcgtccgtctcccctaaggggtcgggtcgcgccgacggctgggcaagcctttcttcaaagacgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacaaacctggttaacgaccagctgggagtcgcctaacaccaggaggcggcggatccccagtccagctgccaccctaagtcccgcaaggagtccctcgtactctgccatattattggtcgcccgaaagtcaaggcgaaccaaatatctgaggacgtctccgctcggcgaggtcaacgtgacccccgcaccggcgccctgaagagacaggaagccgtcgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcctggagggcctcactaacaaagtagacgggccgctgcacctttcggtggggccgatcctcttcgctaggggccacatccctagggcgctctttgtccaagcggcctcgcggggtgcactcgtcttctgtgccgacgacctcggggtcggaggacgacaggggcggccttcccacagtggcctcggggccgtcctgggggtcgggggctcctggcgtcgtcggacaagcgggcaaagggccaactctggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgggccaagccagcacagggtgggggtgcacggaatgaggattgtcctcatcgcgctccacaaccaacgccgcactaaccacttgcggggtcgccgctaagtagagtagcaaaggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacacattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatcagagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaacgcagttttttcctcatcctccctagccatgtgaatctgatggtaaccagagtatgcatctagaaaacacaaaaggtcgcaccccgctgtggagtcgacaatctgatctatgcgaggcagggggtaagggtccttaggacatgccttgttatggtcggtgtagtcgatgcacatccgaagcttgccgttcgccttgggaacgaccaccgggttcgccagccactccggatggatgacctcgcggatgaatccggcctccagaagtcgcgccacctcctcacggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccatccagaagaccaccgattcgtgtggtcttggacgggccgtcgcccagggcaacctccttgaccgggacctcgtcgcacgtgactatccgctgcctcggggcggcggggatggaggtgccaagcctctcgtcgccaccctcgggcttggacgcagcggcgaggtggtccgcgcgctgctccatacaagcgagcgcgactttgaggtcgccatggacagagatgggaccaccgaggcccggcatcttcatctggaggtaggcgtaatggagcgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgacccggcgtcacaccgataatcggctgggacagccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacgatgcaccacttgccagttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctaaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcatccccggcggcctcgatcccggtcgtgtagacctggagaaactcggcggggttgacgctcccgtcgtatttttcggcgatggtgggccagaaccttgggggccaacggacgttccgaaggctcgccacaaaggctctacagccgacaccaccaaccgggggcacggagggttgatccccgcgtccgtgttgatgtgacactccggacgaggaggcgccctccgttgcgtgggcagcacgtcggccattacgctggtgctcgatactgatgcgggcatccggccctccacgcagatcttcctgggtcggaggcgctgacgaaggagtggcggccgaatggcgagcaacagccgccgctcgccgcgccctccgccttgacgacacggagcgggtggtagcagcgccagaggtcttggtggcggaggaccgcccaccagcacctaggcgctgctgtgccgtcatgaccaagttggccacgtcgtccagccaacgttgggctggagactccgggccagggacaatgggcgggtgacgtaggagcgcgcccgcagcttggagcgcgccctggggcgtgctgccgtcgccgtagacgaggaggcgacgctccccatctcgccgcccttccccagcacccgtggatgtcgaagtcgcggatccttcgaccctctcgagcgcctcctcccgcctaggactttggcgtggaaggggcggtggagtacgagctcgacggcgtgggttcggctccccgtcgtcaccgctaacactcggagagaggctgtgcgcctttgcttgttcagccattgggctgaacaggaaaagcttggtgcacacgaaagagtgcgagagcttagaagaacacacgcagaaccccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgttctggtggatctgtgtatgaagaagctacaaaagagctggagaaccagagagctctt

SEQ ID NO: 74711 - DNA, 2108 bp, Oryza sativa
cactcccatccccttctataatattggattatctcgtgagttgatagggaacatatgccaattataatcctaacgacaacaatcggggtccctaaatgagtatggagataagtttatttcatatgtttatcacacaatcaagtgtaaatgtgaatctatttcacataagatggttgaataatattaaatagcaataaatatagaatatgtaatgtaggaaaaaccataagtttaaaacatgttgccatagtaatttgcgcacaaataaatgcatatgaggatataacagggagggggatggaaaaggcaatcttgttccctctgtgcaatagaggattttctagtggtttgacaaggaatgggtccctattgcaatacctatacaacagtttccttctccttttataattgctaacctgtttttttgtcgatggtaggaaccaactctccattggatttgtgagtagatttacgctagtaacatcttcttcttttccaactctgtggtgacaacaacaacactgtgttaaagttcaaataaatagagggcgaggggacgagggatgggagaagaggaactgaggaagagtcttacgtagagggatgccgaccacggtggtagatcgtgatgggcggtggggtggtcgaccgtgtggagaggaggggaatgagcgtggtaagtgatatatagggccaaggaaatccaattagttggtggtgagcggtggtagcatccggaaacgtggaagacactggtgtgagagatctatacgagaaactataatatgttggtggttaaattggaggtgtagggagtaggatgggagaggaatgggtggcaagggaagcatgaattgaagggaaccatgggataaagtataacggctatatcatggcaatgtggggagagtgatagagcgcgaagagagtgggttgctaggattatcttgaaagaatgtgagtgtttggaccgttggatggaggtaggttttctagtgtaataaaatgataccttgtttagatccaatcctggaatccgattagtaggcggtgagtagtggtagcttttggaaacacggaagagactagtgtgagagatctattcaaggaagtgtaagatattggtagtaaaattggagatgtatggagcgggatggctaaggaaggggtggcaagggaagtatgaattgaatgggagtatgagataaggtataacggatgtggcgcggcaacgtgaggagtgtgatagagagcaaagagagtgggctgctaggattgtcttgaaaggatgtgagtgtttgatccgttggatggagtgggtttgctaatgataccttgtttaaatccactcctggaatccgattagtacgtggtgagtagtgataacttctagcactacaacaaaaacgtcatgcaaaggcaatttttaaaatgactttaaaatcaagagttctaaagtgtagagacatcttttagaggcactttaaatattgtctaaaacgcttttaatctaaagacacttttagcacaatttattaaatttatcttgtagaggcacttttttcaacactttaaaatttgccttatgtaaaggcattttttgagacatttcaatctctatagaggcacttataggaaatttaatctaagctaattaactacataaaagtaacacgcggcacatatgtacaagtaataacatgaggttgagatggttagaccattcaagttaaaaataatatatgcaataagtctaaagttaaaggattggcaattgcaagggaagtgattttttttctttattacattggtttgccatggttttggaagattttaatgcctttagaaaatgcctatactctcttataaatattaaaaatgtgcctctatgaaagtgccagaaggcatagagacattttgtaaagtgcatctagagtattctagagacatttaaaaagtgcctcaattcactagaaagcatttatgagacatttttgaaaatgcctctagaatattctagagacatttaaaaagtgcctctatattattagagaaatgtctcttccatgcatttttgttgtagtgtggagacacgaaacacgctggtg

SEQ ID NO: 74712 - DNA, 661 bp, Oryza sativa
aatttgggagagagcttcaccactagcggcacaaactgttggaaactcgactcatgccacacctaagttatcagacgaagatggatttggtaatcggttgggagtacgggtcagtctaccaatagcacagtgctgctgctgctgctgctagcaccacaatcttggccaacccaaacagatatcaaatcagctcataatgtggacgtcacatacccaattgatgagcacagatgatgaacacactggagtatttggaccatatgggatcagaggaactgcaaactagtgttccaaactgtcaaacatgctactgtatttgcatccgaaagaaagaacatgcatgctcccactgatgatgcatatgcgcatcatcatgcagggattcaagattcacgccgcgtgcgatctgatccccaatcccccctctccttttgcagtggaatggaatcccatgcctttactcgcacgacgatatgccgctaatcaacaacacctacccactcttttagatctgtcacattaaagatccaagaccgcacggatcttgcctcaagacgactcttcgatcctaccaacccattcaaacgaaacgggcccgacctatactagtagaaatccgcgaggaacaaaaagaagccggtcagccagcgacaaggaggga

SEQ ID NO: 74713 - DNA, 1649 bp, Oryza sativa
tgctacgctcaacataccatactcttgagattatgacgacacaaattttcacaaactacaaatggagatttagcaaaaggtttgcttttaatttttacctaagcaatgtttggttttcactatgcttggttttagtttttccaccatctttatatatgtggtgctacagcttgaatggtgacctttgtaataagttatggcaggatgcttcgagctaaaggttggattaattttattatcataaaaatatttggattgaaagaacttggtttgctatcatattaaaatattgacaatactaaaatctaggcaaatattgattgatctgccattgcaaccatcctcaccactgccatatcctcccaggtcccgacaaccaccgtgagctcaaatgaagcttctgtgctggcgtctcgctccacgacggcgcacaagagcgacccgtacacaagatcattggaatgtgcttgctagccggcgacctcaagaagcagcatgggtattcatgacgacgaggccaataaggaaacgattgtaaaagttagtgttgacatagggacccaaaggaaaaattgactaatcaccatcggtgattgcgattctaaacttttgtgttccgaaggccgtattttaattatggactggatattgggtcctctacgtaaactttgggcgtaggtgatggcccaacaccctctttctcacttataggccaggcccatattccagtccgcatgcacgtgagagttttgttttggagggcccacctgattgtaatccctttccgaggaaatgggccggatttgagctggcttcagatgttgtgggccgaaaaccattgcttcctcgcttataaatttgtttaatctactaaaaaataccctgcacattgtaatggactttcttatagaaaaaaggtctatcaatccttacgcatattataccaaagcaaataacacttataatttttttatgatttttctattatacaaacatacctcatataatgcaatgggttaaaattgtgtccattatgtcatatcactttagactaagattttatatatatatatatacatatatatatatatatacatatatatacatatatacatatacatatatacatatatatatatacatatatacatatatacatatatacatatacatatatacatatacatatatatacatatacatatgtacatatatatatatatatacatatatacatatatacatatatatacatatatgtacatatatatatacatacatacatatatacatatatatatatatatacatatatatatacatacatacatatatagatatgtacatatatacatatatacatacatatatacatatatatatgtgtgtgtgtgtgtatgtatacatatacatatacatataaacatatacatatacatatacatatacatatacatatacatatacatacatacctacatacatacatatacatatacatatatacatacatacatacatacatatatccaaggaagttaattttttctttgcatatttccattttctttttggataatattaacccattttgttccacctttctaaaaaatatttcaagatgagcaatatgttctttgtaagtcctt

SEQ ID NO: 74714 - DNA, 3956 bp, Oryza sativa
  unsure (1)..(3956): unsure at all n locations
aaaaaataaatattccatactacagagtcatacaggcattaaaaaaatcgaagtgtaaaagtgacacacttaggaccatgttcaacaaagggcatgaagccattaacattggccacctttaggactatatgttgatatgttccacaaagggcatgaacttacggtggataaaatctatggcttgacaaatatcctggagggctggtgcaaacaggtagtctcttgtgggaataataaggtggtcaatcccatgggcctgcaaaagtaggacttgttactcgtcaggaggatcttgcattgttgattgcaaacacaaaataaagtgattgaaaatcccctgaatgaatcaaatgaataaaattatgctttaaactcaacgagaagatgtctgacaacaaaagactacatcatacactctcacaacgagtaaataatgaagaccaagtctttccttctgattgagtagcgaatcaaggttcacaacacaaatgaaatcatgtactaagctaggaaatcaagtgataagagattttacctggtataaagatgttgggaccagggtctcataagcctcattcaatgttacaactccctgaactccaagttgcttcaaacgtggaacatcacttgggaaaggaacagcacctagcaaaatatactgcgggtggagattggacaaattagtcggtgagatctttatagcacagactcaattaagagtactaaattatgtaaaacaacagtgtaacaaagaacggcaactaaagccatgtccacaaatccctccacatgccaaactaaacatcatatgagacttactgcagtctacactagtaatttaccaaagaacaggccgaaataacgtacgcacttgaagataattactcaaatttcttagacaaaatggagccttaatggaacaaccacaggaacacaatcactgctcacggggaagcgaagggtattacttcagggggaaaaaaaggcaatgaaactctccccgtaatatccaagcataacaaaaccaacccccaagtgaacaaatcccacagagataagtcaacagccaccctaacagtcacgagtaaaccaaaagcgaagcctataatcgcgcgaggcttgtagagagtttaatcacgcgagtcgaattcagacgcaaggaaagagggggcaaacccacctggtcgactcggtcccaccaccggaactccgcctcgaaccggttgcgcagcacgttgtagagcagcgtcgggtagaacagcaccctggcgccggcgccgacgagcgcacgcttcgcgctcagccgcgctaccaccacgccgccgcggacgctggccttctccaccaccacctgctgctcctcctccccttccgaccgcaccccgtcacactctcccagctcgctaatcctcatgcccctcctcctccttcccccaccagcttcaaccctagcgccgccgagacgactccagcgccctctcgcccttccagagccggcagatccgcagggggcgcgggagagaaagcgcgcggatcgggaggtggtgatggcgagttgcggctgcctcgcgggacgcgagaaatgggaagagcgcctgcgccgcggtgtctaaaacctcggtagaggcggatgcggaaacaggtggcaattttgctgaatcggagagagggccaggggagacggtctggtctcgctggttcgtggttttttgttggtgagagaatgagagatggaatttattggtggaggaaacgtggtgtgtgtgctctttcgcgtcaggcccttcaacagctgcataattgtgctctttgatggttggatggtttggtaggtgcaacaacaattcctcaacgcgcagcgttttgttcatgctattgaattaagaggttcattttctagagtacatgtaaaagattttcgtgtcccgcttgcgttaggagaagaaaagggagcacaacagaacccaaacataatggtacggagggaatgaagagttttttagaggtccatgctcagtatacttgaaatgtttaactgatgcgtctaatgttctccttctccatactccaagaggtactccctccgttctataatataagggattttgagtttttacttgcactgtttgatcactcgtcttattcaaaaaattttagaattattatttattttttctgtgacttactttattatctaaagtactttaagcacaacttttcgttttttatatttgcacaaattttttaaataagacgagtggtcaaataatacaaataaaaactcaaaatcctttatattatgggacggagggagtagttgtttagtggggattgagatccgatgcagacacaactgcaccataggactgcatgtattgtaaccgttcattttaatgatcaaaagctcatatttaccgctccactactcaaacagtagtacataaaacaatattttatactataacagtttttgctacattgccaagctaatatgtagtaccgtttaatttcaatccaatacagcagctgcaaattatttaagttacagtcaatactatgactgcagctgattcagatccgtttagtgggatacacagtcaatactcaatgacatgttttaattgtaacggaataacatcgagtcacaaaaaatacttattaatttgttaaaaataaaagaatatacaaaggtgccgaacatggtagtagacagctcttccaggggttgttaaggatatcttattaagttgagtcaatccgttctatgccattaacaattgtgtgggttctacaatatgccactaacaaatttagttctacaatatactaccgaacaatccattttctccttatatgccatcgttgttagtcagccattagttttattaaaaactttgtgcaaatacataagatataaattatgctttaagcacttttagtgataaaacaatcacagtaaaaataaatgataatcataaaaaaattaagtaagtcaaatgatcaaatatgtgtcaaaagttaaagacgactttcattaaaaaccagatgtaatatttaggctttgtttggctaatgagttagggaaataatttcctacccacaaaagacatctttaaattccaaccattcattatcccttttctatttaatcctaaccactggtggagaaagcctttttactcccagttggtaacccccatatagtcccggtttttcaaccgggagtatgaatccaggactaaagatcactatctttagtcccggttcaaatacccgggactaaagatcgatctttagtcccggttggtgttaccaaccgggaaaaaagagaggaatctttaatcccggttgataacaccaatcgggactaaagagagagtagcgctttttttttcttttgccagatttaatctctatattttctcccaaatctagtgccatgtatatccctaaatcaatccccaaatccccaattcaaagtaacatcccaaatcttaagttacttataaacataaatcaaatacatcacaaatcctaaaaaaatatactcaaatcaaatacatcacaaatcctaaaaaatacacacaaatcaaatacatcatagattatacatctcatatccatgcaacgaatcacaaaattacacatcccaatcaatcacaaattgtaaaaaaaaagaaaaaaaaagaaaagagaccggccggcagttgagagggcaaggccgccgccgggcgcacccccgccggccgccgctgcgcgcggcactgccaccgcccgccgcggccccgccggccaccgggtcggatgggaagtgaggaggggaggaggaaggggagaagggggaggaggagttagatctgtgaagaggaaggggaacagatctgtgaagtgtaggagaggataagggatagagatgggtnccgagcaagaaggcggccatggcatcgatccgcgcg

SEQ ID NO: 74715 - DNA, 6277 bp, Oryza sativa
tccatctgataaaagattttgttgttctggttctgctgttcctgggtgaatagacatttggtgtcgatccatattcttggcgccaaaaagcaggagctttccctctgctctgcttttgttcccgcgcgctttgccgctgagattctatttgctgattttttgggaagagaaataagtgattctgttgattagtaatccctaattaatcacaaatggtgggatcactatatgcagctgttgacagaaggatgtgtggcagggatgaaggcaacggcaatgtttgccgtcagccaaaacggcagacgatgtgaacccatccaaagtatgtctggtacgctatggaatttgccacagggagcatgggctctaggccgaataccaacaacttcaggtcttggaaatttcatttgagatacccggcagcatcgaaagcctattgtagggctagatgatccaccataatcccatccggcaaggatcttgccaaaagcaggcgtaaaacctgcagactccataagcacatcggagaaagtctccatcaaactccatcgccaaggagggaggaaggaagctgtcacccagtcgcctgggcatcgccccaaccctaacccaaaccctaacatgattacatgaaattagttagtattagattagaagggtgcgatctgtatacaagtacgaaagaactcagtttaaaggtcagctccgagtaaacttttgaaagttatgtgtgccaaaggttccatttggttagcttgctttaggattcattaacattttataattttcagggttatggataccacatacctaacagtagttaactaaatctcggtagtacccaccacataccatatcttatacggaaacaactttcggatataggaagagttccgcataaggaatgataaatagagttctacatggaaacgacaaggactactattcatattggtttccctagttctacttggacaaggggacacctatgggtataaatacaaggccccctaggaggagaggagacacaatcaacatacacagaacaacaaaagccacaacatacaagccaacatacaccaagacacgccgccggatatcgacatcagagatatgcctggactgaccctatccggtacctacagaggccagctgtagggatctagcgctgtctttaatctcgtcgggcacggattcgaggaggaagactaccctgttgtcgactaagtgacgatatttcaaaccactatgtcgacaacagatagataggctaccccaaatattgtactggtgtgattatggtgaataagagcaacgaccggcttcggtcaacaggatgtagggttattacctgacaattcaggggcccgaacatgtataaaaattatcgtctctgtctcttttacctaagtctcgtatatatcctggtaccaacgatccccatactatacaaataccagaatcgtgacatcaaacatcgacaataatagagattgctaaaggacgctccatcttgtttacaaacaaggtcaaaatgatttgaaatcaccacattaacacaaaacagatatctcccaaaaaaaacagagagagaagaaacctacatcagtaaccatgaaggatctacattattataacggtgtagaatgcagattgactgcatatatattatatttattgtagctgtcacagttgtgtgtgtatgtgcgtgtgtgtatatatatatatacacacacacacaagcaaaatgcccgtgcatcgctacgggtaaaagacatataaaatattttattaggctacatattgataagaaatttcaatgacaattcggatggataaaaaccactattgcatactgaaatacttgctctttttcaactcccgcgtggtaaagtgcgcgatctcctttttctaaaattatacctgggctcgcgtacaaagtgattgtgtcacgcgtagatgacatataggcagtcgagggagaagacgtaggcgctggtaccaacccatcactgattgagagaagggagaaccagagaagggacaagggaagagcaggtgcgttaagtgaatggcaaggcggataattcccttctaactgtcagggtccttaccgaagcgagttaaaccgttagatgattcaatcggacgattcaacatggtccgtgtaggcgacgaatgaaaaggagtgtgatgatcggaaaaatccgtttttttaagtaggaagggataaaagttcgtgtattggtactcgggcagaacatccttgaatgaaagaagcatcggcatgcatcaacaaaagctgcccgtcctccctgctcgcatctccttagcctagcccatctctcatccaagctaagtttgacatgcccgaggagatacacatgcatatgtttggttgcttacacgagagatacggtttggaagagattttgtttggatgattttatggatgatcacttctctttatttagttaggtgaggttatctataaaatatcatattaacatctgattcaattaattaggtgtactcttcaacatgcaaaatatgatttttttactaatgtgtaaatcattgttcccaaaagatgtgaaaaaaaaaccacatatacagtatgtgtgtgtcaaacctagctaatgcatcacagctagtatatgtgtgtgtcaagcagtagcagtaatctacagttaggctaatctgatcttaatgatcaagacacgcatgagtgagtaacaaaaaatgcattgtcttagaaaagtgggaactgggaagcttgcgtgtgagcgcctgagcggtaggagaagaaaaaaagaaaaaaaaaacagaaaaggagcgttgtttcctcgccgcccccgataattatccgcatgtgcagttagtgaaaaaaaaaaacaaaaaaggagcatcgttccttcatcctctttcctcgtcctcatcgccactcgtcattcctctcagctcgccgccccgattcatttgcttgccgccggatctgacgcctttggactcgtggccaacgaatcccgcggcgggaggaaggagagtgtgctgaatcccgttggattcggccgcctagaggccggcggacactggatccaaccgccttgaagccaaaggccgcccgatccacagcgcagcagtggcggcggcgacggcctcagcctagagctagcagtggtggtggtgacggcctcatcctccgacgagcagcggcggcctcccccttctccttgatggccgcatggtaggtgtggatcgaaggtgaccacggctgagagggagattgatgatggtgttggcggtgagtcagtttggttctcctgttattttgttgaatgtctaatatggcagaagaattttgatccgtgatttggttctgctgttgttgatgacgttgacggataattgaatcaatgtaaatttcctcttcttgatttctaaggtgcttctcatctttgacctgtggatgtggaattttttttcctaacttataaatgtggatgggggatttgggcaactgtggatgtgtgattcttcgtaatctgtaatcgtggatggggatcgaggggggggggatgtttacaagattgggttatcttgagggaattttggttgtaatttgtgtgtttatgttttcgattcggttagcttctcatacgggcattgagacagggaagcggggaaattcacatcgatgtgacggacaaaaacggattggctcggataatgtgacgattggaaaaaatatgaatcttttaattagttaagatatagatatagatatatatatatattttttcaatctttaacaataagcaaaggaattgcaaacatagtacacgttgagccgccgcagccgcacaattgtgccggaaaattcagttagttatatagtttgtctgccacttctaaccaaattctctacctaccaacatgctccattatccatagaaacctaactaaagatcacacaaccagcaaagcagcgcagtatccagcatccagccacaagaaaacatgacgagaacaatgctgacaagagcggtacctaccggagagcagtcgtcctcggaagcacaggcgcaagactttgacaagtgccaagactgtgatgtgccaaatagcagggaacattgcccccctagaaaaaaaaggtactacggagtagcagcagacaaatagtgacatggaacatggacatctttttattccgatcggagaaacaaccattaagtgaaatctcacgttttcagggttaaaaaacaaggacaatccgcacatccacatctctacactctccaaactcactatgcacacattttcttcccggtggcattgccgcgataagagaaagtagaaacatcactgtttctaccatgtctaacaggctaactgcctattattatctactactatgtacccttgattcacagcattgaaaactgcataaaagcctgctggtttacctagcaggcccgaacctcagcaaaccggcttggggttggctcacaattgttggtaagtttcagagatccaaagagacatgatagtcttctcatgatgggcttccggctgactatcacttccaacgacacaacgtccttcctggtatcggcataagtatcatatccctcgaggtccgcttctgttatgagtactgcgtcagtacacactgtagggctcgttggcctgggtaacattacttgacaaaggggtaaaccactatcttcgtaatcaagctccatggagtagtaatcatcaatttctgagttggtgatgcagtcatccccggcttctagaaaatggcccaggtttttactctgtattggaagacgcccggtggtgagggtactaaaaacgttgacagcctgcacaatcatgtcgttgcatgaagcagcttagcatttgtaggactgtagagtaatagctctcacttggacaaaatgcaataacaaaagacgtccccacacctgccactgcgatggtgccaaaagtactctaggcctaatggatcggacatgatctaatgctgcttctggactcatgctccgatatttaatctgcaagacaagtaatctgtcatcagcaaaatggagcgaaagatatacaatattgagttgctttaattattgtttatcctaccagataacacaaaacaatagtcgtgctacgccctcttccagctttacagtgaacataagtaatgccaccttctgatgcattccctgaaaaaaagagccaaagttaatatccagttgaggtcagcaaaaattgtctgcataaatggctacaatgcagaaagtgtgtaaaagcaggtttcctttcctgccagcagatatattaataatttcacttaataatcatggtgtatggtagtattatattgcactgacagctaacagatccttctcatcccatggttggaacttggagatgggatgtgaattagaacatgtcgctgcaacttaaatttgaacacctactacaccaacaactaattggccatgatcgcaaaccaaattccatatccattagttgaacgcagctatcacctgctccacaaaatcagagttgactgcaactagcttgacttcccttaatctgactaccggtagtagttttgttacctaaacctatgtcattgtttacatgcggaagaacaatatttcatactagtgttcgagaaaaaataaatattccatactacagagtcatacaggcattaaaaaaatcgaagtgtaaaagtgacacacttaggaccatgttcaacaaagggcatgaagccattaacattggccacctttaggactatatgttgatatgttccacaaagggcatgaacttacggtggataaaatctatggcttgacaaatatcctggagggctggtgcaaacaggtagtctcttgtgggaataataaggtggtcaatcccatgggcctgcaaaagtaggacttgttactcgtcaggaggatcttgcattgttgattgcaaacacaaaataaagtgattgaaaatcccctgaatgaatcaaatgaataaaattatgctttaaactcaacgagaagatgtctgacaacaaaagactacatcatacactctcacaacgagtaaataatgaagaccaagtctttccttctgattgagtagcgaatcaaggttcacaacacaaatgaaatcatgtactaagctaggaaatcaagtgataagagattttacctggtataaagatgttgggaccagggtctcataagcctcattcaatgttacaact
